United States Patent 9,862,959 (TRANSGENIC PLANTS WITH ENHANCED AGRONOMIC TRAITS) - sequence listing, part 2

SEQ ID NO: 3843 - protein, 445 aa, Mortierella alpina
MATPLPPSFVVPATQTETRRDPLQHEELPPLFPEKITIYNIWRYLDYKHVVGLGLTPLIALYGLLTTEIQTKTLIWSIIYYYATGLGITAGYHRLWAHRAYNAGPAMSFVLALLGAGAVEGSIKWWSRGHRAHHRWTDTEKDPYSAHRGLFFSHIGWMLIKRPGWKIGHADVDDLNKSKLVQWQHKNYLPLVLIMGVVFPTLVAGLGWGDWRGGYFYAAILRLVFVHHATFCVNSLAHWLGDGPFDDRHSPRDHFITAFVTLGEGYHNFHHQFPQDYRNAIRFYQYDPTKWVIALCAFFGLASHLKTFPENEVRKGQLQMIEKRVLEKKTKLQWGTPIADLPILSFEDYQHACKNDNKKWILLEGVVYDVADFMSEHPGGEKYIKMGVGKDMTAAFNGGMYDHSNAARNLLSLMRVAVVEYGGEVEAQKKNPSMPIYGTDHAKAE

SEQ ID NO: 3844 - protein, 545 aa, Sinorhizobium meliloti
MAAKEVKFGRSAREKMLRGVDILADAVKVTLGPKGRNVVIDKSFGAPRITKDGVSVAKEIELEDKFENMGAQMVREVASKTNDIAGDGTTTATVLAQAIVREGAKAVAAGMNPMDLKRGIDLAVAEVVKDLLAKAKKINTSDEVAQVGTISANGEKQIGLDIAEAMQKVGNEGVITVEEAKTAETELEVVEGMQFDRGYLSPYFVTNPEKMVADLEDAFILLHEKKLSNLQAMLPVLEAVVQTGKPLLIIAEDVEGEALATLVVNKLRGGLKIAAVKAPGFGDRRKAMLEDIAILTGGTVISEDLGIKLESVTLDMLGRAKKVSITKENTTIVDGAGQKSDIEGRVAQIKAQIEETTSDYDREKLQERLAKLAGGVAVIRVGGATEVEVKEKKDRIDDALNATRAAVQEGIVPGGGVALLRSSVKITVKGENDDQDAGVNIVRRALQSPARQIVENAGDEASIVVGKILEKNTDDFGYNAQTGEYGDMIAMGIIDPVKVVRTALQDAASVASLLITTEAMIAELPKKDAPAMPGGMGGMGGMDMM

SEQ ID NO: 3845 - protein, 542 aa, Mesorhizobium loti
MAAKEVKFHSDAREKMLRGVNILADAVKVTLGPKGRNVVIDKSFGAPRITKDGVTVAKEIELEDKFENMGAQMVREVASKTSDLAGDGTTTATVLAQAIVKEGAKAVASGMNPMDLKRGIDKAVEAIVQELKTNARKVTRNDEIAQVGTISANGDAEIGRFLAEAMQKVGNEGVITVEEAKTAETELEVVEGMQFDRGYLSPYFITNQDKMRVELEEPYVLIHEKKLSNLQALLPVLEAVVQSSKPLLIIAEDVEGEALATLVVNKLRGGLKVAAVKAPGFGDRRKAMLEDIAILTGGTAISEDLGIKLENVTLEMLGRAKKVVIEKENTTIVDGAGSKDEIQGRVSQIKSQIEETTSDYDKEKLQERLAKLAGGVAVIRVGGSTEVEVKERKDRVDDAMHATRAAVEEGVLPGGGVALLRAAKALDSVQAENEDQKHGIEIVRRAIEAPVRQIAENAGAEGSIIVGKLREKPEFGWGWNAQTNAFGDLYNEGVIDPVKVVRTALQDAASVAGLLVTTEAMVAEKPKKEPAVPAMPAGGMDF

SEQ ID NO: 3846 - protein, 396 aa, Methanocaldococcus jannaschii
MRNMQEKGVSEKEILEELKKYRSLDLKYEDGNIFGSMCSNVLPITRKIVDIFLETNLGDPGLFKGTKLLEEKAVALLGSLLNNKDAYGHIVSGGTEANLMALRCIKNIWREKRRKGLSKNEHPKIIVPITAHFSFEKGREMMDLEYIYAPIKEDYTIDEKFVKDAVEDYDVDGIIGIAGTTELGTIDNIEELSKIAKENNIYIHVDAAFGGLVIPFLDDKYKKKGVNYKFDFSLGVDSITIDPHKMGHCPIPSGGILFKDIGYKRYLDVDAPYLTETRQATILGTRVGFGGACTYAVLRYLGREGQRKIVNECMENTLYLYKKLKENNFKPVIEPILNIVAIEDEDYKEVCKKLRDRGIYVSVCNCVKALRIVVMPHIKREHIDNFIEILNSIKRD

SEQ ID NO: 3847 - protein, 578 aa, Tortula ruralis
MGNSCVGAAGYFQGFTSVIALGGRSSRSPSEVSPTPSKAESRGGSRAEAESPETQRKPPRPAHIPAVEPAETQQFKEVIEAMKKGREMKPVPGQSLTHSVLQRKTENLRDLYVLGKKLGQGQFGTTYLCIEKATNREYACKSIAKRKLISKEDVDDVRRELQIMHHLSGHPNIVMIKGAYEDPASVHLVMELCAGGELFDRIIQRGQYSEAKAAVLTRTIVGVVETCHSLGVMHRDLKPENFLFSSTKEDAALKTTDFGLSVFFKPGEVFRDVVGSPYYVAPEVLRKNYGPEADVWSAGVILYILLSGVPPFWAETEQGIFEQVLKSELDFASDPWPKISDSAKDLIRKMLTPQASKRLKAHQVLAHPWICEDGVAPDRPIDSAVQSRLKHFSAMNKLKKIAIRVIAESLSEEEIAGLKEMFKMMDTDNSGSISYEELKAGLKKVGSNLKEEDVRQLMDAADVDGSGAIDYGEFLAATLHLNKVERDENMFAAFSYLDKDNSGYLTVDELQHALAEFNMGDVSVEELLREVDQNNDGQIDYTEFVTMMRKGNMGGGAGRSSLRNSQQLSLTDVLGIGG

SEQ ID NO: 3848 - protein, 680 aa, Photobacterium profundum
MYFAYRIVVRPLTLMSLAVSNFDDDKVPQRINLKGRRFDDEISTLTETYNSSVNRIRDHYDELELAREEAEEANRKKSEFLANMSHEIRTPMNGIIGLSSLLQEMDMPKDQKEYIQMLNISSLSLLDLINDILDFSKIEAGRLELEHTSLNLFELNKEVESIFLVKASEKSIAFQCSIDKRIPPMLLGDATQLRQVLNNLVSNAIKFTHTGYVHLHTQLETDTDTETTIRFEVIDSGIGVSADKHEAVFDKFQQADGSTTRKYGGTGLGLSICRQIVHLMGGEIKISSEVDKGSTFYFTITFEKNVLVSASLEDSKALSEISVLLVDDSMLNMRITSAQLNNFGAKSICCDDATQAIDIVKQAIANKNPFDLVIIDKIMPHLDGFELAQLLTKEFGLDCPRLMMISAGPQMGDDLKAKQVGILACLSRPYKESNLKWTVKRVIKMTSDEVIATPLNCKRSLNGTETSQALSNATSPVMTPEMTTPENFLQSVHHANMPQASEINFLPKSNAEVKKASSPEESGVITNDSTAALTRELDPEASTPRAKVLVVEDAVVNQKVAKMMLEKLGVEVMIASNGQIGVDMYQEHDFDMIFMDCQMPVLDGFGATKAIRNLEQNTSHIPIIALTANVVKEEKDKCYEAGMDDFVSKPVSKKVLSAVLEKHLAIVLLAKKDITIKNNI

SEQ ID NO: 3849 - protein, 165 aa, Zea mays
MDGRMFGLETPLMVALQHLLDVPDGDAGAGGDKASGAAAGGGPTRTYVRDARAMAATPADVKELPGAYAFVVDMPGLGTGDIKVQVEDERVLVISGERRREEREDAKYLRMERRMGKFMRKFVLPDNADMDKISAVCRDGVLTVTVEKLPPPEPKKPKTIEVKVA

SEQ ID NO: 3850 - protein, 491 aa, Zea mays
MDPYKHRPSSAFNPPYWTTNSGAPVWNNDSSLTVGARGPILLEDYHCEKLANFDRERIPERVVHARGASAKGFFEVTHDITHLTCADFLRAPGVQTPVIVRFSTVIHERGSPETLRDPRGFAVNFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRPTCGVRSLMDDEAVRCGANHSHATKDLTDAIAAGNFPEWTLYIQTMDPEMEDRLDDLDPLDVTKTWPEDRFPLQPVGRLVLNRNIDNFFAENEQLAFCPGLIVPGIYYSDDKLLQTRIFSYSDTQRHRLGPNYLLLPANAPKCAHHNNHYDGSMNFMHRHEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 3851 - protein, 358 aa, Kluyveromyces delphensis
MSEWKVDPDNRRRLLQLQKVGANKRCVDCNAPNPQWASPKFGIFICLECAGTHRSLGVHISFVRSITMDQFKQEELVRMEKGGNEPFIEYMTSHGIDMTLPHKIKYDNPIAEDYKEKLSCEVEDKEFVEPKHPDFDPKALGKTSTPSVATKAGAGSITSNATSRQDTPIESRRTGTPQQKEKNEQYFAQLGQKNQERPDHLPPSQGGKFQGFGNTPVNNSKQANTNTMSLENLQTDPVGTLSRGWGLFSSALQKSFDDVNETYIKPNVQQWNTGELSEETKRAAAQFGQKFQETSTYGVQAFSSFTKQYITGEEDTMSNFNRTSPMPGTANSTNSTDNLLKKEKMRPPKAGEDEWEEF

SEQ ID NO: 3852 - protein, 484 aa, Nicotiana glutinosa
MVFISSNNQKQQLLSKIATNDGHGENSAYFDGWKAYENDPFHLINNPNGVIQMGLAENQLCFDLIQEWVVNNPKASICTIEGAENFKDIAIFQDYHGLPEFRQAVARFMENVRGDRVTFDPNRIVMSGGATGAHETLAFCLANPGDAFLVPTPYYPGFDRDLRWRTGVQLFPVVCDSSNDFKVTKKALETAYEKAQESNINIKGLLINNPSNPLGTLLDSDTLRDIVKFINSKNIHLICDEIYAATVFDQPKFISVSEIVEEHVGCNKDLIHIVYSLSKDMGFPGFRVGIVYSYNDTVVNIARKMSSFGLVSTQTQHLIASMLSDEIFVEKFIAESSERLGKRHGMFTKGLAQVGISTLKSNAGLFFWMDLRRLLKEPTFDSELELWRIIINEVKLNVSPGCSFHCSEPGWFRVCFANMDDETMRIALRRIRNFVLQTKGLNNKAAVKKQCSRSKLQISLSFRRMDDFMNSPVHSPMNSPLVRT

SEQ ID NO: 3853 - protein, 215 aa, Triticum aestivum
  misc_feature (205)..(205): Xaa can be any naturally occurring amino acid
MGEQKGNILMGKYEMGKMLGQGTFAKVYHARNIETSQSVAIKVTDKEKVLKGGLTDQIKREISVMKLVKHPNIVQMYEVMATKTKIYFVLEHVKGGELFNKVQRGRLKEDAARKYFQQLICAVDFCHSRGVYHRDLKPENLLLDENSNLKVSDFGLSTISECRRLDGLLHTSCGTPAYVAPEVINREGYDGAKADIWSCGGILFXLLAGYPPFPK

SEQ ID NO: 3854 - protein, 671 aa, Erwinia carotovora
MNNLIRITAIAGLLLAGSSFANENITRVEQIPQLHQEPQHATVSDRVASRFLRSHYRQFMLDAQFSEKIFNRYLNMLDYSHNVLLASDVAQFSGQKAQLGDALKSGQLDIPYALYNLAQKRRFERFQYALSLLDKPVDLTGNDTFELDRSKAPWPQNAGELNRLWDAKVKYDWLSLKLTGKDDKDIKETLTKRYQFAIRRLAQSNSEDVFQLVMNAFAREIDPHTSYLSPRNTEQFNTEMSLSLEGIGAVLQMDDDYTMINSMVPGGPAAKSKNITVGDRVVGVGQSGKPMVDVIGWRLDDVVALIKGPKGSKVRLEILPAGKGTKTRIITLTRERIRLEDRAVKMSVKTVGKDKVGVLDIPGFYVGLTDDVKVQLQKLEKQNVSSIVIDLRTNGGGALTEAVGLSGLFIPSGPVVQVRDNNGKVREDSDTDGIVYYKGPLVVLVDRFSASASEIFAAAMQDYGRALIVGEPTFGKGTVQQYRSLNRIYDQMLRPDWPALGSVQYTIQKFYRIDGGSTQMKGVTPDVMMPTGTETVDTGEKFEDNALPWDSIKAANYIKSGDLKALISKLNEHHQERIAKDPEFQFVAQDIARYNAMKDKRNLVSLNLAQREKENDDDEAMRLNRINDRLAREGKKPLKSLEDLPKDYQAPDPYLDETVKIANDLAQDQKE

SEQ ID NO: 3855 - protein, 73 aa, Oryza sativa
  misc_feature (57)..(57): Xaa can be any naturally occurring amino acid
AILFTYPTSGSFNRTGLVISSKSPSLSVVYTLTIASADTHFKSASDSVHFTESVTQXFRKHRVPVEGLFCIVC

SEQ ID NO: 3856 - protein, 324 aa, Neisseria gonorrhoeae
MDTLTRFLPEHLQQNQLPEALGGVLLSVVSACTEINAKVRLGALAGVLGMAGTGNIQGEDQKKLDVIANNIMIDTLKANPAVAGLASEEEDTFVSAGENGRYLVLFDPLDGSSNIDVNISVGTIFSILAKPEGALATESFLQTGRQQLAAGYVLYGPQTQLVFTFGHGVYVFTLNAENEFVLTKENPKVPESTKEFAINMSNRRHWLPPVQQYVDELLAGETGTRGKNYNMRWVASMVAEIHRILMRGGVFMYLQDKRDPSKPGKLRLMYEANPMALILEQAGASASNAYQAMLDIQPESLHQRVAVIMGSSEEVDYLNRLHSK

SEQ ID NO: 3857 - protein, 336 aa, Candida glabrata
MGSHEGIDTDVISLPRFIIEYQKRVHNATGEFTLVLNALQFAFKFIAHAIRRAELIHLGGLFGTSNATGDEQKKLDVIGDEIFINTMESSNCVKILVSEEQEDMIVFEHNTGNYAVCCDPIDGSSNLDAGVSVGTIVSLFKLQPGSTGKVEDVLRPGTEMVAACYAMYGASTHLVLTMGDGVNGFTLDTNLGEFILTEPDMRVPMYRQIYSINEGNTYYWNDNIKSFINFLKEPQDDGKPFSARYVGSMVSDMHRTFLYGGIYAYPEDKKNPKGKLRLLYEAFPMAFLMEQAGGKAVTDRGERILDLTPTHIHDKSSIWVGSPGEIDKFLKHIGKA

SEQ ID NO: 3858 - protein, 691 aa, Magnaporthe grisea
MATNGSNTVVANEGTVEHIGAVKLDPWLEPFEDVIKRRHGMAEDWLKKIEQSEGSIEKFTRGTEVYGFNVKPDNTIVYREWAPNATAAFLVGDFNQWSRQSHPMKKNEYGVFEITVPPTAAGEPAIPHNSKVKISLFLPNGQLIDRLPAWIKYVTQDLSVSPAYDARFWNPPSSERYTFKNPRPKKPKSVRVYEAHVGISSPELRVATYKEFTKNMLPRIKKLGYNVIQLMAIMEHAYYASFGYQINNFFAASSRYGTPEDLKELIDAAHGMGLTVLLDVVHSHASKNVLDGINEFDGTDHQYFHAGGKGRHDQWDSRLFNYGHHEVLRFLLSNLRFWMDEYQFDGFRFDGVTSMLYLHHGMGTGFSGGYHEYFGPDADEEALVYLMLANKMLHELYPEVISIAEDVSGMPTLCLPWSDGGVGFDYRLAMAIPDMWIKILKEKKDEEWDMADICWTLTNRRHGEKTIAYCESHDQALVGDKTLMMHLCDAEMYTHMSTLTPLTPIIDRGMALHKMIRLLTHGLGGEGYLNFEGNEFGHPEWLDFPREGNQNSFWYARRQLNLTEDNLLRYRFLNDFDAAMNNCEEKHGWLSAPQAYISLKNESDMVVVFERAGVVFAFNFHPTQSFADYRIGVDVSGTYKVALTTDDKEFGGHGRIDSSTRFFTTPMEWNGRKNWTHIYLPSRTAVVLELE

SEQ ID NO: 3859 - protein, 479 aa, Anabaena variabilis
MSDLVLFWHRRDLRITDNIGLATARQHSSKVVGVFCLDPNILERDDVAPVRVTYMIGSLQELQQRYVQAGSQLLILRGDPVQAIPHLAEALNAKAVFWNWDVEPYSQTRDRAIIATLKDKGIQCLTHNWDQILHSPDEIRSGSNTPYTVYTPFWKNWSSKPKAKPVETLHNVEGLTEAEQELAQKAGVKALPTAKDLGFFWDADLIIAPGEAAAQAKLAEFTAKAITEYQEQRNFPGVNGTSQLSAALKFGVIGIRTVWQTTLEALENSRSEETTTSIRTWQQELAWREFYQHAMYNFPELADGAYRATFKNFPWETNEEHFQAWCEGKTGYPIVDAAMRQMNESGWMHNRCRMIVASFLTKDLLINPQWGEKYFMQKLIDGDLSANNGGWQWSASSGMDPKPLRIFNPASQSQKFDPDAEYIRQWVPELRSMDTEYLVTGKITPLERHAVGYVKPIVDHQKQQQLFKQRYQQQKAIGI

SEQ ID NO: 3860 - protein, 1039 aa, Cryptococcus neoformans
MSRVPSGSQQPQYTQQPLYHPSSVHSQSTPIQQTHQQYHPHTGQPMTFQGDAHAYSYDRQSQINTWQANPGAAGSMEYHSAVAGSSRGADPYQPYSQSHRSSPSQSVTASRTQPASAQQYTPWAPVQTSATTPSSRGGGVKLEDLMSSDSRAGGKNQPLSGIPLSVSASFDTRSQFSAGPQGASAEKEKDKERDKATQQQGPSEFIKKLYKMLEEEQAQYGNSRTKKGEKGKRGSVGWGANGTSFVVWDMNDFTTKILPQTFRHSNFSSFVRQLNKYGFSKIKHVDAGTGSIKENIWEFQHPNFQAGGKSDLESIKRKPVAPKKANNQEGDENSPRHIGLSNEDQTRMHLMEDRINMLEDALAKSRSEADEARMREMAMMGLVRDMIGHIAASESEAIGSPAATTGHSPRVLHLLKSLDNLARAYPPEMYHSNIARQPTTMPYTPAQPQSHQSFLNAAYNPAFSGNSVGGAAQAQASPHTDGTGSRGSFSGPSTGEIKPPASSSRLRAASNAGAAPSGSVNASVPLASQPTGNPPAGPVARAEDPAEDVIEIPNQMQDMYGGESVGIAPLFVETPAWLTEGTTVPLTMYRKQSDGQVLKAVYQAFAAGGKLPAGEGQDEDGNAIASGSSTSAAEIMAGSSQMGLQQSYGAGSSTSTGIPLPMEGSPSSESSSRKGKGKKSRGTSLKEQRESKLKPHWAQTPRILVVEDDIVYRTLSKKFLQKFGCETETVENAQGAVDKMNGTKYDLVLMDIFFGPNMDGRKATSLIRQFNNYTPIISMTSNAQPQDVDSYYQSGMNDILAKPFTKNHLFTILDKHLVHLRHAQLYERLIPLGVGVPPLSDQHVQEALAVSAANLQNTNGQLQLENGPTAETQNEQQDSNGELELGIRNPLAGSGWSDEAYQLVLAQFLQTGVMPDITTISAVSSSPNPNGIDGTIGTSIVFGESSGFSRKRSIEAISDDNWDGQAQTSASAQAQTQAQVQNTIMQGDQQQGMSLQMPMNVGMGMEVNMGNMPESGMMNQDISNGSDGREAKRARGMAG

SEQ ID NO: 3861 - protein, 917 aa, Pseudomonas fluorescens
MLKKLGIKGRVLLLTLLPTSLMALVLGGYFTWMQLSDLQTQLLQRGEMIAEQLASLVAPAMGNHNTQMLERIATQALEQQDVRAVSLLAPDRSLLAHAGPSMLNPPPAGNSSHMMQRSGSDATRYQLPVFGRHRNLAGDLIPDESDRLLGWVELDLSHSGMLLRGYRNLFASLLLIPAGLAVTALLAVRMGRTINNPLTQIKQAVAQLKDGNLETRLPPLGSQELDELASGINRMASTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLNLPKTRDDAEDLPGPPLLGRRVAVLENHELARQALQHQLEDCGLEVTPFNTLEALTNGITGVHQSEQAIDLAVLGITTNDMSPERLSQHIWDLEHLGCKVLVLCPTTEQTLFHLSVPNPHSQLQAKPACTRKLRRALSDLVTPRRARSEPEETLSSRAPRVLCVDDNPANLLLIQTLLEDMGAKVLAVDNGYAALNAIQTEPFDLVMMDVQMPGMDGRKSTEAIRQWESERHGTPLPIVALTAHAMANEKRALLQSGMDDYLTKPISERQLAQVVLKWTGLALRNQGPERASERPELGLELQVLDQDEGLRLAAGKADLAADMLAMLLASLDADREAIKAARAANDQNALIERVHRLHGATRYCGVPQLRAACQRSETLLKQEDAKAFAALDELDHAIGRLAAEARTNA

SEQ ID NO: 3862 - protein, 278 aa, Unknown
  Nocardioides sp. JS614
MAIPTHQLNDGSTLPAIGFGTYPMKGEEGVTAIRGAIEVGYRLLDTAVNYQNETAVGEAIRRSRVPRELLQVTSKLPGRDHGYDDAIASVHGSLERLGLEYLDLHLIHWPNPSRDQYVDAWRALVDLREQGLVRSIGVSNFTERHLERIIAATGVTPAVNQIELHPYFPQADMRAVDEGLGIRTEAWSPLGKRQAPFAEPAVADAARRHGMTPGQVILRWHVQLGSIPIPKSAAPERQRQNLDVFGFELSEDEVAAITALGRPDGRLFGGDPDVHEEM

SEQ ID NO: 3863 - protein, 487 aa, Candida albicans
MAPTFTNSNGQPIPEPFATQRVGQHGPLLLQDFNLIDSLAHFDRERIPERVVHAKGSGAYGVFEVTDDITDICAAKFLDTVGKKTRIFTRFSTVGGELGSADTARDPRGFATKIYTEEGNLDLVYNNTPVFFIRDPSKFPHFIHTQKRNPETHLKDANMFWDYLTSNEESIHQVMVLFSDRGTPASYREMNGYSGHTYKWSNKKGEWFYVQVHFISDQGIKTLNNEEAGALAGSNPDYAQEDLFKNIAAGNYPSWTAYIQTMTEAEAKEAEFSVFDLTKVWPHRKYPMRRFGKFTLNENPENYFAEVEQAAFSPAHTVPYMEPSADPVLQSRLFSYADTHRPHRLGTNYTQIPVNCPVTGAVFNPHSRDGAMTVNGNLGSHPNYLASDKPVEFKQFSSFQEDQEVWNGAATPFHWKATPADFKQAQELWKVLKRYPNQQEHLAHNIAVHAAGADAAIQDRVFAYFGKVSQDLADAIKKEVLELSPRK

SEQ ID NO: 3864 - protein, 159 aa, Glycine max
MAGMVFGLDAPMMAALQHLLDIPDGEAGAAAGEKQGPTRAYVRDARAMAATPADVKELPGAYAFVVDMPGLGSGDIKVQVEDERVLVISGERRREEKEDAKYLRMERRMGKLMRKFVLPENADMEKISAACRDGVLTVTVDKLPPPEPKKPKTIQVQVA

SEQ ID NO: 3865 - protein, 155 aa, Oryza sativa
  misc_feature (86)..(86): Xaa can be any naturally occurring amino acid
MSMIRRSNVFDPFSLDLWDPFDGFPFGSGSGSLFPRANSDAAAFAGARIDWKETPEAHVFKADVPGLKKEEVKVEVEDGNVLQISXGERIKEQEEKTDKWHRVERSSGKFLRRFRLPENTKPEQIKASMENGVLTVTVPKEEPKKPDVKSIQITG

SEQ ID NO: 3866 - protein, 251 aa, Triticum aestivum
  misc_feature (176)..(176): Xaa can be any naturally occurring amino acid
  misc_feature (194)..(194): Xaa can be any naturally occurring amino acid
  misc_feature (204)..(204): Xaa can be any naturally occurring amino acid
  misc_feature (227)..(227): Xaa can be any naturally occurring amino acid
MPTPHAKIPFPSSHPLTSTPAANSSNPRRPTPTLPGACASDASAPASATGGAVMVGFFRSGNLASRVFDRQFLSPRPGATVNTVRQFYENLVPSYTIYDIDCPDYSFRKFTDDGKYLVAFSRNHQDLIVYRPIWLTFSCHEECDSHDLPANAERFDSFFKQLYSISLASSNEYICXKDFFLYMECHQYGLFATXSTAQSNDSSXSTEGAIHGVPSIEKITFYLVRLXDGAILDEKAFCNDFINLAHSNWCI

SEQ ID NO: 3867 - protein, 613 aa, Arabidopsis thaliana
MESCDCFETHVNQDDLLVKYQYISDALIALAYFSIPLELIYFVQKSAFFPYKWVLMQFGAFIILCGATHFINLWMFFMHSKAVAIVMTIAKVSCAVVSCATALMLVHIIPDLLSVKNRELFLKKKADELDREMGLILTQEETGRHVRMLTHGIRRTLDRHTILRTTLVELGKTLCLEECALWMPSQSGLYLQLSHTLSHKIQVGSSVPINLPIINELFNSAQAMHIPHSCPLAKIGPPVGRYSPPEVVSVRVPLLHLSNFQGSDWSDLSGKGYAIMVLILPTDGARKWRDHELELVENVADQVAVALSHAAILEESMHARDQLMEQNFALDKARQEAEMAVHARNDFLAVMNHEMRTPMHAIISLSSLLLETELSPEQRVMIETILKSGNPGSTHASDVLDLSRLEDGSLLLENEPFSLQAIFEEVISLIKPIASVKKLSTNLILSADLPTYAIGDEKRLMQTILNIMGNAVKFTKEGYISIIASIMKPESLQELPSPEFFPVLSDSHFYLCVQVKDTGCGIHTQDIPLLFTKFVQPRTGTQRNHSGGGLGLALCKRFVGLMGGYMWIESEGLEKGCTASFIIRLGICNGPSSSSGSMALHLAAKSQTRPWNW

SEQ ID NO: 3868 - protein, 590 aa, Pseudomonas syringae
MCGLAGELRFDHQPADLAAVERITHELAPRGPDAWGFHSQGPVALGHRRLKIMDLSDGSAQPMIDSNLGLSLAFNGAIYNFPELRAELESLGYQFHSGGDTEVLLKGYHAWGADMLPKLNGMFAFAIWERDSKQLFIARDRLGVKPLYLSKTDKRLRFASSLPALLKGGDISGMLDPVALNHYLNFHAVVPAPRTLLAGVEKLPPASWMRIDASGKVEQKVWWTLPYGPHEDEKNLTLEDWRDRVLDSTREAVAIRQRAAVDVGVLLSGGVDSSMLVGLLREVGVEDLSTFSIGFQDAGGERGDEFQYSDLIAKHYGTRHHQLRIQEREIIEQLPAAFRAMSEPMVSHDCIAFYLLSREVSKHCKVVQSGQGADELFAGYHWYPQVDGASDPVAAYRDAFVDRSYAEYAETVQPKWRTANDAAGDFVRDHFAQPGASAAVDKALRLDSTVMLVDDPVKRVDNMTMAWGLEARTPFLDYRLVELSARIPGKFKLPDGGKQVLKEAARMVIPSEVIDRKKGYFPVPGLKHLQGDTLNWVRELLTDSSQDRGLFNPAMVDKLLTNPEGQLTPLRGSKLWQLAALNLWLSEQGL

SEQ ID NO: 3869 - protein, 252 aa, Francisella tularensis
MQIKRWFLNNSLRNYQYLLYDKSHAIVIDPLKSDIFAEFIAKNKLQLEAILITHKHGDHIAGVKKLLAIYLNAKVYAYTGNDLFKPDIYVKDGSFINLGFTSFRVMYIPGHIDDHVCFLFEQERALFCGDTLFNAGVGGVQAESADINQLYDSLVKITKLDGDIKPYPAHDYWLGNLDFALSILADDSYFNYYRNQVAELAAEDKPIVNLAEEAKLNIFIRAMSDKALLKALPDYSLGREMFVKLRQLKNNF

SEQ ID NO: 3870 - protein, 477 aa, Neurospora crassa
MASTSATDIPAEVQAVNVPDGTTDFIPLRGKKYDLKKPHITELPITWGNWYKHVNWLNTTFIIFVPLAGLISAYWIPAQTKTILFSIAYYYFAGLGITAGYHRLWAHTSYKATLPLKIWLAAGGAAAVEGSARWWSRDHRAHHRYTDTDKDPYSVRKGLLYSHIGWMVMKQNPKRIGRTDITDLNEDPVVVWQHKHYIKCVIVMALIVPTLICGLGWGDYAGGFIYGGILRIFFIQQATFCVNSLAHWLGDQPFDDRNSPRDHVITALVTLGEGYHNFHHEFPSDFRNAIEWWQYDPTKWCIWVWKQLGLAYDLKKFPHNEIEKGRLQQQQKKLDQKRATLDWGIPLENLPVVSWDDFVQESKNGKAWIAVAGVIHDVGKFIQDHPGGKALINSAIGKDATAIFNGGVYNHSNAAHNLLSTMRVGVIRGGCEVEIWKRAQAENKDIATVTDSSGKKIVRAGLQPTRVTPPVTTADAA

SEQ ID NO: 3871 - protein, 205 aa, Ustilago maydis
MASRKKVLLKVIILGDSGVGKTSLMNQYVNKRFSSAYKATIGADFLTREVMVDDRLVTMQLWDTAGQERFQSLGVAFYRGADCCCLCYDVNNAKSFETLDSWRDEFLIQAAPHDPENFPFVVLGNKIDVEESKRMVSQKRAMTWCQSKGNIPYFETSAKEAINVEQAFQTIARAALQQEAEAELYADYPDPIRIDQDNQQSGCNC

SEQ ID NO: 3872 - protein, 336 aa, Pseudomonas syringae
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDITIPESTQEFAVNMSNQRHWEAPVQRYVSELLAGEDGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKA

SEQ ID NO: 3873 - protein, 191 aa, Araucaria araucana
DDHREVVAEIRRANLEPYLGLHYPATDIPQASRFLFMKNKVRMIYDCRADGVKVIQDKRLAKPLSLSSSALRALHGCHAQYMANMGSVASFVMAVTINENETDEETSGSGQKGGRRLWGLVVCHHTSPRFVPFPLRYACEFLMQVFGIQLNKEVELAAQLRVKHMLRTQTVLCDMLLRDAPVGIVTQTPNI

SEQ ID NO: 3874 - protein, 234 aa, Triticum aestivum
  misc_feature (32)..(32): Xaa can be any naturally occurring amino acid
  misc_feature (55)..(55): Xaa can be any naturally occurring amino acid
  misc_feature (63)..(63): Xaa can be any naturally occurring amino acid
  misc_feature (82)..(82): Xaa can be any naturally occurring amino acid
  misc_feature (121)..(121): Xaa can be any naturally occurring amino acid
GGPPRGGGAPCLQGWPKRNDSPPPVSRGRTLXLCLLNVSPGGKQVVQAPHPDCFXAPGPAEFXCSVWGNSFSFYQGGGGHQXSHPVKQPSPSPDAAAGPMVALPAVAPVLPSAERATWSTXAGSSDGTTNRVHRCSICPKEFPTGQALGGHKRKHYDGGVGSVAPSSTELLAAAAAESEVGSTGNGSSAARAFDLNIPAVPEFVWRPCAKGKMWEDEEEVQSPLAFKKPRLLTA

SEQ ID NO: 3875 - protein, 464 aa, Listeria monocytogenes
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVCYKLKDDANVNWTLYDLADRLQMRGWQVPAYPLPKSLENIIIQRYVCRADLGFNMAEEFIQDFQASIQELNNAHILFHDTQQSGVHGFTH

SEQ ID NO: 3876 - protein, 191 aa, Araucaria araucana
DDHGEVISEVRKSDLEPYLGLHYPATDIPQASRFLFMKNRARMICDCCASPVRVVEDKRLPRELNLCGSTLRAPHGCHAQYMSNMGSISPLVMAVIVHEKEEERSRCGPQQQKGRRLWGLVVCHHTSPRFVPFPLRYACEFLMRVFGIQLNREIELAAQSREKHILRTQTLLCDMLLRDAPMGIVTQKPNI

SEQ ID NO: 3877 - protein, 212 aa, Unknown
  Vibrio sp. Ex25
MKKVLITGFEPFGGDAINPALEAVKRLEAAAIEDAMIVTCPVPVIRHESVNTVIDAIEAHQPDCVITVGQAAGRGAITPERVAINVDDFRIPDNGGHQPIDEPVVADGPDAYFSTLPIKRVVQTLQKQGIPSQISNSAGTFVCNHLFYGIQHYLKDRPIRHGFVHIPLLPEQAADGRQPSMSLEMIVEGLRLVAQVCIANENDILVSGGSIC

SEQ ID NO: 3878 - protein, 547 aa, Bartonella quintana
MAAKEVKFGREARERLLRGVDILANAVKVTLGPKGRNVVIDKSFGAPRITKDGVSVAKEIELEDKFENMGAQMLREVASKTNDIAGDGTTTATVLGQAIVQEGVKAVAAGMNPMDLKRGIDAAVEEVVGNLFKKAKKIQTSAEIAQVGTISANGAAEIGKMIADAMEKVGNEGVITVEEAKTAETELEVVEGMQFDRGYLSPYFVTNADKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGKKAEINARVNQIKVQIEETTSDYDREKLQERLAKLAGGVAVIRVGGATEVEVKEKKDRVDDALNATRAAVEEGIVAGGGTALLRAANALAIKGSNPDQEAGINIVRRALQAPARQIATNAGEEAAIIVGKVLENNADTFGYNTATGQFGDLIALGIVDPVKVVRSALQNAASIASLLITTEAMVAEVPKKDTPMPPMPGGGMGGMGGMDF

SEQ ID NO: 3879 - protein, 392 aa, Zea mays
SAIAPCLSYARGTGSAPSASCCLNRPTPFVGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTDKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDSVVAKKSVLEIEREVAARWRNAVNKKKTGVC

SEQ ID NO: 3880 - protein, 731 aa, Erwinia chrysanthemi
MFVAAMTESDQNIINLLFSGHYADPFAVLGMHDTASGLEVRALLPDAIDVWVVDAHSGRKVANLQCRDPRGFFASAIPRRKKPFSYRLAVTWPQDTQVIDDPYRFGTLLQELDIWLLAEGRHLRPFETLGAHPSTLDGVVGTCFAVWAPNAQRVSVVGDFNFWDGRRHPMRRRRENGVWELFVPGVGPGQLYKFEIIDCYGNVLVKSDPYAFESQMRPDTASVVSRLPPALPVDEARQHANELQSPISIYEVHLGSWRRHTHNNFWLSYRELADQLVPYVKEMGFTHVELMPVHKHPFDGSWGYQPLGLYAPTRRFGSPDDFRYLVSAFHEAGINVLLDWVSGHFPADSYGLARFDGPALYEYADPKEGYHQDWNTLIYNFDRHEVRNYLAGNALYWTERFGVDGLRVDAVASMIYRDYSRRDGEWVPNYFGGKENLEAIGFLRYTNQMLGQHHAGAVTIAEESTDYAGVTLPPEHGGLGFHYKWNMGWMHDSLAYMQLDPVHRKYHHDLLTFGMLYAYSENFVLPLSHDEVVHGKRSLLDRMPGDVWQKFANLRAYYGFMWAYPGKKLLFMGGEFAQGREWNHDTSLDWHLLDEPEGWHAGVQQLVRDLNHCYRQHPPLYQCDYLHQGFEWVVVDDRENSVFAFIRRDADGNEMLIISNFTPVPRDSYRVGINQPGAWREVLNTDSWHYHGGNLGNQGLVYSETVGSHSRPQSLVLALPPLATLYLVKEA

SEQ ID NO: 3881 - protein, 357 aa, Arabidopsis thaliana
MDRPAVSGPMDLPIMHDSDRYELVKDIGSGNFGVARLMRDKQSNELVAVKYIERGEKIDENVKREIINHRSLRHPNIVRFKEVILTPTHLAIVMEYASGGELFERICNAGRFSEDEARFFFQQLISGVSYCHAMQVCHRDLKLENTLLDGSPAPRLKICDFGYSKSSVLHSQPKSTVGTPAYIAPEVLLKKEYDGKVADVWSCGVTLYVMLVGAYPFEDPEEPKNFRKTIHRILNVQYAIPDYVHISPECRHLISRIFVADPAKRISIPEIRNHEWFLKNLPADLMNDNTMTTQFDESDQPGQSIEEIMQIIAEATVPPAGTQNLNHYLTDDDMEEDLESDLDDLDIDSSGEIVYAM

SEQ ID NO: 3882 - protein, 125 aa, Triticum aestivum
  misc_feature (34)..(34): Xaa can be any naturally occurring amino acid
  misc_feature (68)..(68): Xaa can be any naturally occurring amino acid
  misc_feature (74)..(74): Xaa can be any naturally occurring amino acid
  misc_feature (96)..(96): Xaa can be any naturally occurring amino acid
  misc_feature (103)..(103): Xaa can be any naturally occurring amino acid
PARRTFQGSPDLKAAREVADYLGTIHHEFHFTVXDGIDAIEEVIYHDETYDVTTIRANTPMFLMARKXIKSLGXVRWCVPGKGSEQLLGRLLYFNXAPNKEGXHKEDCRKGEGLHNTPARNKATS

SEQ ID NO: 3883 - protein, 581 aa, Triticum aestivum
MCGILAVLGCGDESQGKRVHVLELSRRLKHRGPDWSGLHQVADNYLCHQRLAIIDPASGDQPLYNEDKSIAVAVNGEVYNHEELRARLSGHRFRTGSDCEVIAHLYEEYGESFIDMLDGVFSFVLLDARDNSFIAARDAIGVTPLYIGWGIDGSVWISSEMKGLNDDCEHFEIFPPGNLYSSKEKSFKRWYNPPWFSEVIPSVPYDPLRLRSAFEKAVIKRLMTDVPFGVLLSGGLDSSLVAAVAARHFAGTKAAKRWGTRLHSFCVGLEGSPDLKAAKEVADHLGTVHHEFNFTVQDGIDAIEDVIYHIETYDVTTIRASTLMFQMSRKIKALGVKMVISGEGADEIFGGYLYFHKAPNKEEFHQETCRKIKALHQYDCLRANKATSAWGLEVRVPFLDKEFINEAMSIDPEWKMIRPDLGRIEKWILRKAFDDEERPFLPKHILYRQKEQFSDGVGYSWIDGLKDHAASNVSDKMMSNAKFIYPHNTPTTKEAYYYRMIFERYFPQSSAILTVPGGPSVACSTAKAIEWDAQWSGNLDPSGRAALGVHLSAYEQDTVAVGGSNKPGVMNTVVPGVAIET

SEQ ID NO: 3884 - protein, 313 aa, Zea mays
  misc_feature (62)..(62): Xaa can be any naturally occurring amino acid
MARKPLDYHELNENLKRVQYAVRREPYLRASELQKEGKKIIFTNVGNPHALGQKPLTFPRQXVVALCQAPFLLDDLLVGLMFPADAIARAKHYLAMAPGGLGAYSDSRGIPGIRKEVADFIHKRDGYPSDPELIYLTDGASKGVMQILNTIIRNEMDGILVPVPQYPLYSATISLYGGSLVPYYLEEEANWSLDFVNIRQTVAEAPSKGISVMFDMGPPISRAMYSFPQIRLPPRAIEAARRAGKSADVFYCLKLLEATGISTVPGSGFGPKQRLFRLRTTILPAEEDFPAIMRSFKKFNDSFMEQYEGYSRL

SEQ ID NO: 3885 - protein, 750 aa, Bifidobacterium longum
MAKETKIEEDTVTVPVAQGDLDATSNAEFYNPHGVLGGHLGIGKHADTATIRVLRPLAKSVTILTQDGEYPMTHEYNGVFVVTVPASGTKKQPTIPDYRVRTEWESGAVLIEDDPYRYMPTVGDMDTYLFGEGRHEKLWETLGAHVLRYDDPMGGADGTPGEQVVGTAFSVWAPNAHAVRVVGNFNAWDGRRHAMRELGSSGVWEIFIPGIGAGETYKFQILNANYTWEMKADPMERQHEVPPNTASIVTESTYKWNDDAWMQHRRTTNPHDGPVSIYEVHAGSWRQGLTYRDLAKQLVDYVKQEGFTHVEFMPLAQHPFSGSWGYQVTGYYAVDSRLGSPDDFRYLVDQFHQAGIGVIMDWVPAHFPKDAFALGRFDGTPLYEDPDPLRGEHPEWGTYVFNFGRREVRNFLVANALFWLEDLHVDALRVDAVSSMLYLDYSREPGHWRPNIYGGRENLEAIDFLKEATATAYKNNPGVMVIAEESTAWPGITAPTSAGGIGFGMKWNMGWMHDTLEYLHEEPINRKWHHNEITFSMVYAYSEHYVLPISHDEVVYGKGSLYGKMPGDDWQKLAGVRSMFAYQWAHPGKKLSFMGNELAQWGEWDHDASIDWDCLNWQEHRQVQTMVADLNAFYKAHPALWSQDFDPAGFQWLTSDDADHNTLSFLRIGTKGETLAVVVNFSGEAWSDYQVALPTGGKWTEVFTTDDAKYGGSDIHNGTFEAVEGEYHSRPFSAKITVPALGVVFLKPED

SEQ ID NO: 3886 - protein, 472 aa, Glycine max
SARGPGSHIVVLAFVLLISSKLAECHNIVRFLPGFQGPLPFLLETGYVEVGETEAEEHAELFYYFIESENDPKGNPLLLWLTGGPGCSAFSGLVFEIGPLTFKNEEYNGSLPNLTLKPQSWTKVSSIIFVDLPAGTGFSYPKTERAVHQSSSKLVRHAHQFIRKWLIDHPEFLSNEVYIAGDSYCGIPVPVIVQEISNGNEGGMQPWIYIQGYLLGNPITTSTEKNYEIPFNHGMALISDELYESLQKNCRGEYRNIDPRNALCLRDMQSYEESISGIETGHVLAPLCDESDLRNDMEVTWRRSSLAHKTSAFFSPRLTLPPLYCRSHAYVLCSYWANDDNVRKALHVRKGSIGKWTRCNDDLKSKFNADIPSSFQYHVNLSRKGYRSLIYSGDHDMVVPFLATQAWIRSLNYSIVSDWRQWYYDGQVAGYTRTYSNRMTFATVKGGGHTAPEYKPEECLAMFSRWISNMPL

SEQ ID NO: 3887 - protein, 147 aa, Bdellovibrio bacteriovorus
MPMRSLSPWGGRRLPSSDLFSQFQDFINEFDRGESSALTRAGFDFSPSVDVEEKDNAYLVSADLPGMKKDEIKVELNDNILTISGERTRESKSEGGYSERSYGRFQRSFTLPVQVNSEKIEAHFEDGVLQITVPKAEGARSHSIKIM

SEQ ID NO: 3888 - protein, 483 aa, Vibrio salmonicida
MSKKLTTAAGCPVAHNQNVQTAGKRGPQLLQDVWFLEKLAHFDREVIPERRMHAKGSGAYGTFTVTHDITKYTKAKIFSDIGKKTDMFARFSTVAGERGAADAERDIRGFSLKFYTEEGNWDLAGNNTPVFFLRDPLKFPDLNHAVKRDPRTNMRSAKNNWDFWTSLPEALHQVTIVMSDRGIPATYRHMHGFGSHTFSFINSDNERYWVKFHFVSQQGIKNLSDAEAGELVGNDRESHQRDLLDSIDNQDFPKWTLKVQIMPEADAATVPYNPFDLTKVWPHKDYPLIEVGEFELNRNPQNYFAEVEQAAFNPANVVPGISFSPDKMLQGRLFAYGDAQRYRLGVNHQHIPVNAPRCPVHSYHRDGAMRVDGNFGSTLGYEPNDQGQWAEQPDFSEPPLNLDGAAAHWDHREDEDYFSQPGDLFGLMTAEKQAILFDNTARNLNGVPKEIQLRHVTHCYKADPAYGEGIGKLLGFDISEYNS

SEQ ID NO: 3889 - protein, 574 aa, Candida glabrata
MCGIFAAYKHQDVHAFKPKALQLSKRIRHRGPDWSGNVVKNSTIMVHERLAIVGLDSGAQPITSEDGDYTLCVNGEIYNHIQLREQFPDYKFKTLSDCEPIIPAYLEHDIDAPKYLDGMFAWCLYDAKQDRIVAARDPVGITTLYMGRCSSSPKTVFFASELKCLTDDCDEITAFPPGHVYDSKTDQITRYFTPDWIDESRIPTTPVNFKDIRESLEKAVRKRLMAEVPYGVLLSGGLDSSLIASIAARETEKANEENDAADNDASASKQLAGIDNQGHLHTAGWSRLHSFAIGLPNAPDLQAARKVAKFIGSIHHEHTFTLQEGLDALDDVIYHLETYDVTTIRASTPMFLLSRKIKAQGVKMVLSGEGSDEIFGGYLYFAQAPSATEFHIESVKRVKNLHLADCLRANKSTMAWGLEARVPFLDKEFLQLCMNIDPKDKMIDQSAGRIEKYILRKAFDTSDEPDVKPYLPEEILWRQKEQFSDGVGYSWIDGLKDTAERVISDTMFSNPKIEWGEDIPTTKEAYWYRLKFDALFPQKTAASTVMRWIPKADWGCAEDPSGRYAKIHEQHVTA

SEQ ID NO: 3890 - protein, 117 aa, Glycine max
NEEEEQIRKMASKVPKKANLLDHHSIKHILDESVSEVVTSRGYVEDVRLSNAKLFIGAIIIVIALFAQFYKKKFPENRDFLIACIALYVIFNGLLQLIIYTASRAGFSLLVPASRAG

SEQ ID NO: 3891 - protein, 192 aa, Araucaria araucana
DEHGEVVAEIRRSDLEPYLGLHYPATDIPQASRFLFMQNRVRMICDCRAVPVKVVQAGQLQQPLCLVGSTLRAPHGCHAQYMANMGSIASLVMAVVIIGNEDEEEGRWKRKRRGSMKLWGLVVCHHTSPRAVPFPLRYACEFLMQAFGLQLNMELQLAAQLTEKHILRTQTLLCDMLLRDAPIGIVLILPSI

SEQ ID NO: 3892 - protein, 412 aa, Ralstonia metallidurans
MVVPHCIPRFLDGEHSLFDSILDWAANGLANWSWWEIVIYTLVMTHITIAGVTIFLHRCMAHRSLDLHPIAQHFFRFWLWMTTGMVTKEWTAIHRKHHAKCETEDDPHSPQTRGIRKVLLEGAELYRAEAKNKETITKFGHGTPDDWIERNLYSRFSWQGVALMLIIDLALFGLVGMSVWAVQMLWIPIHAAGIINGLGHYWGYRNYDCEDASTNVSPWGFIIGGEELHNNHHTYPTSAKFSIKWYEIDVGWWYIRAMQSVGLAKVKKIPPKARLVEARPVDHNTLEAIIANRYDVMARYAKTLKSAYKDELRKHKEGNTPEYSSFKPARKWFHREETKLAAPQRQQLATIVEQNKMLSTFVEMRRELAVIWGRSNLTREQLLAQLQAWCHRAEASGIQALQEFSLRLRRYA

SEQ ID NO: 3893 - protein, 191 aa, Agathis dammara
DDHGEVVAEIRRADLEPYLGLHYPATDIPQASRFLFMKNKVRMICDCRADPVKVIQDKRLAHPLSLSGSTLRAPHSCHAQYMANMGSIASLVMAVTINENENEEEASGSGQKGGRRLWGLVVCHHTSPQFVTFPLRYACEFLMQVFGIQLNKEVELAAQLREKHMLRTQTVLCDMLLRDAPVGIVTQTPNI

SEQ ID NO: 3894 - protein, 140 aa, Zea mays
MVSFEMNDLKKIGLGLTGFGIFFSFLGIIFFFDKGLIAMGNILFLSGLGLTIGLKSTMQFFTKPKNYKGTISFAAGFFLVLIGWPFLGMLLEAYGFVVLFSGFWPTLAVFLQRIPIIGWIFQQPFVTSFLDRYRGKRVPV

SEQ ID NO: 3895 - protein, 192 aa, Agathis dammara
DDHGEVISEVRKSDLGPYLGLHYPATDIPQASRFLFMKNRVRMICDCCAPPVRVIEDKRLPRELNLCGSTLRAPHGCHAQYMSNMGSISSLVVAVIVNEKEEEEGDSDAQQQQKGRRLWGLVVCHHTSPRFVPFPLRYACEFLMQVFGIQLNKEVELAAQLREKHILRTQTLLCDMLLRDAPMGIITQKPNI

SEQ ID NO: 3896 - protein, 426 aa, Alkalilimnicola ehrlichei
MRMIRPLYSTAILLILAAGLGLGQTVWAERQQANADLPLEELQAVAEVYARIRSHYVDEVDDKALLEAAVRGMVSSLDPHSTFLDSSEFQALQEGTRGEFGGLGIEVGQEDGFIKVIAPIDDTPASRAGLRPGDLITRIDDKPVKGMSLTEAVKQMRGEPGSQITLTVVREGEDRPLTFEITRAVIQVESVRARMLEPGYGYLRISQFQERTGRDVREALSELKREADGSLRGLVLDLRNNPGGVLDGAVSVADVFLSNGRIVYTEGRDERAEMSFSATPVDMLHGAPLVVLVNQGSASASEIVAGALQDHGRAVVMGSPTFGKGSVQSILPLGRGAAVKLTTARYYTPGGRSIQDKGIQPDILSEELRVARVEREDMSPAELERHGLRQRPDVDRDDETESLAQRDFTLYEALNLLKGVGIFTGR

SEQ ID NO: 3897 - protein, 492 aa, Hypericum perforatum
MDPYKYRPSSAFNSPFWTTNSGAPVYSNDHSLTVGSRGPILLEDYHLVEKLANFDRERIPERVVHARGASAKGFFEVTHDISHLSCADFLRAPGVQTPVIVRFSTVIHERGSPETLRDPRGFAVKFYTREGNFDLVGNNFPVFFIRDGMKFPDMVHALKPNPKSHIQEDWRILDFFSHHPESLHMFSFLFDDIGIPQDYRHMEGSGVNTYTLVNKAGKVHYVKFHWKPTCGVKSLLEDEAIKVGGSNHSHATKDLYDSIAAGNYPEWKLFIQTIDPDHEDRFDFDPLDVTKTWPEDILPLQPVGRLVLNKNIDNFFAENEQLAFCPAIVVPGIYYSDDKLLQTRIFSYSDTQRHRLGPNYLQLPVNAPKSAHHNNHHEGFMNFMHRDEEVNYFPSRYDPVRHAEKYPIPPVVLNGRREKCMIAKENNFKQPGERYRSFSPDRQERFLNRWISSLSDPRVTHEIRAIWVTYWYQADKSLGQKLASRLNVRPNM

SEQ ID NO: 3898 - protein, 479 aa, Gloeobacter violaceus
MSSIAIVWHRRDLRVHDNPALWQASRTGGQVLAVFIVDPTIVERDDTAPARIYFLRESVLELQKAYRTIGGRLAVRVGEPVQQLVALAQAVGAGAVYFNDDIEPYARERDARAAEALRAAGITVHACAEILLHPAGEVLTAAGGKPYTVYTPFWRQWSAKPKPKPFPTPERLEAPTVEEQSFPELAQLGRPFAGELLVSPGEQSGLEQLEAFAREGLYRYGERRDLPGCDGTSRLSAHLKFGTVGIRAVWARTMDAWKQAEHDRDRAGLAVWQQELGWREFYKYELFHLPQLAGRPFRREFENFQWDEDQERFERWCQGETGYPIVDAAMRQLNTVSWMHNRLRMIVASFLTKDLLLPYGWGERYFMQKLVDGDLSANNGGWQWAASVGTDPKPLRIFNPSTQAGRYDPKAVFIRRWLPELEGVDTALLVTSERLPPLMRAQHRYAQPIVEHKRQQQVFKERYRAVRAQQADPGARDSE

SEQ ID NO: 3899 - protein, 112 aa, Zea mays
STRSAQKESAADNAGMLAGGIKDVPANENDLQLQELARFAVNEHNQKANALLGFEKLVKAKTQVVAGTMYYLTIEVKDGEVNKLYEAKVWEKPWENFKQLQEFKPVEEGASA

SEQ ID NO: 3900 - protein, 343 aa, Rhodopseudomonas palustris
MDQGQTLSVLLDSYAVDPQKKAVAAAVGAIAAGSIEISELIGQGALAGITGAAHGGSNADGDVQKDLDVKAEQIIVKSLKDVPYAALASEESDTLLDGDPNAPISIAYDPLDGSSNIDTNMTVGTIFSIIPNQPGVKPFTAAGSCQIAAGFVVYGPQTSLVLTLGDGVNIFTLDRKAKVYRLIRERVKVPADTAEYAVNASNHRHWEQPIRDFVDECIAGADGPRAKDFNMRWIGSLVAEVYRILTRGGVFLYPGDNRPGYGNGRLRLLYETHPMSFVMEQAGGAASTGRERVLDLTAKTIHQRSPLIMGSIDKVKRIELLHTDPSAASRSAPLFARRGLFRV

SEQ ID NO: 3901 - protein, 473 aa, Staphylococcus aureus
MQDIYFLEQMSQFDREVIPERRMHAKGSGAFGTFTVTKDITKYTNAKIFSEIGKQTEMFARFSTVAGERGAADAERDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKFHFRTQQGIENLTDEEAAEIIATDRDSSQRDLFEAIEKGDYPKWTMYIQVMTEEQAKNHKDNPFDLTKVWYHDEYPLIEVGEFELNRNPDNYFMDVEQAAFAPTNIIPGLDFSPDKMLQGRLFSYGDAQRYRLGVNHWQIPVNQPKGVGIENICPFSRDGQMRVVDNNQGGGTHYYPNNHGKFDSQPEYKKPPFPTDGYGYEYNQRQDDDNYFEQPGKLFRLQSEDAKERIFTNTANAMEGVTDDVKRRHIRHCYKADPEYGKGVAKALGIDINSIDLETENDETYENFEK

SEQ ID NO: 3902 - protein, 503 aa, Methanobrevibacter arboriphilus
MSNKKKFTTNKGIPVPNDQASITTGKGSNYTMLGDSHLTEKLAHFGRERIPERVVHAKGTGAYGYFEVTNDLSKYTRAKFLSEVGKKTEVFIRFSTVGGERGSADAKRDPRGTAMKYYTEEGNYDLVGNNTPIFFIRDAIKFPDFIHTQKRNPKNNLSDADMFWDFMSLTPESIHQATFLFTDRGTPQNYRHMDLFGSHSFMWYNEKNEYVWVKYHFKTAQGIQNLTNDEAIKMCGENPDHATEDLFNAIEEGNYPEWNVYVQIMTPEEAEKYEFDPFDVTKVWFHGDYPLIPLGKLVLNKNPENFFAEVEQVAFAPSNFVPGIGPSPDRLLQGRLFSYEDTQRHRLGPNHHQIPINRAKNAEVNTYQRDGPMTVTDNGGSGPNYYPNSFDGPEVDETVTPPTIELKAEINRHPRPVEDVDFFQTGELWRRVLSDEDKDHLVYNIVAHLGNAQERIQYRQCALFYKAEPEYGTRVAEGIGLDISKVKNLSEMTQEERVEATKK

SEQ ID NO: 3903 - protein, 730 aa, Aspergillus niger
MRHFWLLPAVAGIAGAQCPYLSGEMSFTQEQDNAGDTIEVTEQPIDNTLYVNDTGSYMTTDFGTPISDQTSLKAGPRGPTLLEDFIFRQKLQRFDHERVPERVVHARGAGAYGTFKSYADWSNVTAADFLSANDKETPMFCRFSTVVGFRGSVDTARDVHGHACRFYTDEGNYDIVGINFAPFFIQDAIQFPDLVHAIKPMPNNEIPQAATAHTSAWDFFSQQSTALHSALWLMSGNGIPRSFRHMNGYGVHSFRFVAANGTSKVVRTPWKSQQGVASLVWDEAQAAAGKNSDYHRQDLYNAMPNGHYPKYELQAQIMDEADMLRFGFDLLDPTKLVPEEVVPYTPLGMMELNANPTNYFAEVEQAGFQPGHVVPGIDFTDDPLLQGRLFSYLDTQLTRHGGPNFEQIPVNRPRKPVHNNNRDGFGQQQIPTNNWAYTPNSMSNGYPMQANQTQGHGFFTAPYRYASGHLVRQTSPTFNDHWSQPAMFWNSLIPAEQQMVVNAIVFENSKVNSPHVRKNVVNQLNMVNNNLAVRVARGLGLDEPSPNPTYYTSNKTSNVGTFGKPLLSIEGLQVGFLASNSHPESIKQGQAMAAQFSAAGVDLNIVTEAYADGVNTTYALSDAIDFDALIIADGVQSLFASPALANQMNSTATSTLYPPARPFQILVDSFRYGKPVAAVGSGSVALKNAGIDSSRSGVYTGSSETTEKIAKEVLEGLYTFRFVDRFALDE

SEQ ID NO: 3904 - protein, 222 aa, Glycine max
MGRGKIEIKRIENTTNRQVTFCKRRNGLLKKAYELSVLCDAEVALIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNAIQALASRNFFNPNMLEGGTVYPHSDKKILHLG

SEQ ID NO: 3905 - protein, 84 aa, Glycine max
LLFIFNFHPKDSYDSYSIGVEEAGEYQIILNTDEIKYGGQGILKEEQYFLKTISRRVDGLRNCLEVSLPSRTSQVYKLRRILRI

SEQ ID NO: 3906 - protein, 547 aa, Bartonella henselae
MAAKEVKFGREARERLLRGVDILANAVKVTLGPKGRNVVIDKSFGAPRITKDGVSVAKEIELEDKFENMGAQMLREVASKTNDIAGDGTTTATVLGQAIVQEGVKAVAAGMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKSEINARVNQIKVQIEETTSDYDREKLQERLAKLAGGVAVIRVGGATEVEVKEKKDRVDDALNATRAAVEEGIVAGGGTALLRAANALTVKGSNPDQEAGINIVRRALQAPARQIATNAGEEAAIIVGKVLENNADTFGYNTATGEFGDLIALGIVDPVKVVRSALQNAASIASLLITTEAMVAEVPKKDTPVPPMPGGGMGGMGGMDF

SEQ ID NO: 3907 - protein, 190 aa, Agathis dammara
DEHGEVVAEIRRSDLEPYLGLHYPATDIPQASRFLFMQNRVRMICDCRAAPVKVIQAEELKQPLCLVGSTLRAPHGCHAQYMANMGSIASLVMAVVINGNEDEGGGSGSGRGSMKLWGLVVCHHTSPRAVPFPLRYACEFLMQAFGLQLNMELQVAAQLTEKHILRTQTLLCDMLLRDAPIGIVTHSPSI

SEQ ID NO: 3908 - protein, 464 aa, Mesoplasma florum
MNKFPKDFLWGASTSAYQFEGAIKQGGKVSSIMDRFDEQPSYPKGITGFKEASDHYNHWKEDVKLMSEMGFKSYRFSISWPRIIKNKEGEINKEGIKFYNDLIDELFKHKIEPIVTMFHFDIPDFIQEIGGVCTNEFTKQFEIYSEVLFKNFGSKIKYWLTINELNMFALAGQIIGVVPSDQKINSWQLMHHLNVAQAKAIVLCRKICPSAKIGPAPNISTVYPDSNKPLDYVAKLNLDMVRNWVYLDIVCRGEYSPIFINGLKKMGLEITITEEEKQILKNSKPDFIAFNYYSTMTVKMPTEESLKNTKKDQQQGLSMPGFGESVKNDKLEKTQFGWEIDPVGFRNTLREVYDRYQLPIMITENGIGARDVLEEDGKIHDNYRIEYYEKHIQQMALAIADGVEMIGYMPWSAIDLVSTHEGISKRYGFVYVNRDEFDLKDMKRYKKDSFHWYKELIKNNGENI

SEQ ID NO: 3909 - protein, 434 aa, Ashbya gossypii
MPLLQQNPPIQPPYSRASQKLKSLLSSYGENTSTTTAAKEMNGIAPMNLIEKSVVHPPRTIYTKANFSIPGHYEVLQMLGKGSYGTVVSAIDNLNANYPIRIAIKKITNIFQREVLLKRAIRELKFMHYFKGHKNIVSLINLEIVNEKPYDGLYCYQELIDYDLARVIHSNVQFSEFHIKHFTYQILCGVKYIHSADVIHRDLKPGNILCSISGQLKICDFGLARGISPLFTNTKTSNHITNYVATRWYRAPELILSHKRYNKSIDMWAIGCILAEFYGRKPIFMGQDSMHQISEIVKVLGTPSRDTIIKYGSSRAYDIFCPPKPQYAKIPWAEIYPFAGPDALDLIERLLDWDPDRRLTVEEAIEHDFVKSVRDVNDEPCCPHGPFNFSYEAEFKSMSNLREVLYAEVKQFQEECATKDVVPSLPIPQQIYPI

SEQ ID NO: 3910 - protein, 1124 aa, Cucurbita pepo
MSTSRPSQSSSNSGRSRHSTRIIAQTSVDANVQADFEESGNSFDYSSSVRVTSDVSGDQQPRSDKVTTAYLHHIQKGKLIQPFGCLLALDDKTFKVIAYSENAPEMLTMVSHAVPSMGDYPVLGIGTDVRTIFTAPSASALLKALGFGEVTLLNPILVHCKTSGKPFYAIVHRVTGSLIIDFEPVKPYEGPVTAAGALQSYKLAAKAITRLQSLPSGSMARLCDTMVQEVFELTGYDRVMAYKFHDDDHGEVISEVAKPGLQPYLGLHYPATDIPQAARFLFMKNKVRMIVDCRAKHLKVLQDEKLQFDLTLCGSTLRAPHSCHLQYMENMNSIASLVMAVVVNEGDEENEGPALQQQKRKRLWGLVVCHNSSPRFVPFPLRYACEFLAQVFAIHVNKELELENQIIEKNILRTQTLLCDMLMRDAPLGIVSRSPNIMDLVKSDGAALLYKKKIWRLGLTPNDFQLLDIASWLSEYHMDSTGLSTDSLYDAGYPGAIALGDEVCGMAAVRITNNDMIFWFRSHTASEIRWGGAKHEHGQKDDARKMHPRSSFKAFLEVVKTRSLPWKDYEMDAIHSLQLILRNTFKDTDATEINRKSIQTTLGDLKIEGRQELESVTSEMVRLIETATVPILAVDLDGLINGWNTKIAELTGLPVDKAIGKHLLTLVEDSSVEVVRKMLFLALQGQEEQNVQFEIKTHGSHIEVGSISLVVNACASRDLRENVVGVFFVAQDITGQKMVMDKFTRLEGDYKAIVQNPNPLIPPIFGSDEFGWCSEWNPAMAKLTGWSREEVIDKMLLGEVFGVHKSCCRLKNQEAFVNLGIVLNNAMCGQDPEKASFGFLARNGMYVECLLCVNKILDKDGAVTGFFCFLQLPSHELQQALNIQRLCEQTALKRLRALGYIKRQIQNPLSGIIFSRRLLERTELGVEQKELLRTSGLCQKQISKVLDESDIDKIIDGFIDLEMDEFTLHEVLMVSISQVMLKIKGKGIQIVNETPEEAMSETLYGDSLRLQQVLADFLLISVSYAPSGGQLTISTDVTKNQLGKSVHLVHLEFRITYAGGGIPESLLNEMFGSEEDASEEGFSLLISRKLVKLMNGDVRYMREAGKSSFIITVELAAAHKSRTT

SEQ ID NO: 3911 - protein, 190 aa, Angiopteris evecta
DEHGQVVAEIRRLDLQPYLGLHYPATDIPQASRFLFMKNRVRMICDCCAPPVKVIQDKELRLPLSLAGSTLRAPHGCHAQYMATMGSIASLVMAVVVNDNDENSTTRAHQPKNRKLWGLVVCHHTTPRAVPFPLRSACEFLMQVFGLQLNMEVELAAQMREKHILRTQTLLCDMLLRDAPIGIVTQSPNI

SEQ ID NO: 3912 - protein, 685 aa, Gibberella zeae
MSWFMGVDMDGVISSIVTLLPVRFDTTSIISGRLTVNGSQQLVLGQIGSILSFRSPRVIYWFRTDLRLHDSPALKAALDLDPSVFWPIFTWDPHYVYRARGGLNRWQFLLDCQNDLSKSITKVNSNSKLFVLREAPQTLFPKLFKAWKVTHIVFEKDTDSYARERDSIVTQAAKDAGVEVIIRSGRTLWDSDQIVEKHGGKPTMSITQLQAAGSKLGQVKKPIPAPKNLPDPGDMPVNFDQDEPDTKPDFNSEIRTEGDKTYTKISGPKGDFAIETMEELGFPPATTPHRGGETLALKALDEIIADKKYTATFQKPKTSPAQFEPQATTLLSPHLHFGSLSVREFYWRVKDVVDSYKGASSPPESLIGQLLFRDMYFAAQAALGYVFSQTANNPYCRFIPWHLPSKRDPETGLVTGEYHVDSEEADIWFKRWKAGMTGFPWIDALMRQLKDEGWIHHLGRHAVACFLTRGGCYIDWERGCEVFEEWLIDHEPACNVGNWQWLSCSAFFSQYFRCYSPVAFGQKWDKKGEFIRRYVPELKNMDAKYIYEPWKAPLTDQKKAGVRVKGDGLNNVEEGTYPKPMFDFAKRRDVCISSMKVAYQVGLHGNDGQALDGTWRKLFPTDRGEVQGDVESGYGEHADEEGKSDNEAKEEGEGTSSVKKEDDTTKGKRSARRHSTEKVPKKKKV

SEQ ID NO: 3913 - protein, 190 aa, Angiopteris evecta
DEHGEVVAEIRRSDLEPYLGLHYPATDIPQASRFLFMKNRVRMICDCRTPPVRVLQDKELRQPLSLAGSTLRAPHGCHSQYMANMGSIASLVMAVVVNDNDEDSSNRASHQKSRKLWGVVVCHHTTPRAVPFPLRSACEFLTQVFGLQLNMEVELAAQMREKHILRTQTLLCDMLLRDAPIGIVTQSPNI

SEQ ID NO: 3914 - protein, 404 aa, Lactococcus lactis
MRKFEKSHKLDNVSYDIRGPVLDEAQRMRANGEKILRLNTGNPAEFGFLAPDEVISDLIQHAVDSEGYSDSKGIFSARKAIMQYCQLKGFPNLDINDIFTGNGVSELIVMAMQGLLDTGDEVLIPMPDYPLWTASVSLAGGTAVHYLCDEQAGWFPDIDDIRSKITSNTKAIVLINPNNPTGALYSKDLLLEIVQVARENNLIIFSDEIYDRLVMDGAVHVPIASLAPDLFVVTMNGLSKSHRIAGFRVGWMVLSGEKSHVKGYIEGLNMLASMRLCSNVLAQSVVQTSLGGTQSVDKLLLPGGRVYEQREFIYKAINDIPGLSAVKPQAAFYIFPKIDREMYKIDNDEQFVLDFLKQEKILLVHGRGFNWKEPDHFRIVYLPRVDELAEIQEKMERFLWQYRK

SEQ ID NO: 3915 - protein, 461 aa, Oryza sativa
MVNGEAEAECTRASLLGRYEIGRTLGEGNFGKVKYARHLATGAHFAIKILDRNKILSLRFDDQIRREIGTLKLLKHPNVVRLHEVAASKTKIYMVLEYVNGGELFDKIAVKGKLSEHEGRRLFQQLIDAVSYCHDKGVYHRDLKPENVLVDRRGNIKISDFGLSALPQHLGNDGLLHTTCGSPNYIAPEVLQNRGYDGSLSDIWSCGVILYVMLVGYLPFDDRNLVVLYQKIFKGDTQIPKWLSPSARDLLRRILEPNPMKRINIAGIKEHEWFQKDYTPVVPYDDDDDNYLDSVLPIKEQIDEAKQEKPTHINAFQLIGMASALDLSGFFEEEDASQRKIRFTSTHSPKDLFDKIENVVTEMGFQVQRGNSKLKVMKNGKGSKNLRNPSSFLVCTEVVELGPSLYVVELKKSHGDPILYRQLCERLSDDLGVCKTEQIQRTESLEDDLESFDSGSSLPGF

SEQ ID NO: 3916 - protein, 141 aa, Chromobacterium violaceum
MSMLPARHSLFDEFFRDFTPGFLVKPLHGDALPSQIKMDVKETGEAYQVEAELPGVGKEDIHVEIDGALVTIKAEIKQFDQQGKDERSLRSERYYGLVSRSFQLPQEIDRDAAGAKYENGVLSLTLPKRRNSGVGQRLRIE

SEQ ID NO: 3917 - protein, 332 aa, Salmonella typhimurium
MKTLGEFIVEKQHEFSQATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDSSTSRPYTSRYIGSLVADFHRNLLKGGIYLYPSTASHPQGKLRLLYECNPMAFLAEQAGGKASDGKERILDIIPESLHQRRSFFVGNRHMVDDVERFIREYPDA

SEQ ID NO: 3918 - protein, 285 aa, Unknown
  Nostoc sp. PCC 7120
MTVKHLAIAPEGKKSLRLSWTNVAFFTTIHALALLAPWFFSWSALGLLLFLHWLFGSIGICLGYHRLLSHKSFQVPKWLEYAIATIGALAMQGGPIFWIGGHRQHHAHTEDVYLDPYSSQRGFWWSHMLWILYPRSEFFDYEIYQKYAPDLARQPFYRWLDRYFLLLQIPFGLMLYAIGGWSFVIYGVVLRAVLLWHSTWFVNSATHMWGYRTFNADDNARNLWWVSIVTYGEGWHNNHHTYPNVAKAGFQWWEVDVTWWSIKLLQTLGLAKKVVLPPSQRMNQG

SEQ ID NO: 3919 - protein, 474 aa, Streptococcus pyogenes
MGIFPKDFLWGGAVAANQVEGAFEADAKGWSVQDVLPNGGLGEWTDSPTSDNLTLEAIDFYHRYKEDIALFAEMGFKVFRTSIAWSRIFPNGDDDQPNEAGLQFYDDLFDELLNYGIEPLVTLSHYETPLHLAKAYNGWTDRRLIGFFERFAQTVMERYKDKVKYWLTFNEVNSILHMPFTSGGIMTEKEKLSLQDLYQAIHHELVASASVTKLAHEINPDVKVGCMILAMPAYPMTSDPRDILAAHAFENLNLLFSDIHVRGKYPSYIKSYFKENGIEIVFEDGDKELLAEHTVDFLSFSYYMSVTQAHNPEAYTSGQGNILGGLSNPYLESSEWGWQIDPIGLRLVLNQYYDRYQIPLFIVENGLGAKDQLVQTADGSMTVHDDYRIDYMSQHLVQVAKAIEDGVEVMGYTAWGCIDCVSMSTAQLSKRYGFIYVDRNDDGTGQLTRYKKKSFDWYRQVIQTNGRYLEDNFS

SEQ ID NO: 3920 - protein, 541 aa, Streptomyces coelicolor
MAKILKFDEDARRALERGVNKLADTVKVTIGPKGRNVVIDKKFGAPTITNDGVTIAREVEVEDPYENLGAQLVKEVATKTNDIAGDGTTTATVLAQALVREGLKNVAAGASPALLKKGIDAAVAAVSEDLLATARPIDEKSDIAAVAALSAQDQQVGELIAEAMDKVGKDGVITVEESNTFGLELDFTEGMAFDKGYLSPYFVTDQERMEAVLDDPYILINQGKISSIADLLPLLEKVIQANASKPLLIIAEDLEGEALSTLVVNKIRGTFNAVAVKAPGFGDRRKAMLQDMAVLTGATVISEEVGLKLDQVGLEVLGTARRITVTKDDTTIVDGAGKRDEVQGRIAQIKAEIENTDSDWDREKLQERLAKLAGGVCVIKVGAATEVELKERKHRLEDAISATRAAVEEGIVSGGGSALVHAVKVLEGNLGKTGDEATGVAVVRRAAVEPLRWIAENAGLEGYVITSKVADLDKGQGFNAATGEYGDLVKAGVIDPVKVTRSALENAASIASLLLTTETLVVEKKEEEEPAAGGHSHGHSH

SEQ ID NO: 3921 - protein, 253 aa, Prochlorococcus marinus
MKKKEEGFIIHPIPVLMDNIIWIWVKEKQAIVVDPAISEPVINLLKGNGLSLHSVLQTHHHEDHIGGTQELINVWPSASVIAAKSDLDRIQFQTKSVVDNEELDILGQKIKVIEVPGHTSNHICFFLQGSKESKIDPVLFCGDTLFGAGCGRLFEGTPEQMFNSLSRINNLPKNTKIYCAHEYTEANLRWAKSIFPEDIYIEERLKEVILRKSKGFLSIPSKLSEERKTNLFIRASNQREFAQLRLHKDNWKS

SEQ ID NO: 3922 - protein, 480 aa, Streptococcus pyogenes
MLAFPKEFWWGGATSGPQSEGRFAKQHRNLFDYWYEEEPDLFYDYVGPDTASDAYHQIESDLALLASLGHNSYRTSIQWTRLIDDFEQATINPDGLAYYNRVIDACLANGIRPVINLHHFDLPIALYQVYGGWESKHVVDLFVAFSKVCFEQFGDRVKDWFVHNEPMVVVEGSYLMQFHYPAIVDGKKAVQVAYNLALATAKVIQAYRRGPAELSDGRIGTILNLTPAYPASQSEADTAAAHFAELWNNDLFMEAAVHGKFPEELVAVLKKDGVLWQSTPEELALIAENRVDYLGLNFYHPKRVKAPDVIPVISPSWSPEWYYDAYLMPGRRMNVDKGWEIYPEAVYDIAVKMRDHYDNIPWFLSENGVGISGEDRYRDETGQIQDDYRIRFLKEHLTYLHKGIEAGSNCFGYHVWTPIDGWSWLNAYKNRYGLVENNIHTQVRRPKASAYWFKKVATHNRLISLEVMEEFGGSASHPSD

SEQ ID NO: 3923 - protein, 395 aa, Methanosarcina barkeri
MNEQGLSEKEIFSYLEDVKSEDTDYYRVLSSMCTHPHRIAVEAHRLFIEANLGDLGLFAGAHRLEKEVIRMLGELLHAQSVEIPSGEACESSVCGYLTTGGTESNIQAIRGMKNLVTEDGKKSGEILNIVVPESAHFSFDKVANMMGIEVKRASLDPEFRVDIASAESLIDANTIGLVGIAGNTEFGQVDPIEELSKLALENELFLHVDAAFGGFVIPFLEKPYSFDFKVPGVTSIAIDPHKMGLSTIPSGALLFRSPFFMDSLKVNTPYLTTKSQFTLTGTRSGASAAATYAVMKYLGREGYRKNVQYCMQLTTKLVKEARKFGFEPLIEPVMNVVDLRVPNPDIVREQLLKKFGWNVSITRNPRSLRLVLMPHNTARDIEEFLQDLRKVTTEL

SEQ ID NO: 3924 - protein, 543 aa, Arabidopsis thaliana
MRRFVIGQAKNLIDQSRRRQLHHHKNLSFVSLIPPFSAPSDSSSRHLSSSSSSDMSASDSSSSLPVTLDTINPKVIKCEYAVRGEIVNIAQKLQEDLKTNKDAYPFDEIIYCNIGNPQSLGQQPITFFREVLALCSYTALLDESATHGLFSSDSIERAWKILDQIPGRATGAYSHSQGIKGLRDAIADGIEARDGFPADPNDIFMTDGASPGVHMMMQLLITSEKDGILCPIPQYPLYSASIALHGGTLVPYYLDEASGWGLEISELKKQLEDARSKGITVRALAVINPGNPTGQVLSEENQRDVVNFCKQEGLVLLADEVYQENVYVPDKKFHSFKKVARSMGYGEKDLALVSFQSVSKGYYGECGKRGGYMEVTGFTSDVREQIYKMASVNLCSNISGQILASLIMSPPKPGDDSYESYIAEKDGILSSLARRAKTLEEALNKLEGVTCNRAEGAMYLFPCLHLPQKAIAAAEAEKTAPDNFYCKRLLKATGIVVVPGSGFRQVPGTWHFRCTILPQEDKIPAIVDRLTAFHQSFMDEFRD

SEQ ID NO: 3925 - protein, 195 aa, Azolla filiculoides
DEHGEVVAEIRKPDMAPYLGLHYPATDIPQASRFLFMKNRLRMVCDSRAVAVRVIQDTQLRQPLSLAGSTLRAPHGCHSQYMENMGSIASLVMAVIVNDKGECGSSNGSNPQPRPRMRKLWGLVVCHHTTMRAVPFPLRSACELLVQVFGLQLNMEAELAAQMRDKHILRTQMLLCDMLLRDAPIGIVSKSDPNI

SEQ ID NO: 3926 - protein, 380 aa, Glycine max
MQQSHINATPYLWCEQGCPNLQLASFEFWSVICCFGERVDMDERYETLKELGSGNFGVARLAKDKETGELVAIKYIERGKKIDANVQREIVNHRSLKHPNIIRSFLQVFLTPTHLAIVLEYAAGGELFERICNAGRLSEDEARFFFQQLISGVSYCHSMQICHRDLKLENTLLDGNPAPRLKICDFGFSKSALLHSQPKSTVGTPAYIAPEVLSRKEYDGKVADVWSCGVTLYVMLVGAYPFEDPEDPKNFRKSIGRIMSVQYAIPDYVRVSKECRHLISRIFVANPAKRINISEIKQHLWFRKNLPREIIEAERRGYEETQKDQPSQSVEEIMQIIQEARTKIHTGEQAGTGTSDVVRGDEANEEVDINDHFAKYLTLD

SEQ ID NO: 3927 - protein, 644 aa, Listeria monocytogenes
MLFLKFNSMFSPIDIGPMKVPNRFVVSPMCNNYANTDGTLSDTSLAYYKERALGGFGLITFEATVVDVRAKGGANKACLYSDHQIASFKRVIDVCHDAGAKISVQLQHAGPEGNSKVSGYPLRAASAIASAAGRNTPEAISREELYELIELYGEAALRAKKAGADAVEVHCAHGYLVSSFLSARTNKRVDEFGGCFENRMRLPRLIIESIRKRVGHSIAILCRINSTDGVEGGLSVQDSATVAAYLEDCGLDGLHVSRSVHIRDEYMWAPTVLHAGFSSDLVTQIKRAVSIPVITVGRFTEPHYAELMVREGRADLVAFGRQSLADPETPNKAAAGKLDELLPCIACLQGCVANMYAGKPITCLVNPLLGRESEAYSPKTPSKKVVVIGGGVGGLYAGWMAGSRGHDVTVYEASDMIGGQMRLAAYPPGKGDLTNMVRSYIKKCEQFDVEIKTNTPVTPELIQEVAPDAVIIATGATPLVLPIPGIEDAGLIHAVDLLDGKEKCGQKVLVVGGGMVGSETAAFLGEAGHDVTVVELRDEVGADVISEHRKFLMRDFDEYKIKSVTNAKVTSFFEDGVTYSLADNKEHRIDGFDSVVLAMGSRAYNPLEEAIKKMVPETYVIGDAIRARRALDATKEALDAVLQL

SEQ ID NO: 3928 - protein, 238 aa, Oryza sativa
MAVEEVLDGAAPMLSSSPAASGEEVGARKPQQRCGGAEGWSKRKRSRRRHRDRAAAPPPHGSEEEHLALSLLMLARGHRDPSPAPQEQHGCSVCGRVFSSYQALGGHKTSHRPRTPPTMAAVVVVDEPAATTASPAASSSNSGSGSGGGGGNKVHECSVCKKTFPTGQALGGHKRCHYEGPIGSGGGAAVAGRGFDLNLPAVALPDIMTERCLPAAAEEEEVLSPLASFKKPRLMIPA

SEQ ID NO: 3929 - protein, 194 aa, Azolla filiculoides
DEHGEVLAEIRRSDLEPYLGLHYPATDIPQASRFLFMKNRVRLIYDCRAQPVRIIQDKELRQPLSLAGSTLRAPHSCHGQYMANMGTIASLVMAVVVNDNDEETGNRTQRLNPSPKMRRLWGLVVCHHTTPRVVPFALRSACEFLMQVFGLQLNMELELAAQMREKHILRTQTLLCDMLLRDAPIGIVSESPSI

SEQ ID NO: 3930 - protein, 547 aa, Thermoplasma volcanium
MVNPGDKGRIGNVEIKNRIVMAPMISNIANSDGSPSEPYISYMRERARGGIGLIITEYTYVDPESGKGSRNQLGIYDDIFLPKFSRLAEAVHDYGSKIFVQLVHAGAKALPSSSYKIAPSKTSFDKNAREMDSSDIERVIRNYERAASIARRAGFDGIEIHGAHGYLVDEFISPYWNRRTDKYGGSLEGRIKFPQEVIDAVKSEVDIPVGIRLSLYEDEVGGYGPDYGIKVAKSLVNIDYVHFSAGNNDPPGSSAPFYSNHTHILSKFPGGSNKPTILVGSVTTAEDVRNVLKVADFVAVGRAVLADPYFARKVIDNYGHIRPCIRCNQACRNLAYGEVRCTVNPYFAFPRQLRKLSGDVVIVGGGVKGLEAARFAALNGLSVTLYEQDDKIGGQLNTIYDEAKRKEFNRLIEYYKEVLDRLGVEIITSEKYKGKGIYCLPDKTYPDLQEKPEIFIDSNVYMYHDIALKYSSTSKVFVTYRSLSSLDRARKAAFLKIAESRGIKFIEKADNYDVSIYEEKQYDIGEAMKSGINEVEKYIDDRINEFL

SEQ ID NO: 3931 - protein, 479 aa, Alkalilimnicola ehrlichei
MGDATLVWLRRDLRLTDNPALDQAARRGGPVIAVYLHAPEETPQYPPGAASHWYLHHSLKALGPALAQAGIPLVLRRGPALATLRALIRATGAGAVYWNRLYEPDAVARDRTVKQALRTEGLDCRSFPTALLHEPWAVRNQADRPYRAFTPFWRACRRQPPPAAPLPAPDLRDRPVPAVEGLDLAALGLLPRTPWDTGLRNTWQAGESAALARLEAFAADRLARYAQDRDRPAEPGTSGLSPALHFGELSPRQVWWQVMAAREAGVPEDACETFLSELGWREFAHHLLWSHPDLGDAPVDDRFGAFPWRPDPGDGWLHAWQAGRTGIPLVDAGMHELWQTGWMHNRVRMVTGSFLVKHLRLPWQRGERWFRDTLVDWDAASNAMGWQWVAGCGADAAPYFRIFNPVRQGERFDPQGRYVRRWLPALANLPDKYIHAPWTAPEAVLRRAGVTLGSDYPCPLIDLRLGREQALSAFQAIKG

SEQ ID NO: 3932 - protein, 247 aa, Unknown
  Petunia x hybrida
MVFPNQEFESSSSQRKSGRGKIEIKRIENTTNRQVTFCKRRNGLLKKAYELSVLCDAEVALIVFSSRGRLYEYANNSVRATIDRYKKHHADSTSTGSVSEANTQYYQQEAAKLRRQIRDIQTYNRQIVGEALSSLSPRGLKNLEGKLEKAIGRVRSKKNELLFSEIELMQKREIEMQNANMYLRAKIAEVERATQQMNLMHGGGSEYQQQPMSSTSQPYDARNFLPVNLLEPNPHYSRQDQTALQLV

SEQ ID NO: 3933 - protein, 208 aa, Desulfovibrio vulgaris
MPIKTFPLGPLETNCHLVHNGRTAVVVDPGGAPRPVLNYLEMQGLTLTHILNTHLHFDHIYGNAALAAATGAPILASAGDAFLRQTELGKGGAFGFPAVDDFTSIDLEPGEHRFGDLACTAFATPGHTPGSLSFYFPEEDTIIVGDLIFYRSIGRTDFPGGDLEKLRASVRDHIFTLPGKTRILPGHGPATSVDDETRNNPYFGDFAV

SEQ ID NO: 3934 - protein, 173 aa, Triticum aestivum
  misc_feature (92)..(92): Xaa can be any naturally occurring amino acid
  misc_feature (141)..(141): Xaa can be any naturally occurring amino acid
  misc_feature (160)..(160): Xaa can be any naturally occurring amino acid
  misc_feature (166)..(166): Xaa can be any naturally occurring amino acid
PFNQIISANIGNPQQLGQKPITFFRQVLSLLEYPTLLENEDVLLKQLGYKVDVIERAKWLLKSVGAIGAYSASNGAPAIRESIANFIERRDXHPADPKDIYLSAGASSGVNTLLSIICAKPTTGVLVPIPQYPLYTATLSXLGAKCVPYYLDESKGWGTXVEAIKXAYEQGNF

SEQ ID NO: 3935 - protein, 502 aa, Oryza sativa
MMDGRSILMGRYEVGKQLGQGTFAKVYYARNLTTGQAVAIKMINKDKVMKVGLMEQIKREISIMRLVKHPNVLQLFEVMASKSKIYFVLEYAKGGELFNKIAKEGKLSEDSARRYFHQLINAVDYCHSRGVYHRDLKPENLLLDENENLKVSDFGLSALAESKRQDGLLHTTCGTPAYVAPEVLSRKGYDGAKADVWSCGVILFVLVAGYLPFHDPNLIEMYRKICRADFRCPRYFSAELKDLIHKILDSDPSTRISIPRIKRSTWYRKPVEINAKNSEAATTNSISSGVATTSGSAECSTSEENQGSLSLPNLNAFDIISLSTGFNLSGFFEDTHGHQEERFTTRQPVTTVLGKLKELAKRLKLKVKKKDNGVLRLAAPKEGKKGFLELDAEIFEVTPSFLLVELKKTNGDTMEYRKLVKEDIRPALKDIVWVWQGDEHLNSQSILQGEQQQSPLPPELPQDQLQPSLPQQEKQDMPEPPLLPQVPQEEVQTSIPAEQTKN

SEQ ID NO: 3936 - protein, 661 aa, Bacillus cereus
MEQLEHHVTDNQRKHALTTNQGVKIAEDEFSLKMGLRGPTLMEDFHFREKMTHFDHERIPERIVHARGVGAHGYFQLYESLEAYTKADFLTNPSKKTPVFVRFSTVQGSKGSNDTVRDVRGFATKFYTDEGNYDLVGNNMPVFFIQDAIKFPDFVHAVKPEPHNDIPQGASAHDTFWDFVAHNPESTHMVMWQMSDRAIPRSLRMMEGFGVHTFRLINKEGKAHFVKFHWKPTLGVHSLVWDEAQRIAGKNPDFHRQDLYEAIEKGDYPEWELGLQLIPEEDEHAFDFDILDPTKLWPEEEVPVKLVGKMTLNKNVDNFFAETEQVAFHPGHVVPGIDFSNDPLLQGRLFSYTDTQLSRLGGPNFHQIPINQPVCPFHNNQRDGMHQMQIHRGQTSYHPNGLNDNQPATVQAEQGGYEHYQEKIDGHKIRGRSKSFLNFYSQAKLFYNSMSPIEKQHIKDAFCFEVGKCKSDMVKANVITLLNHVDRQLAKEVANIIGAPLPKENHEVNSDAKSPALSMSNTICKSDSKNVAILLNGDPSVSLLSEWIQAFAQHRINYGIIDKKIYHFTDSIKVTDTYTTADSSLFDAVLVFSSESVIHSPVLEFAETTFKHFKPIAHVLSNPHALDNSKIKLDGAGIYNLANTSIESFIEGIAQGRFWNR

SEQ ID NO: 3937 - protein, 478 aa, Lactococcus lactis
MEHKKLKAFPNDFLWGSASAAYQVEGAPFEDGKKASVWDNFVRIPGKTFKGTNGDVAVDHYHRYKEDVALMKELGLKSYRFSIAWTRILPDGRGEVNQAGLKFYEDLIDELIANEIEPIVTIYHWDLPQALEDLYGGWESREIIADFVNYAEVLFNAFKGKVKYWVSLNEQNIFTSQGWSLATHPPGKRDMKLFYQVNHIANLTNAAVINKFHELEMDGQIGPSFAYTPQYAKDSDPLNVLAAENAEELYSHFWMDVYLYGEYPIAAMAYLRENGLAPEFEAGDAELLKSAKPDFLGINYYQTATNAWNPVDGGVGVGSFNTSGKKGTTKESGIPGLHKKIQNPFIDRTNWDWEIDPEGLRIALRRITSRYRIPVMITENGLGEYDKVEDGKIHDDYRIKYLESHVKAIKEAMTDGAKVIGYHTWSYTDLLSWLNGYQKRYGFVYVDQDETMEGSLKRIPKDSYYWYQHLIETNAEEV

SEQ ID NO: 3938 - protein, 242 aa, Akebia trifoliata
MGRGRVGLRRIENKINRQVTFAKRRNGLLKKAYELSVLCDAEVALIIFSNRGKLYEFCSSSSMFKTLERYQKCNFGAPEPNVSTREALEHSSHQEYLKLKARVEGLQRSQRNLLGEDLGPLSGKELETLERQLDMSLKQIRSTRTQYMLDQLSDYQRREQMLSEANKALRRRLEEGSQPNPHQWDPNVQVVNFGRQQAPAQGEGFFQHIECEPTLHIGYQPDQITVAAAGPSMNNYMQGWIG

SEQ ID NO: 3939 - protein, 529 aa, Glycine max
MTQSRKPRKPNPQAREAQESPSSSFSSSGMKLIVPLQGVVQGRGGLLLGTLVPCTLFYFLQLYLKRRRSNFSPPSPSSSESTLPRTSSRSNLSTRGSISRVRVSKLATSISKPDESLYYVGLERVSRDPYDALENPNGIIQLGLSDNKLCLDLIGEWVARNLEGSISGGVGLGINGIVPYQSFDGVMELKMALSDFMHQVMGGSVKFDPSNMVLTAGATPAIEILSFCLADHGNAFLVPTPYYPGFDRDVRWRPGVDLIPVHCRSTDNFDLNITALEQAFSQARKRGVKVRGILISNPSNPVGNMMTQDMLYSLLDFAEEKNIHIIADEVFAGSTYGSEKFVSVAEILDSDYIDKSRVHIIYGLSKDLSLAGFRVGVICSFNESVLAAAKKLSRFSSISAPTQRLVTSMLSDKRFIQEYFETNRKRIRQMHDEFVGCLSKLGIKCAKSSAGMYCWVDMSGLIRPYSEKGEIELWGKFLSVAKINITPGSACHCIEPGWFRICFTTITLEEIPMVIDRIRRVVESCNFSS

SEQ ID NO: 3940 - protein, 229 aa, Akebia trifoliata
MQKREGDMGRGKIEIKRIENTTNRQVTFCKRRNGLLKKAYELSVLCDAEVALIVFSSRGRLYEFSNSSIKSTIERYKKASADSSNTTSIIEANAHYYQHEATKLRQQIQNLQIANRQLMGDSLSSLTVKELKQLENRLERGLTRIRSKKQEIMFAEIEYMQKREVELQKENMYLRAKIAENENAQQTSMVPAQEFDAIQTFDSRNYFQMNMLEGGAAYSHADQTALHLG

SEQ ID NO: 3941 - protein, 548 aa, Salmonella enterica
MAAKDVKFGNDARVKMLRGVNVLADAVKVTLGPKGRNVVLDKSFGAPTITKDGVSVAREIELEDKFENMGAQMVKEVASKANDAAGDGTTTATVLAQSIITEGLKAVAAGMNPMDLKRGIDKAVAAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKIADLKGQNEDQNVGIKVALRAMEAPLRQIVLNCGEEPSVVANTVKGGDGNYGYNAATEEYGNMIDMGILDPTKVTRSALQYAASVAGLMITTECMVTDLPKSDAPDLGAAGGMGGMGGMGGMM

SEQ ID NO: 3942 - protein, 487 aa, Triticum aestivum
MGDRPKLPARYEQVKLLGEGNFAKVYLARHMDTKEEVAIKVMDKEKLIKLGAVQQIKREIAVMRRLRHPNIVQLHKVMACKSRIFVVMEYVRGGPLYRHIPANSGLKEDETRRIFQQLVSALTFCHAQGVYHRDIKPDNLLVDEHGNLKVADFGLSAHADTARREALLHTVCGTPLYVPPEVFARRGYDGAKADAWSCGIVLFVLAAGRKPFRDDDFITLYRTICRGDYRCPRTFSPELVRIVRRLLQPNPAHRITLLQIKETDWFKKGFKEISFYIDNKDCLRSLDGSEEPDLCDSDSEDETAMSSSSSGSSSPVAHGDGGGMHTSVSAPSLVNLEKMHIAAARAPEPRIRRIKSMNAFDIIASSPSFDLSGLFEERGEQLRFVSSAPVNTIIKKLEEIAGQVSFTARTKDCQVSFEATRNGHKGALAISTKIFQLTPELVMVQVCKKAGDTAEYRQFCGSELKPGLRGLVDGLPEDGLPPTLNVA

SEQ ID NO: 3943 - protein, 694 aa, Rhodobacter sphaeroides
MKRPTRPAPPLKFDMSSAHPNRLGADFDGEGTNFPLFSENATRVELCLFDETGQTQTHCLDLPSYEGGIWYGYLPGIREGQTYGYRVHGPHAPEEGHRFNPNKLLIDPYARELRGDLIWDDALFGYPIGGDDLELDPRDSAPFMPKAVVVDPAFDWEADKALRHRWQDTVIYEAHVKGLTMRHPGVPEEDRGTFKGLASPAVIDHLKAIGVTAIELLPIHGFLNDRHLIEKGLSNYWGYNTLSFFAPYRPYTKSGSMREVKRAIKRFHDAGIEVILDVVYNHTCEGNEKGPTLSFRGIDNASYYLLSPEAKRHSFDTTGTGNTLNVAHPMVLRMVMDSLRYWVEVMHVDGFRFDLASTLGREPEGFERGGTFFAAIRQDPVLSMVKLIAEPWDIGEGGYQVGGFPWPFREWNDKARDDLRAFWRRDPGLIGDVSQRLLGSPVQFSHSHRPATSSVNFIAAHDGFTAWDLVSYDEKHNEANGEDNRDGHSHNLSHNLGAEGPTDDPGILEARLRRVKAMLATLFLSQGVPMILAGDEFGQSQQGNNNAYCQDNEIAWLDWEEARDELIRAVADLAEFRKADGGISRARFAVGPDAVQHDTPVATWLHPAGREMEEGDWNEGELRLFALRLDLPRGRDLLVVLNAGDDGDFALPEGEWRLKIDTSRERIACDEPALGTLPVGWQSVMVLVAAEEAD

SEQ ID NO: 3944 - protein, 267 aa, Shewanella oneidensis
MLTITAINAFNDNYIWVLQQDTQQAVYVVDPGDVNVVLDYLNAHQLTLAGILITHHHRDHTGGIAALVAYVEQTTGHTLAVYGPQSEAIQGVNIAIEPQITQILHLPFLNSPVQVLSVPGHTAGHIAYLVDGALFCGDTLFSGGCGRLFEGTPAQMCHSLRLLAALPAETRVYCAHEYTLANLKFAQAADPSNAKLKAYNEQATALRAQGKATIPSTIGLERSINPFLRGLTPTIVDSIKQQFCDQDLSNVDELTYFTLLRQWKDIF

SEQ ID NO: 3945 - protein, 1039 aa, Desulfovibrio vulgaris
MVNLSLGRFSWRGQRREACRGLTFILRCHLLLLFLALSMAGAAWGASPRVLLLSSYGPAFPTFFQQVEGVRAVLASAGVVLDVEFMDSKRFTDESSVDHFESYLRYKLARLPAYDVVITSDDNALAFVMERHGGLLGKSPVVFCGVNNVGLARSLSGSETYTGVIEAVSMHETIKLVWSLKPSTQTLYVISDVMPAGKADLETFHDVVRGIASVRYQELSLENMGWEELGRRLQRVGANDAILLLSAYKDQRGVVRNFEEGLAFILQNTRSPVYHLWEHGMGKGLLGGKLISHYEQGRLAADMALKILAGASPASLPVIEGNDANAYLFDYEVLRRHGISTHRIPQGSRVINEPESIWRDYWRELLVAVAFVAVLCVLVVVLLKHVLRLREARTEIKRSETRYRLVFDQSPLGLVQYDGDGIIIDVNERFAELCGASRGQIIGFNYINQMHDARMLGAVLASLRGGIGGFEGVYTSPLGKKTAFIRCLFKGVKAPAGDVFIGIGIIEDVSDRKQAEEALRERELFLLETQRIAKIGGWKANIRTDYLFWSEEVNRILDLPEDYKPGLAEWLTSFMPEYLPRIRAMLEDVLHHGGTADIECEAMTRLGRRKWTHLRAVGRVDEGSGALVVGTFQDVDERKRTELELVEAKTKAVAANRAKDEFLANMSHEIRTPLNGIFGMLRMLADASLAPRQQELAEMAMRSCRRLADLLTDVLDISRIDAGKLEIVSIPFDLSRSIRQVRELFIPSAMQAGVSLHVHIDAAIPSRVVGDASRLQQVLTNLLGNAFKFTEKGSVTLRAEHLSPVLANSCRVLFSVEDTGCGIPDEKHGKLFTPFTQACEGFKRSHQGAGLGLSICRRIIRVMGGHLAFESEAGTGTTVYFTLNFGLPDGDEVQPEAAAASSAEPIPPLRVLVTEDDAVTRRYITYQLDRDGHTVAVAEDGRQALEQLSTGDFDMVLMDIQMPVMDGAEAILRIRKGEAGSRNTDIPVIALTAYALSGDRERLLQIGADDYVAKPAEVAQLHAAIARHVSRMQLRRADA

SEQ ID NO: 3946 - protein, 1414 aa, Oryza sativa
MDSPPPPREEVVVFAVNSERFELRRDGGDPGESLLEFLRSRTRFTGAKLGCGEGKATPQPTALPPPRLLCFRGCGACVVVVSAYDAEADEVAHAAVSSCLTLARGLHHRAVTTTEGLGSSRRGLHALHERLAGFHASQCGFCTPGVCMSLAGALAAAEGNGKKAASAAEGFSRLTAAEAERAVAGNLCRCTGYRPIADACKSFAADVDLEDLGLNCFWNKGDATASVSKLPPYKERSIAAFPEFLKDEIRSSLGIDHSISSASMVGSVSSWYQPKNVEEYYKLIGSLSSSSDKSRTKVVVGNTSSGVYRDAELYDRYIDLRAIPELNSVSKDVKGVGIGAAMSISQVIEILRGEGNSYKDVVFCKIADHMEKVASQFVRNMASLGGNLIMAQRDEFASDIATVLLAAGSSLCIQVSSERMNVTLERFLDMAPCDCKTLLLRIYIPHCTPSGISSSSESVNKTGDKPASSVLFETYRASPRPIGNAVSYLNSAFLAKLSSDETSGNCILEKLCLAFGAYGTQHAVRATNVESLLVGKPITASLLLEACTVLKKTIVPGEGTRHAAYRSSLAVAFLFSFLYPITKGTFKPVEAVHLNGHIISDNNGNMNRGPDTHVDVSPKEINNVKSDLHGNDRILESSKQVIEISEDYLPVGLPAKKVGAELQASGEAIYVDDIPSPKDCLHGAFVYSTKPLAHVKSIELNPSLEQLKTVAIVTAKDIPKGGSNVGANTIFGPEPLFGDPLTQWAGEPLGIVVAETQKTANIAASRALVDYSMENLDAPILSIEEAVRSSSYFEILPFLLPQKIGDFSKGMEEADQKIYSTEVNLHSQYYFYMETQTALAIPEEDNCMVVYSSSQCPEVAQETIAKCLGLPCHNVRVITRRVGGGFGGKAVRSLPVATACALSAFKLQRPVRIYLDRKTDMIMTGGRHPMKIRYSVGFKSDGNITALHIELLVNAGITQDVSPVIPHNFIEALKKYNWGAFSYDARICKTNIATRSAMRGPGEVQGSYVAEAIIEHVAAVLSTDVNLVRQRNLHTVESLSLYHSECMEDALGYTLPSICNQLITSANYQHQLEMIRSFNKSNRWKKRGLSVVPIVHKFASRPTPGKVSILNDGSVAVEVGGIELGQGLWTKVKQMAAFGLGQLWTDRRQELLERVRIIQADTLSVIQGGWTTGSTTSESSCEAVHRACNILVDRLKPLKEQLQEKQGTVSWDELISQAKMVGVDLSAKELYVPGASGSYLNYGAAASEVEIDLLTGATTILRSDLIYDCGRSLNPAVDLGQVEGAFVQGIGYFMNEEYVTNSDGLLVSDGTWTYKIPTVDTIPKQFNVKLLNSGFHKKRVLSSKASGEPPLLLAASVHCATREAIRAAREEYHCSRSGSSPPFFDLEVPAIMPTVKELCGLDNVEKYLESICSK

SEQ ID NO: 3947 - protein, 243 aa, Citrus sinensis
MGRGRVQLKRIENKINRQVTFSKRRAGFLKKAHEISVLCDAEVAVIIFSHKGKLFEYSTGSCMEKILERYERYAYAERQLIAPDPESQRNWPLECNNLKAKIDLLQKDQRHYLGEDLESLSLKDIQQLEQQLDTALKHIRSRKNQLMQESISELQKKEKSIEEQNNLLVKQIKEREKAAAQQAQWGNQIQNQVPNTLSFLLPQPPPCLRLGGAYQEQASEMRRNELNLTLEPVCSCSLGCFAG

SEQ ID NO: 3948 - protein, 628 aa, Francisella tularensis
MCGVVGFYSFNKEEGFDSIINQSLLSIKHRGSDDSGYWCDNQVTLGHTRLSIHDITNAGHQPMLSNSGNTAIVFNGEIYNYLSIKNQLLSEYSNLKFKSNSDTEVLVNAIELWGIDKTLEKCIGMFAFGVYSRKTSCLILARDRFGEKPLYFGIQNGILGFASELKALKPLKECGWRFDIDRDALATYMRYAYVPTPYSIYKNISKLNVGSYIKFDAKGNSKEYKYWDSKKVLDSEKYKDSYDQAILDLEIKLKSTLSIQMQSDVPLGAFLSGGIDSTTVVALMQSMSKDKINTFSIGFNQKEYNEAEHARAVAKHIGTNHTDMYVTERDALDVIPKLAGIYDEPFADSSQIPTYLVSKIAKSKVTVALSGDAGDELFGGYNRYFLAPNIAKKIKFAKLLKYAPDAWIKKAEILNFGKFALLADKLLKLKRVLEKAKTNKELYVLLCSQINDTSFVLGAKEYDILRDKNIYDIPQLSFQEWMMFVDSNTYMIDDILVKVDRAAMANSLETRVPFLDHNIYEFAYSLPIDYKIQRGNGKRILKDLLYKYVPESLVNRSKMGFGIPLAKWLREDLREWADNLLDYSKIDKQGYLSPEVVQKYWQEHLSGKRNWQAILWNILIFQEWLDNE

SEQ ID NO: 3949 - protein, 428 aa, Triticum aestivum
  misc_feature (415)..(415): Xaa can be any naturally occurring amino acid
CTLPNAPFPNNLPSSYRGVAIKILDKEKVLKVGLAEQVRREITTMRLVAHKSIVQLHEVMATRSKIYFVMEYMKGGELFDKVSKGGKLTEGAAHKYFQQLISAVDYCHSRGVYHRDLKPENLLLDENENLKVSDFGLSALSESKRQDGLLHTTCGSPAYVAPEVISKGGYDGAKSDIWSCGVILFVLVAGYLPFQGQNLIEMYRKIEKGDFKCPGWVSQKLQKLLYKIMDPDPNKRISIQKIKESTWFRKGPGENLTAKERLPSENATTDAVPTLGVRRRKNSHEDGKPLAVTNLNAFEIISFSTGFDLSGLFVEKESKKEARFTSEQPASAIVSKLEAVAKTLNLRVRKKDNGVVKMQVRKEGRNGVLQFDSEIFEISPSYHLIEMKQTSGDSLEYQKLLEESIRPALKDICLXAWHGADGQQEPQG

SEQ ID NO: 3950 - protein, 369 aa, Photobacterium profundum
MTHPLFTPTSMSNNSQQPIALSNRMVMAPMTRARTSQPGNIPNEMMAEYYAQRASAGLIITEATQISDDSQGYSFTPGVYTSEHIQGWRTVTDAVHQAGGKIFNQLWHVGTVSHTHFQNGEAPIAPSAIQPIDTQVWIVKDGEDGTMFPCPMPREMNTDDIKRVIADFAQAAENAIEAGFDGIEIHGGNGYLIDQFLRTNSNKRTDEYGGNRENRLRFLMEVVEAVSARIGAERVGVRLAPFATFKDMDCPDIVPTILDAAEHLNQCGIAYMHLSEADWDDAPTIPDDFRVALRERFSGTIIVAGRYDLKRAEYILDAGYADLVAFGRAFLANPDLAHRLANDVALAEADNTKLFGGNKSGYSDYPACV

SEQ ID NO: 3951 - protein, 291 aa, Triticum aestivum
VIRTQLKRKATREENNAAESSDCMIVTTGVTGNPLLTPVSGKAVKNSKSKTKNNKAGPQTPTPNVGSPLNPSTPAGTCRYDSSLGLLTKKFINLLKQAEDGILDLNNAAETLEVQKRRIYDITNVLEGIGLIEKTLKNRIRWKGLDDSGVELDDGLSGLQTEVENLNLQEQALDERISDMREKLRGLTEDENSQRWLYVTEDDIKGLPCFQNETLIAIKAPHGTTLEVPDPDEAGDYLQRRYRIVLRSTLCPIDVYLVSQYDDGFENLCGAATPARHTNVPKSGPCEDLHA

SEQ ID NO: 3952 - protein, 319 aa, Arabidopsis thaliana
MALAVGTIRGYKKNLFEFVKTCAIADDGSSRSRVVSTMQKRAYFQRQWPLVDVVRASVVVIVHFLCLLAPFNFKWEALRFGLVLFALTTLSITFSFHRNLSHRSFKIPKWLEYPWAYSAVFALQGDPMDWVSIHRFHHQFTDSDRDPHSPKEGLLFSHILWIFDTQYIKYKCGGRDNVLDLKKQWFYKFLRRTIAVHILMFWTILYLYGGLPYLTCGGGVGIFIGYHVTWLVNSACHIWGSRSWNTKDTSRNVWWLSLFTMGESWHNNHHAFESSARQGLEWWQIDITWYLIRLFEVLGIATDVKLPSELQKQKMALVR

SEQ ID NO: 3953 - protein, 335 aa, Schizosaccharomyces pombe
MQQTYKPNTSALKDGAPKATVDQKQLLPCKYRVGRVLGGGTYATVREAVHIETNKMYAAKIMNKKMMEKKQDFVKNEIAILKRVSYEHPNILHLVDFFETVNNLYLITELATGGALFDRICAKGSFYEADAAALMRTTTSAVKYLHDNGIVHRDLKPENLLYRSKDPNSDLLIADFGLSHFYEDSQYYMLMTACGTPEYMAPEVFRRTGYGKPVDMWAIGVITYFLLSGYTPFARPSQVEVIEAILANEYTFNDPCWSGISETAKDFIKKCLENDPSKRLTAADALKHPFLSENGPATSNLLPNVRENFNARKTFRTAYNAVRAFNTWKKLENKH

SEQ ID NO: 3954 - protein, 205 aa, Emericella nidulans
MSSRKKVMLKVIILGDSGVGKTSLMNQYVNKKFSGSYKATIGADFLTKEVLVDDRLVTMQIWDTAGQERFQSLGVAFYRGADCCVLVYDVNNSKSFEALDSWRDEFLIQASPRDPESFPFVVIGNKIDMEESKRMISSKRAMTFCQSKGNIPYFETSAKEAVNVEQAFEVIARSALAQEEAEEYGGDYTDPINIHDTTERDGCAC

SEQ ID NO: 3955 - protein, 854 aa, Arabidopsis thaliana
RARVRFPHLPSIKKKNSSLHSFNEDLRRSNAVSFSLRKDSRSSGKVFARKPSYDSDSSSLATTASEKLRGHQSDSSSSASDQVQSRDTVSDDTQVLGNVDVQKTEEAQETETLDQTSALSTSGSISYKEDFAKMSHSVDQEVGQRKIPPPGDGKRIYDIDPMLNSHRNHLDYRYGQYRKLREEIDKNEGGLEAFSRGYEIFGFTRSATGITYREWAPGAKAASLIGDFNNWNAKSDVMARNDFGVWEIFLPNNADGSPAIPHGSRVKIRMDTPSGIKDSIPAWIKYSVQPPGEIPYNGVYYDPPEEDKYAFKHPRPKKPTSLRIYESHVGMSSTEPKINTYANFRDDVLPRIKKLGYNAVQIMAIQEHAYYASFGYHVTNFFAPSSRFGTPDDLKSLIDKAHELGLVVLMDIVHSHASKNTLDGLDMFDGTDGQYFHSGSRGYHWMWDTRLFNYGSWEVLRYLLSNARWWLEEYKFDGFRFDGVTSMMYTHHGLQVEFTGNYNEYFGYSTDVDAVVYLMLVNDLIHGLYPEAIVVGEDVSGMPAFCVPVEDGGVGFDYRLHMAVADKWIELLKKRDEDWQVGDITFTLTNRRWGEKCVVYAESHDQALVGDKTIAFWLMDKDMYDFMAVDRQATPRVDRGIALHKMIRLITMGLGGEGYLNFMGNEFGHPEWIDFPRTDQHLPDGRVIAGNNGSYDKSRRRFDLGDAEYLRYHGLQEFDRAMQNLEETYGFMTSEHQYISPKDEGDRVIVFERGNLLFVFNFHWTNSYSDYRIGCSVPGKYKIVLDSDNSLFGGFNRLDDSAEFFTSDGRHDDRPCSFMVYAPCRTAVVYAAVDDDDDDERSSLVPIGLLPEDV

SEQ ID NO: 3956 - protein, 194 aa, Arabidopsis thaliana
  misc_feature (184)..(184): Xaa can be any naturally occurring amino acid
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGNGDGILVPVPQYPLYSATISLLGGTLVPYYXDEFENWGLDV

SEQ ID NO: 3957 - protein, 377 aa, Pereskia zinniiflora
TDVPAAAAGAFKSYKLAAKAISRLQSLPSRNMSLLCDVLVKEVSELTGYDRVMVYRFHEDEHGEVISEYCRPDLGPYLGLHYPATDIPQASRFLFLKNRVRMIFDCLATPVKVIQYKKLTQPLSLGGSILRAPHGCHAQYMANMGSIASLVMAVTVNEDEDEVRSDPSTGKRLWGLVVCHHTSSRFIPFPLRYACELLVQVFGIQINKEVELAAQIRESHILRIQTVLCDMLLRDSPVAIVTQSPNVMDLVKCDGAALYYKGQVWLLGTTPTEEQIKNITQWLVEYHGSTKGLSTDSLMEAGYPGASELGDAVCGMAAVRISSKDVLFWFRSHTAKEIKWGGAKHDPVDSDERRKMHPRSSFKAFLEVVKWRSQPWE

SEQ ID NO: 3958 - protein, 166 aa, Nicotiana tabacum
IERYKKHHADSTSQGSVSESNTQYYQQEAAKLRRQIRDIQTYNRQIVGEALSSLSPRDLKNLEGKLEKAIGRVRSKKNELLFSEIELMQKREIDLQNANMCLRAKIAEVERAQQQMNLMPGGSEYNQQQQPMTTSQNYNDARNFLPVNLLEPNPHYSRHDDQTALQ

SEQ ID NO: 3959 - protein, 377 aa, Pereskia guamacho
TDVPVAAAGAFKSYKLAAKAISRLQSLPSRNMSLLCDVLVKEVSELTGYDRVMVYRFHEDEHGEVISEYRRPDLGPYLGLHYPATDIPQASRFLFLKNRVRMIYDCLAIPVKVIQYKKLTQPLSLGGSILRAPHGCHAQYMANMGSIASLVMAVTINEDEDEVKSDPSTGKRLWGLVVCHHTSSRFIPFPLRYACELLVQVFGIQINKEVELAAQIRESHILRIQTVLCDMLLRDSPVAIVTQSPNVMDLVKCDGAALYYKGQVWLLGVTPTEEQIKNITQWLLEYHGNTKGLSTDSLMEAGYPGASELGDAVCGTAAVRISSKDILFWFRSHTAKEIKWGGAKHDPVDSDDRRKMHPRSSFKAFLEVVKWRSQPWE

SEQ ID NO: 3960 - protein, 285 aa, Lactobacillus johnsonii
MKFNSVEDTYTLNNGVKIPIIGFGTWQTPDGDVAKHVVEAALNSGYRHIDTAAAYGNEESVGEGIKNSGINRHDLFITTKLWNADHGYKEAKAAIDKSLQNLGTDYLDLYLIHWPNPLALRDHWAEANAESWRAMEEAVKAGKIRAIGVSNFRKHHLEELLKTAEIKPAVNQIMLNPSDLQSDVVKVNEELGLLSEAYSPLGTGGLLGNEVVNEIANEVGKSPAQVLIRWSLEHGFLPLPKSVHDKYIAANIDVFDFELNDEQMSKLDSLHGVSDLATDPDTANF

SEQ ID NO: 3961 - protein, 116 aa, Arabidopsis thaliana
TLLLCGTIQLAICRSEEKSTEKTMMLGGVHDLRGNQNSGEIESLARFAIQEHNKQQNKILEFKKIVKAREQVVAGTMYHLTLEAKEGDQTKNFEAKVWVKPWMNFKQLQEFKESSS

SEQ ID NO: 3962 - protein, 580 aa, Triticum aestivum
  misc_feature (221)..(221): Xaa can be any naturally occurring amino acid
MYRAAAAAISRSSSSALRRQLARGGGGEQRQWARGYAAKEVTFGVGARAAMLRGVNDLADAVKVTMGPKGRNVVIERPNRSPKVTKDGVTVAKSIEFEDSAKNVGASLVKQVADATNKAAGDGTTCATVLTQAILTEGCKAVAAGVNVMDLRKGINKAISAVTAHLKSKAWVIDSPDEINQVATISANGEKEIGDLISKAMGIVGKDGPVSRADPRARDNXELEAVQGMKLTRGYISPYFVTDHKTQKCELKDPLILIHDKKISNMNSLLPAVQISIQNRRPLLIFAEDVDGEALSMLVLNKHRAGLKICAVKAPGFGENRRANLDDMAVLTGGQVISEDQGLDLDKVELQMLGTAKKVTVSLDDTIILDGGGERQQIEERCQQLRESLENSTSMFDKEKAQERLSKLSGGVAILKIGGASEAEVGEKKDRVTDALNAARAAVEEGIVPGGGVALLYATKELDNISTSHEDEKIGVQIIKNALKAPLMTIAANAGIDGAIVIGKLLEQDNLSLGYDAAKGEYVDMIKAGIIDPVKVIRTALQDAASVSLLMTTTEAAVAELPSTKARIASRMPDMSGMGF

SEQ ID NO: 3963 - protein, 294 aa, Listeria monocytogenes
MTKTLQDRMILPGNETIPYIGLGVFQVTEQEFIAGAVEKAIEVGYRLFDTAAVYNNEAIVGQAIASSAVSREELFISSKVWNGDLGFDETLFAFERTLRNLKLDYLDLYLIHWPVAGKYRDSWRAMERLHDEKLIKSIGVANFKQHHLSDLLVAANEKPVLNQVETHPLLPQNDLRKYLAEQNIAHAAWSPLAKGILMQNPVITEIAKKHQASVDQVILQWHLNRNTIIFPKSITSSRIEENSRLSYFQLDAIDMEKIDRLETGKRVGPDPDDLEYFLSSIERERAYLSGENAE

SEQ ID NO: 3964 - protein, 412 aa, Burkholderia pseudomallei
MKPIQKSNKLLNVCYDIRGPVLEHAKRLEDEGHRIIKLNIGNLAPFGFDAPDEIIQDMIRNLPASSGYSDSKGVFAARKAIMHYTQQKGVHGVGLDDIYIGNGASELIVMATQALLNDGDEVLLPAPDYPLWTAAVSLSGGTPVHYVCDESNRWMPDPDDIRRKITPNTKALVVINPNNPTGALYSDALLIELIAIAREHGLIIFADEVYDKIVYDGKSHTALASLAEDVITVTFNSLSKSYRSCGYRAGWMSVAGLTAENRRRAHDYLEGLGILSSMRLCANVPGQYAIQTALGGYQSINELIMPSGRLYKQRELAYDMLTSIPGVSCVKPEAALYMFPRLDPKLYPIENDQQFILELLLRERVLLVQGTGFNWPTPDHFRVVFLPNVDDLTDSIERIARFLDGYRKRNSV

SEQ ID NO: 3965 - protein, 358 aa, Zea mays
MVGGGGGGPLRRVGKYEVGRTIVEGTFAKVKFAQNTETGESVAMKVLDRSSILKNKMAEQIKREISIMKLVRHPNVVRLHEVLASRKKIFIILEFITGGELFDKIIRHGRLSEADARRYFQQLIDGVDFCHKKGVYHRDLKPENLLLDSQGNLKISDFGLSAWPAQGSFLLRTTCGTPNYVAPEVLSHKGYNGALADTWSCGVILYVLLAGYLPFDEVDLTTLYGKDDNEDAFEDETGPLTLNAFDLIILSQGLNLAALFDRRQDCDKLQNRFLSRNPAKVILSSMEVVAQSMGFKTHIRNYKMRVEGLNADKTSHLSVMVEVFEVAPSIFMVELQRAAGDTSEYNTIHPKGQIYIGQ

SEQ ID NO: 3966 - protein, 479 aa, Streptomyces sp.
MVPAAQQTATAPDAALTFPEGFLWGSATASYQIEGAAAEDGRTPSIWDTYARTPGRVRNGDTGDVATDHYHRWREDVALMAELGLGAYRFSLAWPRIQPTGRGPALQKGLDFYRRLADELLAKGIQPVATLYHWDLPQELENPGGWPERPTAERFAEYAAIAADALGDRVKTWTTLNEPWCSAFLGYGSGVHAPGRTDPVAALRAAHHLNLGHGLAVQALRDRLPADAQCSVTLNIHHVRPLTDSEADADAVRRIDALANRVFTGPMLQGAYPEDLVKDTAGLTDWSFVRDGDLRLAHQKLDFLGVNYYSPTLVSEADGSGTHNSDGHGRSAHSPWPGADRVAFHQPPGETTAMGWAVDPSGLYELLRRLSSDFPALPLVITENGAAFHDYADPEGNVNDPERIAYVRDHLAAVHRAIKDGSDVRGYFLWSLLDNFEWAHGYSKRFGAVYVDYPTGTRIPKASARWYAEVARTGVLPTA

SEQ ID NO: 3967 - protein, 196 aa, Glycine max
  misc_feature (184)..(184): Xaa can be any naturally occurring amino acid
MINCLGLYPLISAPSTIACTTHIVRSKQYLATQKPVNLALGYRNPHGYGFSFGSRRSIHERVSSHFKGIAVMTDDKSTMSSTEEDLENIGIFHIDPSLKPYKDHFKYRLKRYVDQKKLIEEYEGGLEEFSQGYLKFGFNREEGGIVYCEWAPAAQEAQIIGDFNGWDGSNHQMEKNQFGVWSIXIPDTDGNSAIPH

SEQ ID NO: 3968 - protein, 137 aa, Nicotiana tabacum
IFDPFEGFPFSGTVANVPSSARETSAFANARIDWKETPDSHIFKMDVPGIKKEEVKVEVEEGRVLQISGERSREQEEKNDTWHRMERSSGKFMRRFRLPENAKMEEIKAAMENGVLTVTVPKEEEKKSEVKAIDISG

SEQ ID NO: 3969 - protein, 203 aa, Magnetospirillum magnetotacticum
MTDNRPILTTRQGHPVRDNQSTRTVGERGPATLENYQFIEKITHFDRERIPERVVHARGAGAHGWFEAYGKIGDEPASKYTRARVLNETGVKTPMFVRFSTVAGAKESPETERDPRGFAVKFKTVEGNWDLVGNNLKVFFIRDAIKFPDMIHAFKPDPVTNRQEAWRFFDFVAQHPESIHMVTWLKSPWGIPANYREMEGYGR

SEQ ID NO: 3970 - protein, 481 aa, Nostoc punctiforme
MSDLILFWHRRDLRISDNTGLAAAKRRSPKVVGVFCLDPHILERDDVAPVRVTYMIGCLQKLQERYAQVGSQLLILHADPVQAIPALAEAINAKAVFWNWDVEPYSQERDRTIINALKEKGIEFLNQNWDQILNSPDEIRTGGNSPYTVYTPFWKNWITKPKANPVETLQNVEGLTEAEQEIAKLSGSLTLPSAKDLGFIWDEQLIISPGEAAAQERLEEFTNKAITEYQEQRNFPAVDGTSQLSAALKFGVIGIRTVWQATIEALENSRSEETAVNIRTWQQELAWREFYQHAMYNFPELADGAFRDTFKNFPWETNEEHFQAWCEGRTGYPIVDAAMRQMNESGWMHNRCRMIVASFLTKDLLINPQLGEKYFMKHLIDGDLSANNGGWQWSASSGMDPKPVRIFNPASQTQKFDPEGEYIRQWVSELRSVDTEYLVTGKIPPLERHAVGYPDPIVDHKIQQNQFKLRYQQQKNTSGGE

SEQ ID NO: 3971 - protein, 377 aa, Echinocactus platyacanthus
TDVPAAAAGAFKSYKLAAKAISRLQSLPSRNMALLCDVLVKEMSELTGYDRVMVYKFHEDEHGEVISEYRRPDMEPYLGLHYPATDIPQASRFLFLKNRVRMICDCLATPVKVIQGKKWAQPLSLGGSILRAPHGCHALYMANMGSIASLVMAVTINEDEDEVKSDPSTGKRLWGLVVCHHTSSRFIPFPLRYACELLLQVFGIQINKEVELAAQIRESHILRIQTVLCDMLLRDSPVAIVTQSPNVMDLVKCDGAALHYKGQVWLLGITPTEEQIKNITQWLLKYHGSTKGLSTDSLMEAGYPGASELGDAVCGMAAVRISSKDVLFWFRSHTAKVIKWGGAKHDPVDSDDGRKMHPRSSFKAFLEVVKWRSQPWE

SEQ ID NO: 3972 - protein, 377 aa, Pereskia stenantha
TDVPAAAAGAFKSYKLAAKAISRLQSLPSRNMSLLCDVLVKEVSELTGYDRVMVYKFHEDEHGEVISEYRRPDLEPYLGLHYPATDIPQASRFLFLKNRVRMICDRLATPVKVIQDKKLAQPLSLGGSILRAPHGCHAQYMANMGSIASLVMAVTINEDEDEVKSDPSTGKRLWGLVVCHHTSSRFIPFPLRYACELLVQVFGIQINKEVELAAQIRESHILRIQTVLCDMLLRDSPVAIVTQSPNVMDLVKCDGTALYYKGQVWLLGITPTEEQIKNITRWLLEYHGSTKGLSTDSLMEAGYPGASELGDAVCGMAAVRISSKDVLFWFRSHTAKEIKWGGAKHDPVDSDDGRKMHPRSSFKAFLEVVKWRSQPWE

SEQ ID NO: 3973 - protein, 581 aa, Glycine max
MCGILAVLGCSDDSRAKRVRVLELSRRLKHRGPDWSGLHQHGDCFLAHQRLAIVDPASGDQPLFNEDKSVIVTVNGEIYNHEELRKQLPNHNFRTGSDCDVIAHLYEEHGEDFVDMLDGIFSFVLLDTRDNSFIVARDAIGVTSLYIGWGLDGSVWISSEMKGLNDDCEHFECFPPGHLYSSKERGFRRWYNPPWFSEAIPSAPYDPLVLRHAFEQAVIKRLMTDVPFGVLLSGGLDSSLVASITSRYLANTKAAEQWGSKLHSFCVGLEGSPDLKAAKEVADYLGTVHHEFTFTVQDGIDAIEDVIYHIETYDVTTIRASTPMFLMSRKIKSLGVKWVISGEGSDEIFGGYLYFHKAPNKEEFHRETCRKIKALHQYDCLRANKSTFAWGLEARVPFLDKAFINAAMSIDPEWKMIKRDEGRIEKWILRRAFDDEEHPYLPKHILYRQKEQFSDGVGYSWIDGLKAHAAKHVTEKMMLNAGNIYPHNTPKTKEAYYYRMIFERFFPQNSARLTVPGGASVACSTAKAVEWDAAWSNNLDPSGRAALGVHISAYENQNNKGVEIEKIIPMDAAPLGVAIQG

SEQ ID NO: 3974 - protein, 290 aa, Arabidopsis thaliana
MANAITFFKLNTGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSAYSPLGSPGTTWLKSDVLKNPILNMVAEKLGKSPAQVALRWGLQMGHSVLPKSTNEGRIKENFNVFDWSIPDYMFAKFAEIEQVRS

SEQ ID NO: 3975 - protein, 445 aa, Pseudomonas syringae
MLHLSRLTSLALAIAIVIGAPLAQAAEKTAPATPAAVAPAKPNANAKPPLPLDELRTFAEVMDRVKAAYVEPVDDKTLLENAIKGMLSNLDPHSAYLGPEDFQELQESTSGEFGGLGIEVGVEDGLVKVVSPIDDTPASKAGIEAGDLIVKINGTPTQGQNMQEAVDKMRGKIGEKITLTLVRDGGTPFDVTLARATIQVKSVKAQMLENGYGYIRITQFQVKTGDEVGKALAKFRKDNGKKMSGLILDLRNNPGGVLQSAVQVADHFLTKGLIVYTKGRIANSELRFSADPADASEGVPLVVLINGGSASASEIVAGALQDQKRGILMGTDTFGKGSVQTVLPLNNDRALKITTALYYTPNGRSIQAQGINPDIVVRRAKVTSEADGENYKEADLMGHLGNGNGGADKPTVKGSAAAKARPQDDDFQLSQALSLLKGLSITRGN

SEQ ID NO: 3976 - protein, 496 aa, Staphylococcus aureus
MDDKQHTSSSDDERAEIATSNQDQETNSSKRVHLKRWQFISILIGTILITAVITVVAYIFINQKISGLNKTDQSNLNKIENVYKILNSDYYKKQDSDKLSKAAIDGMVKELKDPYSEYLTKEQTKSFNEGVSGDFVGIGAEMQKKNDQIMVTSPMKGSPAERAGIRPKDVITKVNGKSIKGKALDEVVKDVRGKENTEVTLTVQRGSEEKDVKIKREKIHVKSVEYKKKGKVGVITINKFQNDTSGELKDAVLKAHKDGLKKIVLDLRNNPGGLLDEAVKMANIFIDKGKTVVKLEKGKDTEAIQTSNDALKEAKDMDISILVNEGSASASEVFTGALKDYNKAKVYGSKTFGKGVVQTTREFKDGSLLKYTEMKWLTPDGHYIHGKGIKPDVTIDTPKYQSLNVIPNTKTFKVGDDDKNIKTIKIGLSALGYKVDNESTQFDKALENQVKAFQQANKLEVTGEFNKETNNKFTELLVEKANKHDDVLDKLINILK

SEQ ID NO: 3977 - protein, 221 aa, Glycine max
MGQKSLIYAFVSRGTVILAEYTEFSGNFNSIAFQCLQKLPATNNKFTYNCDAHTFNYLVDNGYTYCVVADESIGRQLPMAFLERVKDEFVSKYGGGKAATAPANSLNKEFGPKLREHMQYCVDHPEEISKLAKVKAQVSEVKGVMMENIEKVLDRGDKIELLVDKTENLHNQAQDFRTSGTRIRRKMWLQNMKIKLIVLGILIALILIIVLSVCRGFNCGK

SEQ ID NO: 3978 - protein, 330 aa, Arabidopsis thaliana
  misc_feature (99)..(99): Xaa can be any naturally occurring amino acid
  misc_feature (149)..(149): Xaa can be any naturally occurring amino acid
MQAISKVSSAASFFRCSRKLVSQPCVRPCVRQLHVRKGLVSGVMKLFSSPLRTLRDAGKSVRISRFCSVSNVSSSLQIELVPCLKDNYAYILHDEDPGXTVGVVDPSEAVPVMDALQKNRRNLTYILNTHHHYDHTGGNLELKDRYWCXVIGSAMDKDRIPGIDMALKDGDKWMFAGHEVHVMDTPGHTKGHISLYFPGSRAIFTGDTMFSLSCGKLFEGTPKQMLASLQKITSLPDDTSIYCGHEYTLSNSKFALSLEPNNEVLQSYAAHVAELRSKKLPTIPTTVKMEKACNPFLRSSNTDIRRALRIPEAADEAEALGIIRKAKDDF

SEQ ID NO: 3979 - protein, 465 aa, Solanum tuberosum
MKLLSKKAMCNSHGQDSSYFLGWEEYEKNPYDETRNPKGIIQMGLAENQLSFDLLESWLTQNPDAAAFKRNGNSIFRELALFQDYHGLPAFKDALVQFMSEIRGNKVSFDSNKLVLTAGATSANETLMFCLADPGDAFLLPTPYYPGFDRDLKWRTGAEIVPIQCTSSNGFRITESALEEAYKEAERRNLRVKGVLVTNPSNPLGSTLTKKELQLLLTFVSTKQIHLISDEIYSGTVFNSPKFVSVMEVLIENNYMYTEVWDRVHIVYSLSKDLGLPGFRVGAIYSNDDMIVSAATKMSSFGLISSQTQYLLSALLSDQKFMKNYVSENQKRLKKRHEMLVGGLKQIGIRCLESNAGLFCWVDMRHLLSSNTFDGEMELWKKIVYEVGLNISPGSSCHCTEPGWFRACFANMSEDTLNIAIQRLKAFVDSRDNKDDIQNQKHSNKKKSFSKWVFRLSFNERQRER

SEQ ID NO: 3980 - protein, 117 aa, Neurospora crassa
MPTMWLSDSQKIGVAFCSGGGFFLIGGVLLFFDRAMLAMGNQKAKGTAAFFSGLALILMRWPLIGFCVELYGIMILFGDFLGTIAGFARNIPVIGPYIGTAVDRSGVVARQNADLPV

SEQ ID NO: 3981 - protein, 465 aa, Solanum tuberosum
MKLLSKKAMCNSHGQDSSYFLGWEEYEKNPYDETRNPKGIIQMGLAENQLSFDLLESWLTQNPDAAAFKRNGDSIFRDLALFQDYHGLPAFKDALVQFMSEIRGNKVSFDSNKLVLTAGATSANETLMFCLADPGDAFLLPTPYYPGFDRDLKWRTGAEIVPIQCTSSNGFRITESALEEAYKEAERRNLRVKGVLVTNPSNPLGTTLTKKELQLLLTFVSTKQIHLISDEIYSGTVFNSPKFVSVMEVLIENNYMYTEVWDRVHIVYSLSKDLGLPGFRVGAIYSNDVMIVSAATKMSSFGLISSQTQYLLSALLSDKKFTKKYVSENQKRLKKRHEMLVGGLKQIGIRCLESNAGLFCWVDMRHLLSSNTFDGEMELWKKIVYEVGLNISPGSSCHCTEPGWFRACFANMSEDTLNIAIQRLKAFVDSRDNKDDIQNQKHSNKKKSFSKWVFRLSFNERQRER

SEQ ID NO: 3982 - protein, 486 aa, Leuconostoc mesenteroides
MYSKESITGFPKDFLWGGATAANQIEGAWQVDGKGLTTAEVVRKAEDRRHGSMGDVNADTLQEAIADHSDVHYPKRRGVDFYHHYKEDIALFAEMGFKVFRLSIAWSRIFPTGLEENPNEAGLAFYDRVFDELDKYHIEPLVTLSHYEMPIELTKRYNGWLDREVIKAFNHYTETVFKRYKDRVKYWLTFNEINTSAWGFHETGAMDGDLSTQEQLQVRYQAVHHQFVASAIATKQLKEIAPNAKIGSMLARMQTYPATANPVDVQAAQVEDQKNLFYTDVQARGEYPEYMNRYFNENGIVINMSADDEKILKQYPVDFISFSYYMTNVTGVDGVEDGIGNMSLGGRNPYLKESEWGWQIDPIGLRVSLNVLWDRYRKPLFIVENGLGAVDELTADYKVHDDYRIDYLRLHIEQMKEAVIDGVDLMGYTMWAPLDIISFSTSEMSKRYGLIYVDQDDAGNGTLKRYKKDSFFWYQKVIESNGKTLE

SEQ ID NO: 3983 - protein, 870 aa, Phaseolus vulgaris
MVYTISGIRFPAVLSLHNSTLRGDRRAASLPVFLRKNNFSRKILAVKSSHDSDSPSSAIAESDKVLIPQDHDNSASLTDQLETPVITSVDAHNLEDLTMEDEDKYNIGEADSSYRQIEDGLGSVASSPVDVDIPAKKTSVSVGKEVKIPSVEAKPKIIPRPGAGQKIYEIDPSLLAYRDHLDFRFGQYKRLHDEINKHEGGLDAFSRGYEQFGFLRSATGITYREWAPGAKSAALIGDFNNWNPNADVMTRNEFGVWEIFLPNNVDGSPPIPHGSRVKIRMDTPSGIKDSIPAWIKFSVQAPGEIPYSGIYYDPPEEEKYVFKHPQPKKPKSLRIYESHVGMSSPEPKINTYANFRDDVLPRIKKLGYNAVQIMAIQEHSYYASFGYHVTNFFAPSSRFGTPEDLKSMIDKAHELGLLVLMDIVHSHSSNNTLDGLNMFDGTDGHYFHPGSRGYHWMWDSRLFNYGSWEVLRYLLSNARWWLDEYKFDGFRFDGVTSMMYTHHGLQVAFTGNYSEYFGLATDVDAVVYLMLANDLIHGLFPEAVTIGEDVSGMPTFCLPTQDGGVGFDYRLQMAIADKWIEILKKQDEDWKMGDIVHTLTNRRWLEKCVAYAESHDQALVGDKTIAFWLMDKDMYDFMSLDRPATPRIDRGIALHKMIRLITMGLGGEGYLNFMGNEFGHPEWIDFPRGEQQLPNGSVIPGNNYSYDKCRRRFDLGDADYLRYRGMQEFDQAMQHLEEKFGFMTTEHQYISRKNEGDKVIIFERGNLVFVFNFHWNNSYSDYRVGCATPGKYKIVLDSDDALFGGFNRLNHSAEYFTSEGWYDDRPRSFLIYAPSRTAVVYALADDLEPAFLDEVEPALADEVEPEPVDP

SEQ ID NO: 3984 - protein, 543 aa, Brevibacillus choshinensis
MAKQVKFSEDAPRSMLRGVETLPNAVKVTLGPKGRNVVLEKKFGSPLITNDGVTIPKEIELEDAYENMGAQLVKEVATKTNGIAGDGTTTATVLAAAMIREGLKNVAAGANPMVIRRGMEKAVGAAVEEIKSIAKPVENKSSIAQVAAISADDQEVGNLIAEAMEKVGKDGVITVEESKGFVTELEVVEGMQFDRGYASPYMITDTDKMEAVLNNPFILITDKKISNIQEVLPVLEQVVQSGKPLLIIAEDVEGEALATLVVNKLRGTFTAVAVKAPGFGDRRKAMLQDIAALTGGEVITEELGLDLKSTKLEQLGRAGKIVVTKENTTVVEGAGDKANIESRVAQIRQQIEDTTSDFDREKLQERLAKLAGGVAVIKVGAATETELKEKKLRIEDALNSTRAAVEEGIVPGGGTTLINAIKAVEGVKVEGEEAVGVHIVLRSLEEPVRQIAANAGLEGSVIVERLKKEPVGIGFNAATEEYVNMLEAGIVDAAKVTRSALSNAASVAAMFLTTEAVIADKPEENKAPMGMPDMGGMGGMGMM

SEQ ID NO: 3985 - protein, 372 aa, Xanthomonas campestris
MINFDWLLMSKSTQSPLFSPVRLGALELANRVIMAPLTRNRAVAGQVPSPLAAEYYGQRATAGLIVAEGTQISPLGQGYLDTPGIYTKEQIEGWRAVTDEVHRRGGKIVLQLWHVGRVSHTSVLPPGEVPVAPSAIRAEGKTFTKNGFEDVSEPRALALDEIPGLIEDYRIAARNAIDAGFDGVEVHAANGYLLDQFLRDSSNQRTDTYGGDIENRTRLLAEVVQAIADEIGADRTGVRLSPVTPVYGAHDSDPQPLFERAVERLNLIGGLAFVHVIEGATGGPRDNIAFDYAALRAKFDGAWIANNGYDRGMSEQAISSGYADAIAYGRPFIANPDLVRRLRENAPLAEIDQATMYGGGAKGYTDYPALPE

SEQ ID NO: 3986 - protein, 432 aa, Zea mays
MDERRTILMDRYEIGRQLGQGNFAKVYFARNLTDGQSVAIKMIDKDKITRVGLIVQIKREISIMRLVKHPNVLQLFEVMASKSKIYFVLEYAKGGELFNKVSKAKLSEDAARRYFHQLVNAVDYCHSRGVYHRDLKPENLLLDENENLRVSDFGLSALSESKRHDGLLHTTCGTPAYVAPEVLGRRGYDGTKADIWSCGVILFVLVAGYLPFHDPNLIEMYRKISRAEYRCPRSFSGELKDLLFRMLDPDPSTRISISRIKRSTWYRKPIEANAAKIKHGTARDTTVRDGEAATASSSIECSNRPEEDQGSSSLPNLNAFDIISLSTGFDLSNLFEERHGRREERFTTRQPVGAVFGRLKELAEAVEAEKFQKEREAGSLNLACAEGKGLKGVPWKLDAEVFELAPSFLLVELKKASRDTIEYQRLREGRKC

SEQ ID NO: 3987 - protein, 893 aa, Oryza sativa
MDGRSILMGRYEVGKQLGQGTFAKVYYARNLTTGQAVAIKMINKDKVMKVGLMEQIKREISIMRLVKHPNVLQLFEVMASKSKIYFVLEYAKGGELFNKIAKEGKLSEDSARRYFHQLINAVDYCHSRGVYHRDLKPENLLLDENENLKVSDFGLSALAESKRQDGLLHTTCGTPAYVAPEVLSRKGYDGAKADVWSCGVILFVLVAGYLPFHDPNLIEMYRKICRADFRCPRYFSAELKDLIHKILDSDPSTRISIPRIKRSTWYRKPVEINAKNSEAATTNSISSGVATTSGSAECSTSEENQGSLSLPNLNAFDIISLSTGFNLSGFFEDTHGHQEERFTTRQPVTTVLGKLKELAKRLKLKVKKKDNGVLRLAAPKEGKKGFLELDAEIFEVTPSFLLVELKKTNGDTMEYRKLVKEDIRPALKDIVWVWQGDEHLNSQSILQGEQQQSPLPPELPQDQLQPSLPQQEKQDMPEPPLLPQVNASTGNHNDHWLVHWLMMKPFRFPPPDSVPSTGRDEEEGSSHHGNGSGAARENPENPLPDLALAKSESDRIKAFYQTVLSAIVVFIVAALSGYKDMKPLYSTTNHKKVHLSNLLVIEGFCMIATFICAAVLMMYEFYTCRDLTVLIAVAGAMLVATDTILVVIANRDNAVFAVLFVPVLLLVGMAVYTGASMEEQPPNSPHDGGYDEATKSTFDLATVSTMAALGLQGTIVFGYLKTPEKKSEHDDPPLDLAVCYIASTVCLTVMAFLDGFVVLSVWPEAVALVLYYAAQLCSGRQPGGGVGSRPWIEFVFRIVATAGFTLMAGLYAAFLGTNHYSVYLKAAMLVLLMAVLSSLSRLANPVYMPEIDGALLEFCVAGVALAFPAVSLLVACPLVLKVFVDLYIHHSSL

SEQ ID NO: 3988 - protein, 429 aa, Arabidopsis thaliana
  misc_feature (388)..(388): Xaa can be any naturally occurring amino acid
MVVRKVGKYELGRTIGEGTFAKVKFAQNTETGESVAMKIVDRSTIIKRKMVDQIKREISIMKLVRHPCVVRLYEVLASRTKIYIILEYITGGELFDKIVRNGRLSESEARKYFHQLIDGVDYCHSKGVYHRDLKPENLLLDSQGNLKISDFGLSALPEQGVTILKTTCGTPNYVAPEVLSHKGYNGAVADIWSCGVILYVLMAGYLPFDEMDLPTLYSKIDKAEFSCPSYFALGAKSLINRILDPNPETRITIAEIRKDEWFLKDYTPVQLIDYEHVNLDDVYAAFDDPEEQTYAQDGTRDTGPLTLNAFDLIILSQGLNLATLFDRGKDSMKHQTRFISHKPANVVLSSMEVVSQSMGFKTHIRNYKMRVEGLSANKTSHFSVILEXGDAEEYLKFYKTFCSKLDDIIWKPPDASMKNRVTKAKSKRR

SEQ ID NO: 3989 - protein, 270 aa, Pleurotus djamor
AHFDRERDPERVVHAKAAGAHGYFEVTHELSDITSNPLLTSVGKKVDLTARFSTVGGESGSADTARDPRGFAFKLRTEQGNWDWVFNNTPIFFIRDPAKFPHFIHTQKRDPQTHLKDADMFWDYLGQNPESIHQMMILFSDRGTPDGVDSMHGYSGHTFKWLKNDGTFVYVQVHVRADQGFKTLDGPTAHKLTADNPDYSTEKMFNRIEKGDYPSWTVYIQTMTPEQAESFRYNILDLTKVWPHAQYPLRPIGKVVLNKNPVTYFAEVEQ

SEQ ID NO: 3990 - protein, 500 aa, Gloeobacter violaceus
MSTKTVLVWYRNDLRVHDHEPLTSALHKNARVVALYCFDPRQFGKAPFGFEKTGPFRARFLLESVADLRRSLRQLGSDLLVRRGHPEEVIPALVSELEIAAVHYHGEVTSEELVVERDLQAALAPLNVPVRSFWGTTLVHPDDLPFAIEAIPELFTDFRKQVERSAAINPPLPAPAKLPPLPAVDPGEIPQLADLGLESPVTDERAVLQFKGGETSGLARLEEYFWQKSLLKSYKQTRNGMLGADYSSKFSAWLALGCLSARYIHEQVQTYETKRIKNDSTYWLIFELLWRDYFRFIAAKHGDRLFYTAGLRGLDIPWKEDWERFELWRTGQTGFPLVDANMRELAATGFMSNRGRQNVASFLTKNLGIHWHMGAEWFESRLIDYDVASNWGNWNYTAGVGNDARGFRFFNILKQARDYDPDGAYVKHWLPELAGLPPARVHEPWKLLPVEQKRFGVRLGVDYPQPVVDLFQSAAANEAIYNAAWEHHHRKRRGQPRSRT

SEQ ID NO: 3991 - protein, 377 aa, Blossfeldia liliputana
TDVPAAAAGAFKSYKLAAKAISRLQSLPSRNMALLCDVLVKEVSELTGYDRVMVYKFHEDEHGEVISEYLRPDMEPYLGLHYPATDIPQASRFLFLKNRVRLICDCLATPVKVIQGTKWAQPLSLGGSILRAPHGCHALYMANMGSIASLVMAVTVNDDEDEVKSDPSTGRRLWGLVVCHHTSSRFIPFPLRYACELLVQVFGIQINKEVELAAQIRESHILRIQTVLCDMLLRDSPVAIVTQSPNVMDLVKCDGAALFYEGQVWLLGITPTEEQIKNITQWLLKYHGSTKGLSTDSLMEAGYPGASELGDAVCGMAAVRISSKDVLFWFRSHTAKEIKWGGAKHDPVDGDDGRKMRPRSSFKAFLEVVKWRSQPWE

SEQ ID NO: 3992 - protein, 305 aa, Corynebacterium glutamicum
MSVVGTGLFFGSPEEERDKLMQSLMDQKNKLSKSEGIPLVTLNDGKTIPQLGFGVFKVDPDEAERVVTEALEVGYRHIDTAAIYGNEEGVGRAIAKSGIPREELFITTKLWNDRHLDVEAAFEESLQKLGLDYVDLYLVHWPAPKNDNYVAAWKGLEKLGDRARSIGVCNFLPEHLEKLLAEATTVPAINQIELHPALQQRDAVEASLAAGITVESWGPLGQGRFDLGAEEPIAAAAKNHGKTPAQVVIRWHLQNGFVVFPKTVTKSRMVENIDVFDFELSDEEMAAITALERNDRGGSHPNDLN

SEQ ID NO: 3993 - protein, 507 aa, Arabidopsis thaliana
MRTIYLSLLVFIIVLALNEVMAKKHSSTPKLRRSDFPEDFIFGAATSAYQVEGAAHEDGRGPSIWDTFSEKYPEKIKDGSNGSIASDSYHLYKEDVGLLHQIGFDAYRFSISWSRILPRENLKGGINQAGIDYYNNLINELLSKGIKPFATIFHWDTPQSLEDAYGGFLGAEIVNDFRDYADICFKNFGDRVKHWMTLNEPLTVVQQGYVAGVMAPGRCSKFTNPNCTAGNGATEPYIVGHNLILAHGEAVKVYREKYKASQKGQVGIALNAGWNLPYSESAEDRLAAARAMAFTFDYFMEPLVTGKYPIDMVNYVKGGRLPTFTAKQSKMLKGSYDFIGRNYYSSSYAKDVPCSSENVTLFSDPCASVTGEREGVPIGPKAASDWLLIYPKGIRDLLLYAKYKFKDPVMYITENGRDEASTGKIDLKDSERIDYYAQHLKMVQDAISIGANVKGFFAWSLLDNFEWATGYAVRFGLVYVDFNGGRKRYPKKSAKWFKKLLNEKKKN

SEQ ID NO: 3994 - protein, 387 aa, Rhodopseudomonas palustris
MSQPPLFRPFTLRGITTKNRILISPMCQYSAVDGVANDWHLVHLGKFAQGGTGIVMVEATAVTANGRITHGDLGLWNDDQIRPLERIAAFLRDNGAVPAIQLAHAGRKASMQRPWYGNAALTAEDIARGDQPWEIVAPSPIPMDEGWLTPQELTDDNLDYLLEAWRSATLRAVEAGFEMLEVHCAHGYLLHSFLSPLSNKRTDAYGADRAGRMRFPLEVIETVRAAWPDTLPLAIRVSSVDGVDGGIELADSVVFAREAKARGADIIDCSSGGLLGSATANRIPRGYGFQVPFAEAIRTEAEIPTIAVGLIIHPDQAEKIVEQGQADLIAIGREALFDPNWALHAQLELTEGDEVFADWPKQYGWWLERRESGLRKLDGPKLPFRRS

SEQ ID NO: 3995 - protein, 335 aa, Schizosaccharomyces pombe
MQQTYKPNTSALKDGAPKATVDQKQLLPCKYRVGRVLGGGTYATVREAVHIETNKMYAAKIMNKKMMEKKQDFVKNEIAILKRVSYEHPNILHLVDFFETVNNLYLITELATGGELFDRICAKGSFYEADAAALMRTTTSAVKYLHDNGIVHRDLKPENLLYRSKDPNSDLLIADFGLSHFYEDSQYYMLMTACGTPEYMAPEVFRRTGYGKPVDMWAIGVITYFLLSGYTPFARPSQVEVIEAILANEYTFNDPCWSGISETAKDFIKKCLENDPSKRLTAADALKHPFLSEKRPATSNLLPNVRENFNARKTFRTAYNAVRAFNTWKKLENKH

SEQ ID NO: 3996 - protein, 532 aa, Vibrio vulnificus
MAAKDVLFANDARQKMLKGVNLLADAVKVTLGPKGRNVVLDKSYGAPSITKDGVSVAKAIELKDKFENMGAQMVKQVASKANDEAGDGTTTATVLAQALINEGLKAVAAGMNPMDLKRGIDKAVDSAVEKLRAMAQPCSDKESITQVGSISANSDRAIGDIIAEAMEKVGRNGVITVEEGQGLSNELSVVEGMQFDRGYLSPYFITNQDSGAVELDNPYILLVDKKVSSIRELLPVLESVAKASRSLLIIAEDIDGEALATLVVNNLRGIVRAAAVKAPGFGDNRKAMLEDIAVLTAGTVISEEIGLELEKATIEQLGSAKKVTITKDTTTIVGGAAQESAIRDRVATIEKQIENTTSSYDKEKLQQRIAKLSGGVAVIKIGAATEVEMKEKKDRVDDALHATRAAVEEGIVAGGGVALTKIASELADLKGDNDDQNVGIRVALRAMEEPLRQIAINAGDEGSVVANAVKAGDAHYGYNAATGEYGNMIEMGILDPAKVTRSALQYAASVAGLMITTEAMITDHVADTSSEI

SEQ ID NO: 3997 - protein, 100 aa, Cryptococcus neoformans
MPVRGSDIVLILVAIIFPPAAAAIITGCSCDLLINILLTILGYLPGHIHAFWLIYKRIKAEEAYGNGGYTYLGNGNFVGNAPGGVAPGAPAQQPYYGSTR

SEQ ID NO: 3998 - protein, 244 aa, Eucalyptus globulus
MGRGRLQLKRIENKINRQITFSKRRAGLLKKAHEISVLCDAEVALIVFSAKGKLFEYSTDSCMERILERYERYSYAEHQVLASETESIGSWTLEHAKLKARLEVLHRNYRHFMGEDLDSLSLKDLQNLEQQLESALKHIRSRKNQLMHESISVLQKKDRALQEQNNLLTKKIKEKERALAQQAQWEQQDHALDSPVVLPHYLPSLDINGSYQARHNGHDDGENLTQPRAGTLLPPWISASQLRL

SEQ ID NO: 3999 - protein, 634 aa, Lactobacillus plantarum
MVKQTTEMNDASYLFNTGAGFNSQDYLGCHLAASGRAVFRVWAPHAKAVGVVGDFNDWQPSALKLLGATGIWQGQVPNVHAGQLYKFQITTPTGQVQLKIDPFAQQFERKPGDAAVVVEPMTMRWHDSLWLARRKKSRAANRPINIYEVHLGSWRRHLDGSYYTYAELAAELIPYVKQRGYTHIELMPVMEHLLDASWGYQQLGYFAPTSRFGKRDSFLSFVDQCHQANIGVFVDWVPGHFIRNYDALYQYDGTPTFEYADPERANNRRWGAWNFDLGKTQVQSFLISSAEYWLDQCHLDGLRVDAVSNMLYCDYDEGREGQVNQYGDNRNLEGIAFLQKLNTTVLTHHPDILMIAEESSAYPQVTGSVANGGLGFNYKWNMGWMHDTLDFFMMDPLYRHDHFNLLTFAFVYMFDERFILPFSHDEVVHGKKSLMHKMSGDRYNQFANLRTMLTYMAAFPGKQLNFMGSEWGQFLEWRDWSALEWVDLKDDLNHRMQQFTTQLNAVYRHNRPLWEQDHDPAGIIYTHTDDPDSSTMGFIRQAKRKYSFVVAAFNFVPVERQDYRIGVPYRGRYELLLNTEAQAFGGTWTKLETTFTAVDKPYRGQPASFTVTLPAMGALLIRPVKVIGGVKHAR

SEQ ID NO: 4000 - protein, 520 aa, Zea mays
MGNSLGCSASGERLVSAARDGDAIEARMLLELSPALARYSTFGGLNTPLHFAAAKGHLDIVTMLLEKGADVNARNYCGQTALMHACRHGHWEVVQMLLLFRCNVTRADYLSGRTALHFAAHDGFVRCIRLLVADFVPSVALEDIASSVVDGGDCQTNSGSSPNSSSGQKFNESARVRYINKPADGGVTALHMAALNGHLDCMQLLIDLGANVSAVSFPYGTTANLIGAGSTPLHYAAGGGKQECCELLISKGASRLTLNCNGWLPVDVARIFGRRSLEPLLSPNSHSNVPVFQPSSYLALPLMSILNIAREFGLQHTTPSIDDNDLCSVCLERSCSVAAEGCSHEFCIKCALYLCSTSNIRVEFTGPPGSIPCPLCRNGIMSFTKLPSTPTEGLKSGSALTFCNPCILNTRSMDSPATFSKAEIRRNRVAAVSSELVCPITCSPFPSSALPTCRCSDDDPCGDTDVQDGPEFQSPRPSHSASMELDKMGEGDLDRASCSGMFWSRRSCHREQQCDAEINA

SEQ ID NO: 4001 - protein, 493 aa, Burkholderia pseudomallei
MRSIAARSSHAGAGLEQEGVMDLEEGVRQLYPYAAEFGALHEFPERGMPRERLLEELRSMAVREDRKWESGRCSGTMYCGDHEHYAFLNEAYGLFSHVNALQRDLCPSMNRMESEIVAMTVALLHGEAVQRHDGAHRACGALSLGGTESILNATLAYREKARAERGIERPRMIWPASAHPAFRKAAHLFGFDVTVAPIDPVTMQVDADFVRDAVDANTVMLVGSACNYPYGTIDPIGALSAIAVEKDVWLHVDGCLGGWMLPWGEALGYPDIPAFDFRLPGVTSISADTHKFGYGPKGGSVLAWRDASFRRHQYFLMTDWVGGVYGSPGLTGSRSGGLIAATWAALRSLGREGYLARAKAIFETAFDMQAAVRAIPELRVLGKPTFCFAFTSDAFDIYHVNDFMRQRGWRFNGLQHPDALHMCVTGPQTQPGVAERFRQDLGEAVEHARHRAHARPQSSGVYGGDAAGLDLRDDARARAFFTQVLDLFTDCPL

SEQ ID NO: 4002 - protein, 467 aa, Listeria monocytogenes
MLYSEDDKRKQESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKDMSYLGTSTVGSSEACMLGGLAMKFRWRNNAEKRGLDIQAKRPNLIISSGYQVCWEKFCVYWDVDMRVVPMDKNHLSLDVDKVFDLVDEYTIGVVGILGITYTGKFDDIQLLDEKVEAYNETNEHQLVIHIDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTAIYLAKTVEKSGYFEIINDGANLPIVCYKMKEGLDVEWTLYDLADQLLMKGWQVPAYPLPADLSDTIIQRFVCRADLGYNVAEEFAADFADAIHNLEHARVLYHDKERNDSYGFTH

SEQ ID NO: 4003 - protein, 377 aa, Maihuenia patagonica
TDVPVVAAGAFKSYKLAAKAISRLQSLPSRNMSLLCDVLVKEVSELTGYDRVMVYKFHEDEHGEVISEYRRPDLEPYLGLHYPATDIPQASRFLFLKNRVRMICDCLATPVKVIQGKKWAQPLGLGGSILRAPHGCHALYMANMGSIASLVMAVTINEDEDEVKSDPSTGKRLWGLVVCHHTSSRFIPFPLRYACELLVQVFGIQINKEVELAAQIRESHILRIQTVLCDMLLRDSPVAIVTQSPNVMDLVKCDGAALYYKGQVWLLGITPTEEQIKNITQWLLEYHGSTKGLSTDSLMEAGYPGASELGDAVCGIAAVRISSKDVLFWFRSHTAKEIKWGGAKHDPVDGDDRRKMHPRSSFKAFLEVVKWRSQPWE

SEQ ID NO: 4004 - protein, 125 aa, Brassica napus
  misc_feature (12)..(12): Xaa can be any naturally occurring amino acid
ADGQRCDQMFFXELMKEASDIARCFKSRVRHLLHLHVATGMQRYMMRLRRCFTDEKQALIHEGHILIQYITMNAIAIRKILKKYDKVHGSENGKNFKLKMRAERIELLHSPWLIELGAFYLNSGL

SEQ ID NO: 4005 - protein, 377 aa, Austrocylindropuntia subulata
TDVPAAAAGAFKSYKLAAKAISRLQSLPSRNMSLLCDVLVKEVSELTGYDRVMVYKFHEDEHGEVISEYRTPFLESYLGLHYPATDIPQASRFLFLKNRVRMICDCLAAPVKVIQDKKLAQPLSLGGSILRAPHGCHAQYMENMGSIASLVMAVMINEDEDEVKSDPSTGKRLWGLVVCHHTSSRFIPFPLRYACELLVQVFGIQINKEVELAAQIRESHILRIQTVLCDMLLRDSPVAIVTQSPNVMDLVKCDGVALYYKGQVWLLGITPTEEQIKNITQWLLEYHGTTKGLSTDSLMEAGYPGASELGDAVCGMAAVRISSIDVLFWFRSHSAREIKWGGAKHDPVDSDDRRKLHPRSSFKAFLEVVKWRSQPWE

SEQ ID NO: 4006 - protein, 416 aa, Burkholderia fungorum
MPAVKPILKSNKLLNVCYDIRGPVLEHAKRLEEEGHRIIKLNIGNLAPFGFDAPDEIIQDMILNLPGSSGYSDSKGVFAARKAIMHYTQQKGVHGVELDDIYIGNGASELIVMALQGLLNDGDEVLLPAPDYPLWTAGVSLSGGTPVHYICDESNSWMPDLDDIRAKITPNTRALVVINPNNPTGALYSDELLLGLIEIARQHGLVIFADEVYDKIVYDGKKHTSMAALSEDVLTVTFNSLSKSYRSCGYRAGWMFISGLTAGENRRHAKDYFEGLGILASMRLCPNVPGQYAIQTALGGYQSINDLIVPSGRLYKQRELAYDMLTAIPGVSCVKPEAALYMFPRLDPKIYPIQDDQQFILDLLLEERVLLVQGTGFNWPTPDHFRVVFLPNVDDLADSINRIARFLDGYRKRHTA

SEQ ID NO: 4007 - protein, 319 aa, Paracoccidioides brasiliensis
MATDPSKYKFNHTMIRVKDPKRSVEFYNFLGLSQINRLDFPENKFSLYFLAYDGPQALSGSRHWTDRNGIIELTHNYGTENDPSYTVSTGNVEPHRGFGHLAISVDNVELACKRLEDANYSFQKKFAEGRMRNIAFVKDPDGYWVEIIRKHQTDAAVAQTNPSTYRMNHTMVRVKDPEASLKFYQEVFGMTLLRTLELAGADCNLYFLAYPSSNPSLKEGDANPVAEWEGLLELTWNHGTEKQEGKVYHDGNSEPQGFGHICVSVDDLDAACARFEAQNVTWKERLTDGRMKNVAVILDPDGYWIEIIQNESFKNRSHW

SEQ ID NO: 4008 - protein, 375 aa, Pereskiopsis porteri
TDVPAAAAGAFKSYKLAAKAISRLRSLPSRNMSLLCDVLVKEVSELTGYDRVMVYKFHEDEHGEVISEYRTPDLEPYLGLHYPATDIPQASRFLFLKNRVRMICDCLAAPVKVIQDKKLAQPLSLGGSILRAPHGCHAQYMANMGTIASLVMAVTINEDEVKSDPSTGKRLWGLVVCHHTSSKFIPFPLQYACELLVQVFGIQINKEVELAAQIRESHILRIQTVLCDMLLRDSPVAIVTQSPNVMDLVKCDGAALYYKGQVWLLGITPTDEQIKNITQWLLEYHGSTKGLSTDSLMEAGYPGASELGDAVCGMAAVRISSKDVLFWFRSHSAREIKWGGAKHDPVDSDDRSKMHPRSSFKAFLEVVKWRSQPWE

SEQ ID NO: 4009 - protein, 728 aa, Salmonella enterica
MSSRIDRDVINALIAGHFADPFSVLGMHQTQAGLEVRALLPDATDVWVIEPKTGRKVGKLECLDARGFFCGVLPRRKNFFRYQLAVTWHGQQNLIDDPYRFGPLMQEMDAWLLSEGTHLRPYETLGAHADTMDGVTGTRFSVWAPNARRVSVVGQFNYWDGRRHPMRLRKESGIWELFIPGAHNGQLYKFELLDANGNLRIKADPYAFEAQMRPETASMICGLPEKVTPSEERQKANQFDAPISIYEVHLGSWRRHTDNNFWLSYRELADQLVPYAKWMGFTHLELLPVNEHPFDGSWGYQPTGLYAPTRRFGTLDDFRYFINAAHAAGLNVILDWVPGHFPSDEFSLAEFDGTHLYEHSDPREGYHQDWNTLIYNYGRREVSNYLVGNALYWMERFGIDALRVDAVASMIYRDYSRKEGEWIPNEFGGRENLEAIEFLRNTNRIIGEQVPGAVSMAEESTDFSGVTRPPETGGLGFWYKWNLGWMHDTLDYMKLDPVYRQYHHDKLTFGMLYNHTENFVLPLSHDEVVHGKKSILDRMPGDAWQKFANLRAYYGWMWAFPGKKLLFMGNEFAQGREWNHDASLDWHLLEGGDNWHHGVQRLVRDLNHTYRHHKALHELDFDAYGFEWLVVDDNERSVLIFVRRDKAGNEIIVASNFTPVPRHDYRFGINQPGRWREILNTDSMHYHGSNTGNGGVVHSDEIESHGRQHSLNLTLPPLATIWLMREGE

SEQ ID NO: 4010 - protein, 682 aa, Shewanella oneidensis
MMRKLILATSIATVFVGFSAWAVPPTIQISELPTLKQEAQHKVASKRVTDLYTRSHYHRFALDDAFSAQIFDRYLQQLDYRRNVLTQADVDSFKPYINQFDDMLSSGELDPAYKMFDLVQKRRYEGFVYALSLLDKEMDFTAPGDVYDYDREDVAWPKDQAEINELWRQRVKYDALNLKLTGKKWLEIVDILQKRYNNAIKRLTQTNSEDVFQAVMNAFSRSIEPHTSYLSPRNAERFQMEMNLSLEGIGAQLQLEDDYTVIKSLIAGGPAAGSEKLSPEDKIVGVGQEGGEIVDVIGWRLDDVVELIKGPKGSKVVLQILPKKGGSNAKPFNVTLVRDKIRLEDRAATSKIIEPKDGVYANRKVGVIQIPGFYMNLSQDVEKELLKLNEAKVEGVVIDLRGNGGGALTEAVLLTGLFIDMGPVVQVRDADGRVSAHRDNDGKTTYTGPLTVMVDRYSASASEIFAAALQDYDRALIVGESSFGKGTVQQHKSLGRIYDMYEKPIGHVQYTIQKFYRINGGSTQLKGVTPNIAYPSALEPGEYGEAEEKNALPWDKVPMAQYGTLNDITPELVASLEKKHLARIQNSVEFNYINQDIADFKKHHKEKTVSLVESERIASREADEKKVLDRTNERRVANGLAPVKSMEDIKDDVVAPDAFLDETAYITLDMVDAKKLANAGTK

SEQ ID NO: 4011 - protein, 841 aa, Glycine max
RNNKVRMIVDCHAKHVRVLQDEKLPFDLTLCGSTLRAPHSCHAQYMANMDSIASLVMAVVVNDNEEDGDTDAIQPQKRKRLWGLVVCHNTTPRFVPFPLRYACEFLAQVFAIHVNKEIELEYQIIEKNILRTQTLLCDLVMRDAPLGIVSESPNIMDLVKCDGAALIYKNKVWRLGVTPSESQIREIAFWLSEYHMDSTGFSTDSLSDAGFPSALSLGDVVCGMAAVRVTAKDVVFWFRSHTAAEIRWGGAKHEAGEKDDGRRMHPRSSFKVFLDVVKARSLPWKEYEIDAMHSLQLILRNAFKDTESMDLNTKAINTRLSDLKIEGMQELEAVTSEIVRLIETATVPILAVDVDGLVNGWNIKIAELTGLPVGEAMGKHLLTLVEDSSTDRVKKMLNLALLGEEEKNVQFEIKTHGSKMDSGPISLVVNACASRDLRDNVVGVCFVAHDITAQKNVMDKFTRIEGDYKAIVQNRNPLIPPIFGTDEFGWCCEWNPAMTKLTGWKREEVMDKMLLGELFGTHMAACRLKNQEAFVNLGVVLNKAMTGLETEKVPFGFFARNGKYVECLLSVSKKLDVEGLVTGVFCFLQLASPELQQALHIQRLSEQTALKRLNALSYMKRQIRNPLCGIIFSRKMLEGTALGTEQKQLLRTSAQCQQQLSKILDDSDLDSIIDGYLDLEMAEFTLHEVLVTSLSQVMTKSNGKSIRIVNDVAEQIVMETLYGDSLRLQQVLADFLLISINFTPNGGQVVVAGTLTKEQLGKSVHLVKLELSITHGGSGVPEALLNQMFGNNGLESEEGISLLISRKLLKLMNGDVRYLREAGKSAFILSAELAAAHNLKG

SEQ ID NO: 4012 - protein, 221 aa, Griffithsia japonica
ARGSLGSIFSVYYRKSAPGKEGDTSDLLQRPGFEQVAAGYCVYGSTTYLTFSMGYGVHVFILDTLSGHFVLAKQHVQTPKAGPIYSVDTSVLPNVVDGVRKYVDLLEAEGSGKKFRHLNNLVANFHNVLTKGGILMLPGPQKQDLAKFLTEAAPLAFVARQAGARASVGKRNLLELSAWSLEMSVPLFVGSTADVDRLEEMVLGHAVEEKNSVDPSTMHKI

SEQ ID NO: 4013 - protein, 785 aa, Ralstonia solanacearum
MKIVCIGGGPAGLYFALLMKRRDPSHDITVVERNRPYDTFGWGVVFSDQTLGHLQRADPESAAQILDAFNHWDDIEVHIRGQVVRSGGHGFCGIGRKRLLNILQARCEAVGVKLVFETDVQDDGAYADADLIIASDGLNSRIRAKYAATYQPDIDTRRCRFVWLGTHKLFEAFTFAFEQTEHGWFQAHAYRFDADTSTFIVETPEEVWRKAGLETMEKDEAIAFCERLFAKYLDGHKLMSNAAHLRGSAQWIRFPRVVCRRWVHDSGRAPVVLMGDAAHTAHFSIGSGTKLALEDAIELARCIGEQPADLRAALEHYEAVRSVEVLRIQNAARNSTEWFENVARYATLPTEQFAYSLLTRSQRISHENLRQRDRAYLESFEDWIAGQAGAPRAPDRAPVPPMFTPFTVRGLTLKNRVVVSPMAQYSCRDGLPADYHLVHLGARAMGGAGLVMAEMTCVSPDARITPGCPGLWNAEQRDGWARIVRFVHDHSEARLGIQLGHAGAKGSTRVAWEGIDLPLPDGNWPLISASPQQYLDGVSQWSRAMTRDDMDRVRDDFVRAARLAVEAGFDWLELHCAHGYLLSSFISPLTNLRSDAYGGALENRLRYPLEVFRAVRAVWPAERPMSVRISAHDWVQGGITPDDAVEIARLFKAAGADMIDCSSGQVSKKEQPVYGRMYQTPFADRVRNEAGIATIAVGAISEADHVNSIIAAGRADLCAVARPHLANPAWTLNEAARIGYLDMPWPRQYRAGKLQLERNLERERALAAQAAGLSPLEQANRMQGV

SEQ ID NO: 4014 - protein, 90 aa, Ricinus communis
RESFPVPSAICSGKREKCVIEKENNFKQPGERYRSWPPDRQERSLNRLVGGFSEPRITQELRTIWISYWIQCDKSLGQKLATRLNVKPSI

SEQ ID NO: 4015 - protein, 507 aa, Burkholderia pseudomallei
MRVACFVDFMQPHPGNIRTHIGVPTDVGTAKENVMDLEEGIRRLYPYAEEFGVMRGFPEQGTPRDELLAQLRSMAEREDRNWESGHSSGAMYSGDRDHHAWLNEAYSVFSHVNALRRDMCPSMNRMESEIVGMTVAMLHGDAVAAHHPGQRACGMITLGGTESILGATLAYREKARAERGIERPRMIWPASAHPVFRKAAHLFGFDVTVAPIDPVTMQVDADFVRDAVDANTVMLVGSACNYPYGTIDPIGALSAIAVEKDVWLHVDGCLGGWMLPWGEALGYPDIPAFDFRLPGVTSISADTHKFGYGPKGGSVLAWRDASFRRHQYFLMTDWVGGVYGSPGLTGSRSGGLIAATWAALRGLGREGYLARAKAIFETAFDMQAAVRAIPELRVLGKPTFCFAFTSDAFDIYHVNDFMRQRGWRLNGLRRPDALQMCVTGPQTQPGVAEQFRCDLGAAADYARAHAQERPKTSGVYASDAAGVDLSDDARTRAFFTQVIDLFTDCPL

SEQ ID NO: 4016 - protein, 284 aa, Glycine max
MKGEYLEQQQQHPKSETTPPSMFSKLQPQHHPFPHHPFQLSAEEENRVGAATTPSTVQKANSSGGDGATIEVVRRPRGRPPGSKNKPKPPVIITRDPEPAMSPYILEVSGGNDVVEAIAQFSRRKNMGICVLTGSGTVANVTLRQPSTTPGSTVTFHGRFDILSVSATFLPQQSGASPAVPNGFAISLAGPQGQIVGGLVAGGLMAAGTVFVIAASFNNPAYHRLPPEEEGASAGDGHSPQVSGGGDSGHGQAESCGMSMYSCHLPSDVIWAPTARPQPPPPPY

SEQ ID NO: 4017 - protein, 377 aa, Xanthomonas campestris
MCAQLRDSFATPSEPHPCVRRSSGLVHLFAGSVRTGSRLLYGESRVPSTGLDPHAAAPQPATAPPRGGLAARVGSLRRWVDSQTDEPLDEARADRIDWLRAVPFIALHLACLAVFWVGASWFAVGMAVALYALRMFALTGFYHRYFSHRAFKTSRVLQFVFAAIGATCVQRGPLWWAAHHRNHHRHTDTGRDPHSPAQHGFWWSHTGWFLTPRNFRTDWEVIPDLRRFAELRFLDRFDIVMPVLLALGLYLLGDWLAVAAPALKTSGAQLLVWGFVISTVALFHATFTINSLAHRFGSRRFDTRDDSRNNWLLALLTFGEGWHNNHHFFPGSARQGLRWWEYDMTWYGLTAMSWVGLVWDLKPMPKLLTQRAERVKR

SEQ ID NO: 4018 - protein, 377 aa, Grahamia bracteata
TDVPVAAAGAFKSYKLAAKAISRLQSLPSRNMLLLCDVLVKEVGELTGYDRVMVYKFHEDEHGEVISEYRRPNLEPYLGLHYPATDIPQASRFLFLKNRVRMICDCLATPVKVIQDKKLTQALSLGGSILRAPHGCHAQYMANMGSIASLVMAVTINEDEDEVKSDPSSGKRLWGLVVCHHASSRFISFPLRYACELLVQVFGIQINKEVELAAQIRESHILRIQTVLCDMLLRDSPVAIVTQSPNVMDLVKCDGAALYYKGQVWLLGSTPTQEQIKNITQWLLEYHGSTKGLSTDSLMEAGYPRASELGDPVCGMAAVRISSKDFLFWFRSHTAKEVKWGGAKHDPIDNDDERKMHPRSSFKAFLEVVKWRSQPWE

SEQ ID NO: 4019 - protein, 377 aa, Maihuenia poeppigii
TDVPVAAAGAFKSYKLAAKAISRLQSLPSRNMSLLCDVLVKEVRELTGYDRVMVYKFHEDEHGEVISEYRRPDLEPYLGLHYPATDIPQASRFLFLKNRVRMICDCLATPVKVIQGKKWAQPLSLGGSILRAPHGCHALYMANMGSIASLVMAVTINEDEDEVKSDPSTGKRLWGLVVCHHTSSRFIPFPLRYACELLVQVFGIQINKEVELAAQIRESHILRIQTVLCDMLLRDSPVAIVTQSPNVMDLVKCDGAALYYKGQVWLLGITPTEEQIKNITQWLLEYHGSTKGLSTDSLMEAGYPGASELGDAVCGIAAVRISSKDVLFWFRSHTAKEIKWAGAKHDPVDGDDRRKMHPRSSFKAFLEVVKWRSQPWE

SEQ ID NO: 4020 - protein, 373 aa, Triticum aestivum
MASSAGDMPEVKFKRTGSLGSSDYVRADKIDLTSLDIQLEQQLNKKWGKTNIKSQGPRARWEIDLAKLEIRHVIAQGTYGTVYRGTYDGQQVAVKLLDWGEDGFATEAETTALRTSFKQEVAVWHKLSHPNVTRFIGASMGTTDLKIPVNDNGARANLPARACCVVVEYLAGGTLKQYLIKNRRRKLAYKVVVQLALDLSRGLSYLHSRKIVHRDVKTENMLLDTQRNLKIADFGVARVEAQNPKDMTGATGTLGYMAPEVLDGKPYNRKCDVYSFGICLWEIYCCDMPYPDLSFADVSSAVVHQNLRPDIPRCCPSAFANIMRKCWDGNPDKRPDMDEVVQLMEALDTSKGGGMIPDGQSSGCLCFTRARGP

SEQ ID NO: 4021 - protein, 479 aa, Arabidopsis lyrata
KGEEFTCEENEPFTCDQTKLFNSGSFEKDFIFGVSSSAYQVEGGRGRGLNVWDGFTHRFPEKGGPDLGNGDTTCDSYTNWHKDIDVIDELNATGYRFSFAWSRILPKGKRSRGVNEGGIDYYNRLIDNMIARNITPFVTLFHWDLPQTLQDEYNGFLNRTIIDDFKDYADLCFEKFGDRVKNWITINQLYTVPTRGYAIGTDAPGRCSPKIDKRCPGGNSSTEPYLVAHNQLLAHAAAVDVYKTKYKDQGGKIGPVMITRWFLPFDDTPESKAATERAKEFFHGWFMGPLTEGKYPDIMRKLVGKRLPEFTETETALVKGSYDFLGLNYYVTQYAQNNDAIVPPDVHTAMMDSRATLTSRNATGHAPGPPFAKDSYYYPKGIYYVMEYYKNKYGDPLIYITENGISTPGDESFDEALADYKRIDYLCSHLCFLSKVIKEKAVNVKGYFAWALGDNYEFGNGFTVRFGLSYIDFANVTGD

SEQ ID NO: 4022 - protein, 274 aa, Lactobacillus johnsonii
MEYFNLNDGNRIPKIGFGTYKLNGSRGVFAIQAALKNGYRLLDSAVNYENEGAVGRAIKNSGINRDDIFITSKLPGRHHKYQEAIEQIQESLYAANLDYYDLYLIHWPNPKENHYLEAWQAMLDAQRFGLIRSVGVSNFEPSHIEHLYRETGVMPAINQVELHPYWSSKTIREYDNKHNIITEAWSPLQRAGEAFQEKEIIDLAQKYHKSPAQIILRWETQLNVVPIPKASSYEHQISNLDIFDFKLTPEEVQKLINLDKISARRFDPNEHEEF

SEQ ID NO: 4023 - protein, 546 aa, Burkholderia cepacia
MAAKDVVFGDSARSKMVEGVNILANAVKVTLGPKGRNVVLERSFGGPTVTKDGVSVAKEIELKDKLQNMGAQMVKEVASKTSDNAGDGTTTATVLAQSIVREGMKYVASGMNPMDLKRGIDKAVAAAVEELKKISKPCTTNKEIAQVGSISANSDSSIGDRIAEAMDKVGKEGVITVEDGKSLADELDVVEGMQFDRGYLSPYFINNPDKQVAVLDNPFVLLHDKKVSNIRDLLPVLEQVAKAGRPLLIIAEDVEGEALATLVVNNIRGILKTVAVKAPGFGDRRKAMLEDIAILTGGQVIAEETGLTLEKATLAELGQAKRIEVGKENTTIIDGAGEAASIEARVKQVRAQIEEATSDYDREKLQERVAKLAGGVAVIKVGAATEVEMKEKKARVEDALHATRAAVEEGIVAGGGVALIRARTAIAGLTGANADQNAGIKIVLRAMEEPLRQIVTNGGEEASVVVAAVAAGKGNYGYNAATGEYVDMVEAGVVDPTKVTRTALQNAASVAGLLLTTDAAVAELPKEDAPMPGGMPGGMGGMGMDM

SEQ ID NO: 4024 - protein, 494 aa, Arabidopsis thaliana
MVLTKTATNDESVCTMFGSRYVRTTLPKYEIGENSIPKDAAYQIIKDELMLDGNPRLNLASFVTTWMEPECDKLIMDSINKNYVDMDEYPVTTELQNRCVNIIARLFNAPLEESETAVGVGTVGSSEAIMLAGLAFKRKWQNKRKAEGKPYDKPNIVTGANVQVCWEKFARYFEVELKEVNLSEGYYVMDPDKAAEMVDENTICVAAILGSTLNGEFEDVKRLNDLLVKKNEETGWNTPIHVDAASGGFIAPFIYPELEWDFRLPLVKSINVSGHKYGLVYAGIGWVVWRAAEDLPEELIFHINYLGADQPTFTLNFSKGSSQIIAQYYQLIRLGFEGYKNVMENCIENMVVLKEGIEKTERFNIVSKDQGVPVVAFSLKDHSFHNEFEISEMLRRFGWIVPAYTMPADVQHITVLRVVIREDFSRTLAERLVADISKVLHELDTLPSKISKKMGIEGIAENVKEKKMEKEILMEVIVGWRKFVKERKKMNGVC

SEQ ID NO: 4025 - protein, 446 aa, Lupinus albus
MGIEIEKCCVELSKVANSETHGEDSPYFAGWKAYDEDPYHEHTNPSGVIQMGLAENQVSFDLLEKYLEEHSETVKWGKRGRGFRENALFQDYHGLESFRKAMGSFMEQIREGRVKFDPSRIVLTAGATAANELLTFILANPGDALLVPTPYYPGFDRDLRWRTGVNIVPIHCDSSNNFQITPQALEAAYKEAEAMNIKVKGVLITNPSNPLGATIQRKVLEEILDFVTLKNIHLVSDEIYSGSVFSSSEFISIAEILEARNYKNAERVHIVYSLSKDLGLPGFRVGTIYSYNDKVVTTARRMSSFTLISSQTQHLLASMLSDKKFTENYIKTNRERLRKRYTMIIEGLRNAGIECLEGNAGLFCWMNLSPLLVLENKATREGELELWNETLHEMKLNISPGSSCHCSEPGWFRVCFANMSEETLELALKRIHHFMEKRRTRTEKLY

SEQ ID NO: 4026 - protein, 487 aa, Lupinus albus
MDLGSKTNQLLSKIATNDKHGENSPYFDGWKAYDNNPFHPSKNPNGVIQMGLAENQLCFDLIEEWIKNNPKASICTLEGVHKFRDIANFQDYHGLPEFRNALANFMSKVRGGNVRFDPNRIVMSGGATGANEVIMFCLADPGDAFLVPTPYYPAFLRDLCWRTGLQLIPVECDSSNNFKITREALEKAYNKAKEDNINVKGLIITNPSNPLGTTLDRETLKSLITFINENNIHLVCDEIYAATVFSSPSYVSVSELIQEMDQPCKKDLIHIIYSLSKDMGFPGFRVGIVYSFNDEVVNCGRKMSSFGLVSSQTQHMLASMLSDDSFVDKFLAESKKRLAKRHNIFSKVLEEVNITKFPSNAGLFCWMNLKSLLKEQTFEAEMMLWHMIINEVKLNVSPGSSFNCSEPGWFRVCFANMDDETVEVALTRIRTFIGKETKKPEMQVKSWQRNLQLSFSSIRRFVHETIMSPHMMSPHSPIPQSPLVKAT

SEQ ID NO: 4027 - protein, 738 aa, Burkholderia pseudomallei
MTDAPFDRADIDALLGARHPDPFACLGPHRVGDATVVRTLLPGALRVRAIAAGGGVLGELRQVDPAGCFAGALPDGQERGERPRYRLSIDWPDARQDVEDAYAFGTLLDEDALARFAAGDPRAALACLGARALDMDGVPGVRFAVWAPGASRVSVVGDFNGWDARRHPMRLRRPWGVWELFVPRIGAGERYKFALRARDGAALPLKADPCACRTEAPPRTASIVADLDALERFGWHDDAWLRARASLDLAHAPVSIYEVHPESWLRVAAEGNRSATWDELAQRLIPYAAGMGFSHVELTPIAEYPFGGSWGYQSLSPFAPSARFGPPEGFARFVEHAHAAGLGVIVDWVPAHFPDDPHGLGKFDGTALFEHADPREGWHPDWHTHVFNVGRREVGAFLIASALAWAHRYHVDGIRVDAVASMLYRDYSRAAGEWVPNVYGGRENLESIAFLKHFNDTLHGPAAPPGVATFAEESTAWPGVTAPTAEHGLGFDFKWNMGWMHDTLAYLREDPIHRRHHHDRLTFGLVYAFSERFVLPLSHDEVVHGKGSLAAKMPGDAWQRLANLRAYFGFMWAHPGKKLLFMGGEFAQWGEFAHDATPQWDLLDAPAHRGVQRLVRDLNRLHAAEPALHALDDRPAGFAWLVGDDRNNSVFAFVRRDDAGRMLVAVCNFTPVPRTDYRLGLPAPGRWAEVLNTDGAAYGGTDAGNGGAVQADEIPAHGERWSAALRLPPLATLWLRPA

SEQ ID NO: 4028 - protein, 440 aa, Zea mays
MATHAGENGSGHENGGGHAEWRFARAAKEGALAVAGDKMSIRAVRFKISASLDARDPRPVLPLAHGDPSAFPAFRTAAEAEDAVAAALRTGKFNCYPAGVGLPEARRALAEHLSSDLPYKLSSDDIFVTAGGTQAIEVVVSVLAQPGTNILLPRPGYPNYEARAGLHNLEVRRFNLIPERGWEIDIDGLESIADKNTTAMVIINPNNPCGSVYTREHLAKVAEVARKLGILVIADEVYGNLVFGDTPFVPMGVYGHIAPVLTIGSLSKRWIVPGWRLGWVAVCDPNKVLQETKIIASITNFLNVSTDPATFVQGALPHILKNTKEDFFKRIIGLLAETSEICFSGIKDIKCITCPHKPEGSMFVMVKLNLYLLESIHDDIDFCCKLAKEESVILCPGSVLGMENWIRITFAIDSSSLLDGLERLKSFCQRHKKKNLLNGH

SEQ ID NO: 4029 - protein, 555 aa, Unknown
  secondary endosymbiont of Bemisia tabaci
MAAKDLKFGNDARKKMLKGVNILANAVKVTLGPKGRNVVLDKSYGAPSITKDGVSVAREIELEDKFENMGAQMVKEVASKANDAAGDGTTTATVLAQSIVTEGLKAVAAGMNPMDLKRGIDKAVEAAVEELKIISKPCKDSKEIAQVGTISANADAKVGKLISDAMKRVTNEGVITVEEASGLEDDLIVVEGMQFDRGYLSPYFINKQESSSIEFDNPYILLVDKKISNIRDMLSILEVVAKEGKPLLIIAEDVEGEALATLVVNTMRGIVKVSAVKAPGFGDRRKEMLQDIAVLTHGHVISEETGDSLEKATKENLGNAKRVVITKDATTIIDGAGEKSKIEARIQNIKKQIENATSDYDKEKLQERVAKLSGGVAVIKVGAPTEIAMKEKKARVEDALQATRAAVEEGVVPGGGVALIRVASKIANSSLKGDNEDQNVGIRVALRAMESPLRQIVVNAGEEASVIANKIKENKGNDNYGYNAQTEAYGDMIEMGILDPTKVTRSALQYAASIAGLMITTECMVTDLPKEEKASDMGAGGMGGIGGMGGMNGMM

SEQ ID NO: 4030 - protein, 634 aa, Burkholderia pseudomallei
MNDSTATHAYALPFGATCVDARHTRFHLWAPACRSAAVERQDGETVAMTPDGGGGFDAIVRCGPGTLYCYLLDGTLRVPDPASRFQPHGVHGPSEVVDPAAYRWRHDDWRGRPWRETVLYEVHVGAFGGYARIARRLPALAALGITAIELMPVNAFPGARNWGYDGVLPFAPDASYGPPDALKSLVDAAHGLGLQVLLDVVYNHFGPDGNLLPRYAPAFFRRDRDTAWGPAIDFSCPQAGAFFLENALYWLDEYRFDGLRIDAAHAIDDDAWLAGLARRVRAYAGDARHVHLVLENERNTASLLAGGRFDAQWNDDFHNSMHVLLTGEQAGYYRAYADAPIRHLARVLGEGFAYQGEPSPLHGGAPRGEPSADLPPSAFVAFLQNHDQIGNRAFGERLRALVNDDALRAASALALLAPQIPLLFMGEECGTTQPFQFFTDHRGALAAAVREGRRREFAAFPAFADPAHRDAIPDPNDPATFARSSLAAPGAEPPDANAWRRFYRGALAVRARFVTPWLDGARALGATVLARADGGHANALVARWRLGDGNTLAIALNLDARPAALAAPPDGKIVFETPPRARDALADARLAAHACIAWRSGNVNGVARRGRAVDAKHMPAVKHANGVNGQDGAP

SEQ ID NO: 4031 - protein, 216 aa, Triticum aestivum
  misc_feature (86)..(86): Xaa can be any naturally occurring amino acid
ALLMKQLVDLRLYQQSSNLEVQSLIQRLQVMEQNQKQMMALLAIVVQNPSLLNQLVQQQQQQRRNNCVYEDGNKKRRFPALEQGPXVTDHETSGSGAEIIQYRPPVPETSSQVIADEAFLSATAQPISSAALNMPMDIDTQTTLGNLNTQGSSGDIFADMPALPDFEDMHLWFSEDGEPTLTIQDYDEFPQSGQDCQMEAQHNYNNPQHADAITEA

SEQ ID NO: 4032 - protein, 540 aa, Streptococcus agalactiae
MAKDIKFSADARSAMVRGVDILADTVKVTLGPKGRNVVLEKAFGSPLITNDGVTIAKEIELEDHFENMGAKLVSEVASKTNDIAGDGTTTATVLTQAIVREGLKNVTAGANPIGIRRGIETAVSAAVEELKEIAQPVSGKEAIAQVAAVSSRSEKVGEYISEAMERVGNDGVITIEESRGMETELEVVEGMQFDRGYLSQYMVTDNEKMVSELENPYILITDKKISNIQEILPLLEEVLKTNRPLLIIADDVDGEALPTLVLNKIRGTFNVVAVKAPGFGDRRKAMLEDIAILTGGTVVTEDLGLDLKDATMQVLGQSAKVTVDKDSTVIVEGAGDSSAIANRVAIIKSQMEATTSDFDREKLQERLAKLAGGVAVIKVGAATETELKEMKLRIEDALNATRAAVEEGIVSGGGTALVNVIEKVAALKLNGDEETGRNIVLRALEEPVRQIAYNAGYEGSVIIERLKQSEIGTGFNAANGEWVDMVTTGIIDPVKVTRSALQNAASVASLILTTEAVVANKPEPEAPTAPAMDPSMMGGF

SEQ ID NO: 4033 - protein, 436 aa, Zantedeschia aethiopica
VNPSLGHGRTSTGTLKVMAADLDESKQTKTDRWAGLYTDTSDDQQDITRGKGMVDSLFQAPMGDGTHNPVLSSYEYISTGLRSFNLDNTVNGLYIAPAFMDKLVVHITKNFMNLPNIKIPLILGIWGGKGQGKSFQCELVFAKMGINPIMMSAGELESGNAGEPAKLIRQRYREAADIIRKGKMCCLFINDLDAGAGRMGGTTQYTVNNQMVNATLMNIADNPTNVQLPGMYNKQENPRVPIIVTGNDFSTLYAPLIRDGRMEKFYWAPTRDDRVGVCTGIFRSDNVPKEDVIKLVDTFPGQSIDFFGALRARVYDDEVRKWIAEIGVDGVGKRLVNSLEGPPTFAQPKMTLDKLLEYGNMLVQEQENVKRVQLADKYLSEAALGDANQDAIKTGSFYGKAAQQANVPVPEGCTDRNATNFDPTARSDDGSCLYTL

SEQ ID NO: 4034 - protein, 270 aa, Pyrus caucasica
AHYKSEADVGEAFAEAFKTGLIKREELFITTKIWNSDHGHVVEACKNSLEKLQLDYLDLYLVHYPMPTRHNAIGKTASLLGEDKVLDIDVTISLQQTWEGMEKTVTLGLVRSIGLSNYDLFLTRDCLAYSKIKPAVSQFETHPYFQRDSLVKFCIKHGVLPTAHTPLGGAAANKDMFGSVSPLDDPILNDVAKKYGKSVAQICLRWGIQRKTAVIPKSSKIQRLKENLVVLEFQLSDEDMQLIYSIDRKYRTSLPSKTWGLRRVCKGEFV

SEQ ID NO: 4035 - protein, 334 aa, Zantedeschia aethiopica
THNPVLSSYEYISTGLRSFNLDNTVNGLYIAPAFMDKLVVHITKNFMNLPNIKIPLILGIWGGKGQGKSFQCELVFAKMGINPIMMSAGELESGNAGEPAKLIRQRYREAADIIRKGKMCCLFINDLDAGAGRMGGTTQYTVNNQMVNATLMNIADNPTNVQLPGMYNKQENPRVPIIVTGNDFSTLYAPLIRDGRMEKFYWAPTRDDRVGVCTGIFRSDNVPKEDVIKLVDTFPGQSIDFFGALRARVYDDEVRKWIAEIGVDGVGKRLVNSLEGPPTFAQPKMTLDKLLEYGNMLVQEQENVKRVQLADKYLSEAALGDANQDAIKTGSFYG

SEQ ID NO: 4036 - protein, 865 aa, Bdellovibrio bacteriovorus
MMPTEQEQNNQLWRRYKTIFESKLVGILSTDMNGQILDANDCFLEMVGYSREDLNEGRLNWKTLTHPNYLEQSRQVAEILKTKGSVPVFEKEYIHKKGHLVPVRLGLTMFEDGTVITLVQDITRQKDIERKLEEAKSLLEERVAERTRQLVESESFLMAIFENMPTMVFVKDARDLRFVRFNKAGENLLGIPRSQLIGKNDYDLFPKEQADFFTTKDRDVLKESKIVDIPEEQINTARGVRYLHTRKIPVFDKEGRPQYLLGVSEDITELKEAEKQRAVLVKEQIARSSAELRAQQMGFLSDLTFAMTQSFDLDNILKAFTEKSIPTLADICIVDLMDEEGLEISHTQVAAKTDEDRQFIQSWRERFPLRWDAPYGAAEVIRSRKTEIINGVDLDQFLKSTFGPEAAMTQRPIHAEAFMTVPILLRDEKPLGTISLITTSPGRHFSPLDQSMAEEVGRRLAVLIENSRLYYRAQEASRAKTAFLANVSHEIRTPLGAMLGFAEILKEDESLREEQKEAVETVLRNGQQLLHIVDEILDISKVESERIQIESIVFDLPDLLHDVIHLLRGRAEEKGIELRLRLGPLPKKIQSDPTRLRQILINVIGNAIKFTDSGFVEMEARSHNGKRRDGRQRIEFLVTDTGIGISSEQRNNLFQPFSQADSSTTRRFGGTGLGLFLSRKLARLLGGDVILNTSSAGIGSSFLISILGREVTDSQIRDLGKKNDKSAEVSSRQVESILVVDDAMDNRELFRRFIVRAGIPEERIETAENGAEAVRKALDRSYSVILMDIQMPEMDGFQALKKLRTQGYRGPIVALTAHAMKGDREKCLAAGFDGYLQKPLDRVELKRVLNLDFSSQQPGPRDAEL

SEQ ID NO: 4037 - protein, 426 aa, Zantedeschia aethiopica
STGTLKVMAADLDESKQTKTDRWAGLYTDTSDDQQDITRGKGMVDSLFQAPMGDGTHNPVLSSYEYISTGLRSFNLDNTVNGLYIAPAFMDKLVVHITKNFMNLPNIKIPLILGIWGGKGQGKSFQCELVFAKMGINPIMMSAGELESGNAGEPAKLIRQRYREAADIIRKGKMCCLFINDLDAGAGRMGGTTQYTVNNQMVNATLMNIADNPTNVQLPGMYNKQENPRVPIIVTGNDFSTLYAPLIRDGRMEKFYWAPTRDDRVGVCTGIFRSDNVPKEDVIKLVDTFPGQSIDFFGALRARVYDDEVRKWIAEIGVDGVGKRLVNSLEGPPTFAQPKMTLDKLLEYGNMLVQEQENVKRVQLADKYLSEAALGDANQDAIKTGSFYGKAAQQANVPVPEGCTDRNATNFDPTARSDDGSCLYTL

SEQ ID NO: 4038 - protein, 203 aa, Pichia angusta
MNNEYDYLFKLLLIGDSGVGKSCLLLRFAEDTYTQDYISTIGVDFKIRTIELDGKTIKLQIWDTAGQERFRTITSSYYRGAHGIIIVYDVTDQESFNNVNQWLQEIDRYATSGVMKLLVGNKCDLTDKKVVDYAVAKEFADSRGIKFLETSASQSTNVEQAFIVMSKQIKSQMANSQPASNTAGKPSVNLSGTSVINQQGGCC

SEQ ID NO: 4039 - protein, 435 aa, Zantedeschia aethiopica
AVSSVGAVNRVRPSLHGSGSGASVTRSGFLGTSLKTVNPSLGHGRTSTGTLKVMAADLDESKQTKTDRWAGLYTDTSDDQQDITRGKGMVDSLFQAPMGDGTHNPVLSSYEYISTGLRSFNLDNTVNGLYIAPAFMDKLVVHITKNFMNLPNIKIPLILGIWGGKGQGKSFQCELVFAKMGINPIMMSAGELESGNAGEPAKLIRQRYREAADIIRKGKMCCLFINDLDAGAGRMGGTTQYTVNNQMVNATLMNIADNPTNVQLPGMYNKQENPRVPIIVTGNDFSTLYAPLIRDGRMEKFYWAPTRDDRVGVCTGIFRSDNVPKEDVIKLVDTFPGQSIDFFGALRARVYDDEVRKWIAEIGVDGVGKRLVNSLEGPPTFAQPKMTLDKLLEYGNMLVQEQENVKRVQLADKYLSEAALGDANQDAIKTGSFYG

SEQ ID NO: 4040 - protein, 475 aa, Prochloron didemni
MSKLILFWHRRDLRISDNMGLAAARKQSSKIVGLFCLDPNILNSNEVAPARVTYMLGCLQELKESYSKIGSQLLIVRGEPIEAIPQLAVALQVTGVFWHKDGEPYARERDGKVEQELLKQGIAVTNYWDQLLHPPEDILTQSGKPYTVYTPFWKNWSQKPKLEVAEKLDRIQGLTAEEIKIAQETGVVSLPTGKDLGYYWDGELILTPGETAAREQLEEFSERAIAQYQEQRNFPAVEGTSLLSPALRFGVIGIRTVWQATLEATKNSYSEEVRANIETWQKELAWREFYQHALYHFPQLTVEPYRQQFKDFPWDNNPEHFQAWCEGKTGYPMVDAAMRQLNETGWMHNRCRMIVASFLTKDLIINWQWGEQYFMQKLCDGDLASNNGGWQWSASCGMDPKPLRIFNPASQAKKFDPEGEYIRQWLPELSSIDTEYLVRGKIPDDERERCDYPQPIVDHNLRQREFKRRYKELSP

SEQ ID NO: 4041 - protein, 563 aa, Clostridium tetani
MKKLNNKNNIIKFILYLLFITLINSNNVVFANNNNEHDNYHKLDQQFSELLKDNTYKEYNDGLIEQIKYLINNVYYYDVPESISNAKSVEEIMKNIRDPYTQYYTGEEFKKLQEGINNVFSGIGIYYKKHEDGIIITDMVPGSSAEYAGLKIGDIVIQLNREEIKGLSVEKIDKYIKGEEGTKVILDVKRGTQIVTFILQRRAVEIPTVDSKILDENIGYVHIKSFGNKTPELFKKRIENLLNSNIENLVVDLRGNLGGYTSSAYEIAGYFIGNKTVTIMKDKKGNETLYRGSSQELLRDIPIIFITDKNTASASEILTSAVKDYERAFIIGNKTYGKGVQQTSFILTDESFLKLTTHEFFSPFGSKINKIGVKPNFDTKSIDSLKVAELLFSGGKHREYNSQLVKLSIDNREFIIDLKKGKDRNYRSAFKYIIESSDGENIEIGNKDNWVKFDKNKISNDFYFENLKTMDSLTKSSKDTELIVKFNKDIRPRTANELNVKLVEGAFFQEIQLEYTIDKGNEIHIKCKEDLSTDKEYYLLVEGIESIDGMPLKNGSIARVYVY

SEQ ID NO: 4042 - protein, 246 aa, Brassica napus
  misc_feature (224)..(224): Xaa can be any naturally occurring amino acid
VDPRVRTKLSMYISVCPLWILCFIIITLVSSSSSTIWYEDHVSLREINTQENFSFPKDFLFGTASSAYQYEGAYLTDGKTLSNWDVFTSIPGKIADGTHGKVAVDHYHRYPEDLDLMQDLGVNSYRFSLSWARILPKGRLGDVNMEGIDHYNRMINAILKRGMEPFVTLTHYDIPQELELRYKSWLSPQIREDFEHYAEICFRHFGNRVKFWSTFNEPNVQVIXGLPGKGTYPPFTFVPRTFACTR

SEQ ID NO: 4043 - protein, 483 aa, Streptomyces violaceus
MTQGPLTTEAGAPVADNQNSETAGVGGPVLVQDQLLLEKLAHFNRERIPERVVHARGAGAYGTFTLTRDVSRWTRAAFLSEVGKRTETFLRFSTVAGSLGAADAVRDPRGWALKFYTEEGNYDLVGNNTPVFFIKDAIKFPDFIHTQKRDPYTGSQEADNVWDFWGLSPESTHQVTWLFGDRGIPASYRHMNGYGSHTYQWNNEAGEVFWVKYHFKTDQGIKNLTQDEANRLAGEDPDSHQRDLREAIERGDFPTWTVQVQIMPAADAAGYRFNPFDLTKVWPHEDYPPVEIGTLELNRNPENIFAEVEQSIFSPAHFVPGIGPSPDKMLQGRLFAYGDAHRYRVGINADHLPVNRPHATEARTHSRDGFLYDGRHKGAKNYEPNSFGGPVQTDRPLWQPTPVTGVTGDHAAPSHAEDDDFTQAGDLYRLMSEDEKGRLIDNLSGFIAKVSRDDIAERAIGNFRRADEDFGKRLEAAVQALRG

SEQ ID NO: 4044 - protein, 371 aa, Medicago sativa
MSVESAENNIRGVPTHGGRYLQYNIYGNLFEVSRKYVPPIRSVGRGAYGIVCAAVNAETREEVAIKKIGNAFDNRIDAKRTLREIKLLRHMDHENVMSIKDIIRPPQKENFNHVYIVSELMDTDLHQIIRSNQPMTDDHCRYFVYQLLRGLKYVHSANVLHRDLKPSNLLLNANCDLKIGDFGLARTTSETDFMTEYVVTRWYRAPELLLNCSDYTAAIDIWSVGCILGEIVTRQPLFPGRDYVHQLRLVTELIGSPDDASLGFLRSENARRYVRQLPQYPKQNFSARFPNMSPGAVDLLEKMLIFDPSKRIKVDEALCHPYMAPLHDINEEPVCARPFSFDFEEPMFTEEDIKELIWKESVRFNPDPPIN

SEQ ID NO: 4045 - protein, 480 aa, Saccharophagus degradans
MSKCPYQTTSAGSPVADNQNSQTAGPRGPVLMQDYQLLEKLAHQNRERIPERVVHAKGWGAFGTFTVTKDISKYTRAKIFDTVGKQTPLLTRFSTVAGELGAADAERDVRGFAVKFYTEEGNWDLVGNNTPVFFIRDPLKFPDFIHTQKRHPKTNLRSPTAMWDFWSQSPESLHQITILMSDRGLPTDVRHINGYGSHTFSFWNNDGERFWVKFHFKTQQGHRHWTNEEAEKVVGKTRESTQEDLFSAIENGNYPKWTVNVQIMPEADAEKTSYNPFDLTKVWPHSEYPLIEVGEMELNRNAENYFAEIEQAAFSPSNVVPGIGFSPDKVLQARIFSYADAHRYRIGTHYEALPVNAPKCPVHHYHKDGSMNFFGNKSGSTDAYYEPNSFGGAVQNPDVAEPPLKISGDADRYNHREGNDDFSQPAALFNLFDDGQKQRLFNNIAGAMQGVPQNIIDKQLALFDKVDPAYGAGIRAALKA

SEQ ID NO: 4046 - protein, 448 aa, Lupinus albus
MGLEIEKGCVKLSNIAISETHGEDSPYFAGWKAYDENPYHEITNPSGVIQMGLAENQVSFDLIEKYLEEHSEAATWGKGAPSFKDNALFQDYHGLKSFRTAMASFMEQIRGGRAKFDPSRIVLTAGATAANELLTFIIANPGDALLLPTPYYPGFDRDLRWRTGVNIVPIHCDSSNNFQITPKALEAAYKEAEAMNMKVKGVLITNPSNPLGATIQRKVLEEILDFVTLKNIHLVSDEIYSGSVFSSSEFISIAEILEARKYKNAERVHIVYSLSKDLGLPGFRVGTIYSYNDKVVTTARRMSSFTLISSQTQQLLASMLSDKVFTENYIKTNRERLRKRYTMIIEGLISAGIECLKGNAGLFCWMNLSPLLVLENKVTREGELELWNETLHEMKLNISPGSSCHCSEPGWFRVCFANMSEQTLELALQRIRDFMAKRSGTEKMIFQN

SEQ ID NO: 4047 - protein, 248 aa, Sinapis arvensis
ENQLCGDLMRKWVLEHPEASICTAEGVNQFSDIAIFQDYHGLPEFRQAVAKFMEKTRNNKVKFDPDRIVMSGGATGAHETVAFCLANPGEGFLVPTPYYPGFDRDLRWRTGVNLVPVTCHSSNGFKITVEALEAAYENARVSNIPVKGLLITNPSNPLGTTLDRDCLKSLVKFTNDKRIHLVADEIYAATTFGQSEFISVAEVIEEVPDCNPDLIHIVYSLSKDMGLPGLRVGIVYSYNDRVVQIARK

SEQ ID NO: 4048 - protein, 441 aa, Solanum tuberosum
MAIEIEQRPTVVRLSNVATSDTHGEDSPYFAGWKAYDENPFDEVHNPSGVIQMALAENQVSFDLLEEYLEKKKDDGIAEISRFRENALFQDYHGLVCFRKAMATFMEQVRGGRARFDPDRVVITAGATAANELLTFILADPGDALLVPTPYYPGFDRDLRWRTGVKIIPVHCDSSNNFQVTLQALEEAYKDAESNNIKVRGVLITNPSNPLGTTVQRCVLEEILEFVARKNIHLVSDEIYSGSAFCCSEFVSIAEILESRNYKDSERVHIVYSLSKDLGLPGFRVGTIYSYNDKVVTTARRMSSFTLISSQTQQLLASMLSDEKFTENYIKKNRERLRRRYEMMIEGLRSAGIECLRGNAGLFCWMNLSTLLEKPTKECELEVWNTILHEVKLNISPGSSCHCSEPGWFRVCFANMSENTLEIALKRIHHFMETRGILQKY

SEQ ID NO: 4049 - protein, 161 aa, Arabidopsis thaliana
  misc_feature (25)..(25): Xaa can be any naturally occurring amino acid
  misc_feature (65)..(65): Xaa can be any naturally occurring amino acid
VSCVHTYTLLAKSGKVLSEKLHWKXTCRRSMISRREHAIITSALHTVSDHGIGCLLHTGNYPEWXLRIQTMDPADDDKCDFDPLDVTKIWPEDIMPLQPVGSLVLNMTIDSFFNETEQLASNPDLEAPGMYYSDDKLLQRTIFAYGDTHRHRLEPNYLQLA

SEQ ID NO: 4050 - protein, 251 aa, Sinapis arvensis
ENQLCFDLIETWLAKNPDAAELKKDGQSIFKELALFQDYHGLPEFKKALAEFMEEIRGNRVSFDPSKIVLAAGSTSANETLMFCLAEPGDAFLLPTPYYPGFDRDLKWRTGAEIVPIHCSSSNGFQITESALQQAYQQAQKLDLKVKGVLVTNPSNPLGTMLTRRELNLLVDFITSKNIHLISDEIYSGTVFGFEQFVSVMDVLKDKKLENSEVSKRVHVVYSLSKDLGLPGFRVGAIYSNDEMVVSAATK

SEQ ID NO: 4051 - protein, 492 aa, Hordeum vulgare
MDPYKHRPTSGANSAYWTTNSGAPVWNNNNALTVGHRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRVVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDRFDFDPLDVTKTWPEDIIPLQPVGRMVLNKNIDNFFAENEQLAFCPAVTVPGIHYSDDKLLQTRIFSYADTQRHRLGPNYLMLPVNAPKCAHHNNHHDGLMNFIHRDEEVNYFPSRFDPTRHAEKYPMPPRVLSGCREKCIIDKENNFKQAGERYRSFDPARQDRFLQRWVDALTDARVTHEIQSIWVSYWSQCDASLGQKLASRLKIKPNM

SEQ ID NO: 4052 - protein, 492 aa, Nicotiana tabacum
MDLSKFRPSSAYDSPFLTTNAGGPVYNNVSSLTVGPRGPVLLEDYHLIEKLATFDRERIPERVVHARGASAKGFFEVTHDISHLTCADFLRAPGVQTPVICRFSTVVHERGSPESLRDIRGFAVKFYTREGNFDLVGNNVPVFFNRDAKSFPDTIRALKPNPKSHIQEYWKILDFFSFLPESLHTFAWFFDDVCLPTDYRHMEGYGVHAYQLINKAGKAHYVKFHWKPTCGVKCMSEEEAIRVGGTNHSHATKDLYDSIAAGNYPEWKLFIQIMDTEDVDKFDFDPLDVTKTWPEDILPLMPVGRLVLNRNIDNFFAENEQLAFNPGHIVPGLYYSEDKLLQTRIFAYADTQRHRIGPNYMQLPVNAPKCAHHNNHRDGAMNFMHRDEEVDYLPSRFDPCRHAEQYPIPSRVLTGRREMCVIEKENNFKQAGERYRSWEPDRQDRYVSKWVEHLSDPRVTYEIRSIWISYLSQADKSCGQKVASRLTLKPTM

SEQ ID NO: 4053 - protein, 494 aa, Hordeum vulgare
MDPCKFRPSSSFDTKTTTTNAGQPVWNDNEALTVGPRGPILLEDYHLLEKIAHFARERIPERVVHARGASAKGFFECTHDVTGLTCADFLRAPGARTPVIVRFSTVIHERGSPETIRDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVSRAGKSHYVKFHWRPTCGVSCLMDDEATLVGGKNHSHATQDLYDSIDAGNFPEWKLFVQVIDPDEEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRHAEPASFPVPTRPVVGKREKTRIKKENDFVQPGERYRSWAPDRQDRFVRRFSDALAHPKVSHELRVIWIDFLSKCDKSCGMKVANRLNVKPSM

SEQ ID NO: 4054 - protein, 865 aa, Saccharomyces cerevisiae
MSYTNKRHTYYGGFTNDLSDTFQYPQRTDEQRRKHVTFGPYILGSTLGEGEFGKVKLGWPKNFSNSSNSTFDFPKQVAIKLIKRDSISNDYRKEVKIYREINALKHLSHPNIVKLEEVLQNSRYIGIVLEYACGGEFYKYIQKKRRLKEMNACRLFSQLISGVHYIHSKGLVHRDLKLENLLLDKNENLVITDFGFVNEFCSRNELMKTSCGSPCYAAPELVISAEPYEARKADIWSCGVILYAILAGYLPWDDDPNNPEGSDIGRLYNYINSTPLKFPDYILPIPRDLLRRMLVSDPKKRINLKQIKKHEWLKPHSSFLSITPDEWDKLNNTQSVFRLAKPRRRYGSRPQSSCSTSSLGSRSDKRDSLVIDSTLITFPAPPQESQNHIITRPASIASDQRLSPIRRSNRHNRSNSAASVALQAVVNADREYVLSHEQSLSPVQNIRQTTGNMTASLSPPPAISPGDIIIETTPIKRNTISGSSIVPSLEEESSTTMQTSKIQPNNMASSQNHQYNKNKTQNSLQSAKNFYRTSSSSHTKPRPTSYHPGSYTTPPYNSNTLSIYEINEKAKSSASSQTLNQRDTSPFDSTPYLALDTCITSSSSIESSPKLITHGQFSVAKPSVDLQSVSGDLIKYKRDADVVTRIYDEKYKQKRKSLRYSGIFSDISCDTVTEESDELRPPESPLQQHEGQESIDKAKTEDTSEKGSKSSNIAKATAQKHVNNHLERSLNEAESTKKRFSFLSLYSYDTSKSSLYSSMDSKRKPSPPSQRRPKKDDSYQTNSKNHYITASNMQTSHQVSKDLPAPTMVQNKCTLETKKAVRSNRSSIMVSEVNKASVDNKAAQSPEHSTAKRVLGFFKRRSMKI

SEQ ID NO: 4055 - protein, 492 aa, Solanum tuberosum
MDPSKYRPSSAYDTPFLTTNAGGPVYNNVSSLTVGPRGPVLLEDYYLIEKLATFDREKIPERVVHARGASAKGFFEVTHDISHLTCADFLRAPGAQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKEGKAHYVKFHWKPTCGVKSMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAEQYPIPACVLNGRRTNCVIPKENNFKQAGERYRSWESDRQDRYITKWVESLSDPRVTHEIRSIWISYLSQADKSCGQKVASRLTVKPTM

SEQ ID NO: 4056 - protein, 918 aa, Pseudomonas aeruginosa
MSRLCLVLLLLCCALPARAQPPAPLDGEDLRLSLGAYAEYYRDAGGKARLGDILALPAQAFAALRGDHANFGKNAAAWWFRVRLDNRNGADLAGFLEVNYPLLDDLKVYLLTADGRIEQQESGDLFAFSQRPVQVRNFWFPLRLPPGESTLLLRVQSSSTVYVPLYFSTYAASAASQETLMGFNGAFYGVLFGLFCYNLFLFVSLREATYAWYLLYNLSLGLFSASFDGLLFKLLPGHVALESAGIYLLMYLSCLVSIQFSRGYLYTRRDFPRLDRFLRGLLLACVVLLASEPLVGLRAWNVLASLTVMLVSLSLLLAGVHVWRQGLRYGLYYILAWGALLLSFLVTTAASLGFELFGLFGSSVVKIGMTVELVTLSIGLADRINALKEEGFRSRQAAEQARVENEAKSRFLAKMSHEIRTPLNGVLGMLQLLRDTPLDRGQAAYVETIASSGSALMSVINDILDYARIESGKLHLERIDFDLEELLSDTLALFSAQAVEKRLRLHLGLDRGVPRRLNGDPTRLRQVLMNLLSNALKFTAEGHVAVRVQRRFDEGGRERLLYSVSDSGIGISAQAQKTLFESFSQADSSTTRRYGGSGLGLAISRELVQMMGGRIEVSSEPGKGTRFSVDLPLSPALEAGEADELAQLLQHRPALLASEDNLTLDCLQALLERWGLRVERCLQPRRLNAYLEDFSAPPLLVLAAPWPGPPSIWLDTLYAQLEQGQRILLLCPPQHCQDLPPHEGLRLLALAQPVAVKALREALLELYRERRRQPGRSSEAAPDERLDAPCILVAEDNPVNQLVVRGFLAKRGYAVRLAGNGRLALDEYLRDPNGIQLILMDGEMPEMDGFEATRLIRREERAQGWPRVPIVALTAHILDEHRRAGIEAGMDAYLGKPVDRAELYATLERLLGQPSRQA

SEQ ID NO: 4057 - protein, 492 aa, Arabidopsis thaliana
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLNMFTFLFDDIGIPQDYRHMDGSGVNTYMLINKAGKAHYVKFHWKPTCGVKSLLEEDAIRVGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCIIEKENNFKEPGERYRTFTPERQERFIQRWIDALSDPRITHEIRSIWISYWSQADKSLGQKLASRLNVRPSI

SEQ ID NO: 4058 - protein, 681 aa, Unknown
  Silicibacter sp. TM1040
MSHDPLLQPFQLKHLTLRNRIMTTSHEPAYPEDGMPKARYRAYHAERAKAGVALAMTAGSAAVSKDSPPVFNNILAYKDEVVPWIRDLTEGCHEHGCAVMIQLTHLGRRTTWNKGDWLPSVSSSRHREPAHRAFPKLVEDWDIERIITDFADAAERMKAGGMDGIELQAYGHLIDQFWSPLTNDLNGPYGADTLENRLRFPMDVLQAIRKRVGPDFIVGMRFTADEVQKGGITEEEGLEITRILSATGQVDFLNVIRGRIHTDPAMTDVIPVQGMRSAPHLDFAGRVKHETDLPVFHAARIPDVATARHAVQAGLLDMVGMTRAHMADPHVVQKLKEGREEDIRPCVGATYCLDRIYQAGDALCIHNAATGRELTMPHEIAPAEKQRKVAIVGAGPAGLEAARVAAERGHRVVVFEAQPDPGGQIRLTAQSPRRREMISIVDWRMAQCAARDVQFHFNTWAEEEDVLAQNPDLVIIATGGLPNLELFETGQEAAHVVSAWDLIAGDVKPAGRVLIYDESGDHPGLQAAEIAAEAGAEVEVMTPDRTFAPEIMAMNLVPYMRALQEKDVTFTVTRRLLGVARQGNELVATIGTDYSNFTTQKSYDQVVLNYGALPNDDLYQALRPASINHGEVDHDALICGQPQAITRNPRGAFQLFRIGDAVSARNTHAAIYDALRLMKDL

SEQ ID NO: 4059 - protein, 82 aa, Helianthus annuus
SLEIDELARFAVDEHNKKQNALLEFGKVVNTKEQVVAGKMYYITLEATNGGVKKTYEAKVWVKPWENFKELQEFKPVDAATS

SEQ ID NO: 4060 - protein, 476 aa, Mycoplasma penetrans
MKFKKLEKFPEGFLWGASSSAYQIEGAWDEDGKGMSTQDLPKQNVDGWVDWSKITDFKVASDQYHRYKEDIALMAEMGFKAYRFSIAWTRIIPDGNGAINKKGIQHYHDVIDELLKHGIEPVITMYHFDLPLALEQQGGWTNRDLIVPAFVKYAKVLFKEYGHKVKYWLTINEQNMVAMVGDILGMVSSDPKNRWKHMANLNHNMLLAQSYAFIYLHKMCPNAKIGPAPNICVYYPKSCNPEDFTAAKNAQSLLHWYYLDIAVRGKYNNIVWKFLKDNDALPEIRKDDFKVFKAGKPDFIAFNYYASGTAEKDEGDAVITHGDQHSMFDVPGLYKGAENEYLGKTNYGWAKDPIGFRNTFRELYDRYQLPLLVTENGLGTQDTLTADEKIHDDYRIEYLENHIKEMRNAISDGVEILGYCPWSAVDLVSTHQGITKRYGFVYVNRDEFDLKDLRRIRKDSFYWYQNVIKNNGNNIE

SEQ ID NO: 4061 - protein, 375 aa, Vibrio fischeri
MNQGTKPSIIWLNVFIFTSSFLLAFVATPIYAYYNPLGSEHWIWLLLTFSFCNLSITAGYHRLWSHKAYNAHPALRFIFALGGAFALQNSALHWSSDHRIHHRHVDDNDKDPYSAKRGFWFSHIGWMLRHYKPATYNDYGNCRDLQKDNILMWQHKHYIVLALIMNIGVPLLLGVIYGDIIGMLLMVGAVRLTLSHHTTFFINSLAHIWGSQPYTEKNTARDNGFLAIFTFGEGYHNYHHIFENDYRNGIYWWQYDPTKWFIKTCSLLGLAHKLRVSPQAKIEKAKALMLRKKAESKIATLHNYHAIKEHLEAEYDALIERMAEYYDSKKQLIENKKDTLSKKYELALLNVQHKQIKMQFEHQKRVWNRLVLQYV

SEQ ID NO: 4062 - protein, 477 aa, Mycoplasma penetrans
MKIKKLNQFPKNFLWGASSSAFQVEGAWNEDGKGLSIQDVPKKDIAGWIDRSKVSDYKVASDQYHRYKEDFALMAEMGFKAYRFSIAWTRILPDGVGKVNPLGIKHYHDVIDELLKHNIEPIITLFHFDMPYALEQQGGWSNRDLIVDAFVNYAKILFKEYGHKVKYWLTINEQNMLAMVGDLFGLTNSQESSNRWQNISKINHNILIAQAKVINELHLTNKNAKIGPAPNIAIYYPKTCHPEDVLASKNAQALMHWYYLDVAVRGQYNNIVWKFLEQENALPEFRKDDEQIFKNGKPDFIAFNYYTSGTVEKALDVAVTTRGDQQNMFDVPGMYKATSNDFLNKTKFNWTIDPVGLRTTYRELYDRYQLPLLVTENGLGSPDELTKDFKVHDDYRIEYLKAHILETRKAISDGIPIIGYCPWSAIDLVSGYQGVNKRYGFVYVNRDEFDLKDLRRIRKDSFYWYQEVIKNNGNNIE

SEQ ID NO: 4063 - protein, 506 aa, Glycine max
  misc_feature (329)..(329): Xaa can be any naturally occurring amino acid
  misc_feature (419)..(419): Xaa can be any naturally occurring amino acid
MGNSFGCSASGERLVSAARDGDLVEAKMLLNCNPCLAKYSTFGGLNSPLHFAAAKGHNEIVALLLENGADVNSRNYCGQTALMQACRYGHWEVAQTLLLFRCNVIRADYLSGRTALHFAAVHGHVRCIRLVVADFVPSAPYQAIHAGTAVDRGGGSNCSALSKFVNKTADGGITALHMAALNGYFDCVQLLLDLNANVNAVTYNYGTSMDLIGAGSTPLHYAACGGNLKCCQILVAHGASRLALNCNGWLPLDIARMWGRHWLEQLLAPSSDATMPTFSHSNYLSLPLMSVLNIAREYGLQSSTASSDEIDFCAVCLERPCSVAAEGCXHELCVRCALYLCSTNNVSSEMVGPPGSIPCPLCRHGVVSFVKLPGSQAKENKLHVSLGLCTPCMLHPRDLDKPSLSHTPEVGRNRVASVXSEILCPVTCSPFPSMAIPLCTCNDGPCPSFEPREVETQDGLPHHSQASTVDQDKIEGPRLDKTTCSSMFWGRRSCSREHQCNSEINA

SEQ ID NO: 4064 - protein, 501 aa, Sinapis alba
DEEITCQENNPFTCGNTDGLNSSSFEADFIFGVASSAYQIEGTIGRGLNIWDGFTHRYPDKSGPDHGNGDTTCDSFSYWQKDIDVLDELNATGYRFSIAWSRIIPRGKRSRGVNQKGIDYYHGLIDGLIKKGITPFVTLFHWDLPQTLQDEYEGFLDPQIIDDFKDYADLCFEEFGDSVKYWLTINQLYSVPTRGYGSALDAPGRCSPTVDPSCYAGNSSTEPYIVAHHQLLAHAKVVDLYRKNYTHQGGKIGPTMITRWFLPYNDTDRHSIAATERMKQFFLGWFMGPLTNGTYPQIMIDTVGARLPTFSPEETNLVKGSYDFLGLNYYFTQYAQPSPNPVNATNHTAMMDAGAKLTYINASGHYIGPLFESDGGDGSSNIYYYPKGIYSVMDYFKNKYYNPLIYVTENGISTPGSENRKESMLDYTRIDYLCSHLCFLNKVIKEKDVNVKGYLAWALGDNYEFNNGFTVRFGLSYINWNNVTDRDLKKSGQWYQKFISP

SEQ ID NO: 4065 - protein, 314 aa, Cryptococcus neoformans
MGEQPEIDLDSVIDRLLEVRGNRPGKAVQLAEYEIKYLCTKAREIFISQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLQSMEQIRRVMRPTDVPDTGLLCDLLWSDPDKDITGWSENDRGVSFTFGPDVVSRFLQKHDMDLICRAHQVVEDGYEFFAKRQLVTLFSAPNYCGEFDNAGAMMSVDDTLLCSFQILKPAEKKPKYGGYGGSARR

SEQ ID NO: 4066 - protein, 328 aa, Cryptococcus neoformans
MGEQPEIDLDSVIDRLLEVRGNRPGKAVQLAEYEIKYLCTKAREIFISQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLQSMEQIRRVMRPTDVPDTGLLCDLLWSDPDKDITGWSENDRGVSFTFGPDVVSRFLQKHDMDLICRAHQVVEDGYEFFAKRQLVTLFSAPNYCGEFDNAGAMMSVDDTLLCSFQILKPAEKKPKYGGYGGSARPVTPPRKGKSNKRKA

SEQ ID NO: 4067 - protein, 295 aa, Digitalis lanata
GEVFTEITKPGLEPYVGLHYPATDIPQAARFLFMKNKVRMICDCRAKHVKVVQDEKLPLDLTLCGSTLRAPHTCHLQYMENMDSIASLVMSIVINEGDEEGSEPVQVQNRKRLWGLVVCHNTTPRFVPFPLRYACEFLAQVFSIHVNKELELENQMFEKNILRTQTLLCDMLLRDAPLGIVSQSPNVMDLVKCDGAALLYKDKKYKLGLTPTDFQIRDIVSWLDEYHRDSTGLSTDSLYDAGFPGALSLGGSISGMAAVKISEKDWLFWFRSHTAAEVRWGGAKHEPGEKDDGSR

SEQ ID NO: 4068 - protein, 634 aa, Methanococcoides burtonii
MCGICGYAGFDDEDLLGKMCDAIVHRGPDDSGSFTDKGIGLGHRRLSIIDLEGGHQPVCNEDGTIYVVYNGEIYNFLSLRDELEKRGHRFQTSSDTEVIVHLYEEYGKDLVHHLRGMFAFALWDSNTRTLLLARDRLGVKPLYYTTIDNRLLFASEIKSIVQYSGYEKAVDIGTLHDYLTFRHALGTETMFAGIKKLLPGHVMTYREGEVNISEYWDVPLVTVGNESEDFYIKKTRLLLEESVKMRLMSEVPLGIYLSGGIDSGIVTGLMSKMVDEPIETFSVGFGERGEIGELSQAQEAADFFGTNHHEIIVDQGAFKQNLKDIIWHNDEPIADPSALAMFQLSKMASKHVTVVLNGAGGDEVFGGYISYKVGLANQKYHKIVPKVIRQGLVRPFVNAISPHLSSKMYVGIQSATQEVEEHGFLFTKSVFSEEDKEDIYTDKIKDKIHHNTFEKATTSLFRGKRYSGAIDERSSAKNTDLLSKMMYADTKSYLVDHILLETDKLTMSSSIEARVPIIDHKVVEFAASIPQELKLRGMTEKYILKKVGQGMLPPAAQNRKKRPFRIPIDTWFKDELHEMSQQVLDESSIVEQGYFRPEVVKDIMKKHERAELLYNHQMYALLVFEMWHERFMKM

SEQ ID NO: 4069 - protein, 251 aa, Sinapis arvensis
ENQLCFDLIESWLAKNQDAASLKRNGQSIFRELALFQDYHGMPEFKKAMAEFMEEIRGNRVTFDPKKIVLAAGSTSANETLMFCLAEPGDAFLLPTPYYPGFDRDLKWRTGAEIVPIHCSSSNGFQITESALQQAYQRAHKLDLKVKGVLVTNPSNPLGTALTRRELNLLVDFVNSKNIHLISDEIYSGTMFGFEQFISVMDVLKDKKLEDTEVSKRVHIVYSLSKDLGLPGFRVGAIYSNDEMIISAATK

SEQ ID NO: 4070 - protein, 69 aa, Populus alba
FKADLPGIKKDEVKVEIEDDRVLQISGERSVEKEDRNDTWHRVERSSGKFLRRFKLPENARTDQVKAGM

SEQ ID NO: 4071 - protein, 279 aa, Bacillus cereus
MKNLQSKTVLSNGVEMPWFGLGVFKVEEGPELVEAIKSAIKAGYRSIDTAAIYGNEAAVGEGIRAGIETTGISREELFITSKVWNADQGYEETIAAYEESLKKLKLDYLDLYLVHWPVEGKYKDTWRALETLYKEKRVRAIGVSNFQIHHLQDVIKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 4072 - protein, 470 aa, Streptococcus pneumoniae
MENLQVKALPKEFLLGTATAAYQVEGATRVDGKGINMWDVYLQENSPFLPDPASDFYYRYEEDIALAAEHGLQALRLSISWVRIFPDIDGDANVLAVHYYHRVFQSCLKHNVIPFVSLHHFDSPQKMLETGDWLNRENIDRFIRYARFCFQEFTEVKHWFTINELMSLAAGQYIGGQFPPNHHFQLSEAIQANHNMLLAHALAVLEFHQLGIEGKVGCIHALKPGYPIDGQKENILAAKRYDVYNNKFLLDGTFLGYYSEDTLFHLNQILEANNSSFIIEDGDLEIMKRAAPLNTMFVMNYYRSEFIREYKGENRQEFNSTGIKGQSSFKLNALGEFVKKPGIPTTDWDWNIYPQGLFDMLLRIKEEYPQHPVIYLTENGTALKEVKPEGENDIIDDSKRIRYIEQHLHKVLEARDRGVNIQGYFIWSLQDQFSWANGYNKRYGLFFVDYETQKRYIKKSALWVKGLKRN

SEQ ID NO: 4073 - protein, 515 aa, Arabidopsis thaliana
FLRMDGSGTGSRSGVESILPNYKLGRTLGIGSFGRVKIAEHALTGHKVAIKILNRRKIKNMEMEEKVRREIKILRLFMHPHIIRLYEVIETPTDIYLVMEYVNSGELFDYIVEKGRLQEDEARNFFQQIISGVEYCHRNMVVHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSPGARDLIPRMLVVDPMKRVTIPEIRQHPWFQAHLPRYLAVPPPDTVQQAKKIDEEILQEVINMGFDRNHLIESLRNRTQNDGTVTYYLILDNRFRASSGYLGAEFQETMEGTPRMHPAESVASPVSHRLPGLMEYQGVGLRSQYPVERKWALGLQSRAHPREIMTEVLKALQDLNVCWKKIGHYNMKCRWVPNSSADGMLSNSMHDNNYFGDESSIIENEAAVKSPNVVKFEIQLYKTRDDKYLLDLQRVQGPQFLFLDLCAAFLAQLRVL

SEQ ID NO: 4074 - protein, 589 aa, Candida albicans
MLELNSITIPRNFTEFQLTALKIYYQLKILFLATYCTQGSLGLNGSVCLARDIFVGYVVYTQLLKLYRVLRGYGIIDSIRRLYLYVSSIVSSQIFSLPFIKSKIDKELQATIGKVEEEIMKNDPQLLQFPELPEQGIDADNVSLELDKLQNLKHSDWINGRVSGAVYHGGENLLSLQVEAYKKYSVANQLHPDVFPGVRKMEAEVVHMVLDIFNAPSDGCGSTTSGGTESLLLAGLSAREYGKKYRGITEPEVIAPVTIHAGIEKACFYFGMKLHKVDLDPVTFQVDVKKVERLINSNTVLICGSAPNYPHGIIDDIESLSKLAVKYNIPLHVDACLGSFIVSFLEKSKVHGDRKLPIFDFRLPGVTSISCDTHKYGFAPKGSSIIMYRSPKLRECQYYIASDWTGGMYGSPTLAGSRPGALVVGCWATLINIGKQGYTKFCYDIVSASMKVKRAIETDPILSKHLQIIGDPIGSVISFQLAPQQSGNLSIYEISDLLTKKGWHFATLQNPSALHFAFTRLTVPVVDELIADLVEATKEAVAIAEEHKKNGVTKAPGDTAALYGIAGSVHTAGLADRLIVAFLDTLYKI

SEQ ID NO: 4075 - protein, 491 aa, Oryza sativa
MDPCKFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPLRHAPPTPITPRPVVGRRQKATIHKQNDFKQPGERYRSWAPDRQERFIAVRRRVAHPKVSPELRAIWVNYLSQCDESLGVKIANRLNVKPSM

SEQ ID NO: 4076 - protein, 368 aa, Scytosiphon lomentaria
MTTFFDELTIAGMKLRNRVVMSPLTRDRATVDLVPTDRDAEVSMLVYYEQRASAGLIISEATQVSTDGQGYPLTPGVFTPEQIAGWKKITDAVHAKGAKMVCQIWHCGRTSHESYQPDGKAPPAPSAIACPDGECFTMEGPKPFPVPREMTVEEIKNCVEQFRQGALNSIEAGFDGVEIHAGNGYLIDQFLKDNSNKRTDDYGGSLENRFRFLKEIVVACQEAIGKDKVAVHLTPGGTFNGTKDKAEEATGNHEYFCKQLNGMGISYLHIKLADDQDERHGGVAIPIETIRKNFDGIIITNNRYHEKEDFGEGDLGKVYDAVAFGRSFIANPDLPARIAKKAPMNEWDHTSFFGGTEKGYTDYPFMDE

SEQ ID NO: 4077 - protein, 226 aa, Thalictrum dioicum
MGRGKIEIKRIENTTNRQVTFCKRRNGLLKKAYELSVLCEAEVALIVFSSRGRLYEYSNNSVKKTIERYKKASTDSPNSGSVSEANVQFYQQEASKLHNQIASLQNHNRNLLGESLSNLNIKELRQIEKKIEGGISKIRAKKNELLFAEVEYMQKREIDLQTDNKYLRAMIAANERAPPEHMNLMPANEYHIMSSAPFDSRNFLPANLLDHNNNYSRSDQTTLQLG

SEQ ID NO: 4078 - protein, 175 aa, Bradyrhizobium japonicum
MANETKLPVTKKTNEPAFGGETWRPFEALRKEVDRLFEDFGTDDFWRRPFRSLAGFERNLAQKLVSTPAVDVTESDKAYEITAELPGMDEKDIEVNVANDGLTIKGEKKFEREEKQKDYYVSERRYGSFERHFGLPKDVEADKIEASFRNGVLKVTLPKTAEAQKPAKKIEVKAA

SEQ ID NO: 4079 - protein, 464 aa, Klebsiella aerogenes
MKTFPTDFLWGGATAANQVEGAYLEDGKGLSTSDVQPHGVFGEVVERVPGDNGIKDVAIDFYHRYPEDIALFAEMGFNCLRVSIAWTRIYPNGDDAEPNEAGLAFYDKLFDEMAKHNITPLVTLSHYEMPWALVKNYGGWGSREVIGFFERYARTVFSPYKNKVKLWLTFNEINMSLHAPITGVGLPAGSSKGEVYQAIHHQLVASALAVKACHELVPEGKIGNMLLGGLMYPLSCKPEDVFETLQENRSWQFFGDVQARGAYPGYMFVYFRDNGITLTITDADREALKTTVDFISFSYYMTGCVTADERLNQQARGNILSMVPNPHLASSEWGWQIDPLGLRTLLNVLWDRYQKPLFIVENGLGAKDKVEADGSINDDYRISYLNDHLMQAREAIDDGVELMGFTSWGPIDLVSASKAELSKRYGFIYVDRHDDGTGTLARSKKKSFGWYKEVIASRGASLKA

SEQ ID NO: 4080 - protein, 507 aa, Staphylococcus aureus
MTMSQQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAERDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKFHFRTQQGIENLTDEEAAEIIATDRDSSQRDLFEAIEKGDYPKWTMYIQVMTEEQAKNHKDNPFDLTKVWYHDEYPLIEVGEFELNRNPDNYFMDVEQAAFAPTNIIPGLDFSPDKMLQGRLFSYGDAQRYRLGVNHWQIPVNQPKGVGIENICPFSRDGQMRVVDNNQGGGTHYYPNNHGKFDSQPEYKKPPFPTDGYGYEYNQRQDDDNYFEQPGKLFRLQSEDAKERIFTNTANAMEGVTDDVKRRHIRHCYKADPEYGKGVAKALGIDINSIDLETENDETYENFEK

SEQ ID NO: 4081 - protein, 621 aa, Listeria monocytogenes
MCGFVGCVHDRITEITGADKETFRQMNSMITHRGPDDEGYFTDDHVQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDGKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPSVFKSMLNSVARIMPEGMRGKSFLERGTTPMEERYIGNAKMFTEKEKQILLPKYQAGHDYTNITDPFYAETTNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLGLLDDHCAGKFDYSRKIWTVVIFMIWYDVYVADKYDFGK

SEQ ID NO: 4082 - protein, 496 aa, Arabidopsis thaliana
MASTVSVQPGRIRILKKGSWQPLDQTVGPVVYWMFRDQRLKDNWALIHAVDLANRTNAPVAVVFNLFDQFLDAKARQLGFMLKGLRQLHHQIDSLQIPFFLLQGDAKETIPNFLTECGASHLVTDFSPLREIRRCKDEVVKRTSDSLAIHEVDAHNVVPMWAASSKLEYSARTIRGKINKLLPDYLIEFPKLEPPKKKWTGMMDKKLVDWDSLIDKVVREGAEVPEIEWCVPGEDAGIEVLMGNKDGFLTKRLKNYSTDRNNPIKPKALSGLSPYLHFGQVSAQRCALEARKVRSTSPQAVDTFLEELIVRRELSDNFCYYQPHYDSLKGAWEWARKSLMDHASDKREHIYSLEQLEKGLTADPLWNASQLEMVYQGKMHGFMRMYWAKKILEWTKGPEEALSISIYLNNKYEIDGRDPSGYVGCMWSICGVHDQGWKERPVFGKIRYMNYAGCKRKFNVDSYISYVKSLVSVTKKKRKAEEQLTRDSVDPKITIV

SEQ ID NO: 4083 - protein, 255 aa, Prunus persica
MGRGRVQLKRIENKINRQVTFSKRRSGLLKKAQEISVLCDAEVALIVFSTKGKLFEYSTDSCMERILERYERYSYSEKQLLANDHESTGSWTLEHAKLKARVEVLQRNCSHFMGEDLQSLSLKELQNLEQQLDSALKHIRSRKNQVMYESISELQKKDKALQEQNNLLAKKVKEKEKALAPQAESWEQQVQNQGLDCSSTLLPEALQSLNFGSGSNYQGIRNDGSGGDHEDENETPTANRPNTLLPPWMLRHLNE

SEQ ID NO: 4084 - protein, 1413 aa, Aspergillus nidulans
MADLKPPFTEEAARAKVKIAQNLWNAQDPVRVSQAYTPGCIWRNRTSFFSGTEAIVDFLTAKWKRERNYRLRKELFSFTDNRIAVQFWYEFQDANDSMRWKRCYGLEDWTFDRESGKMCKRMMSGNDILLGPDGNGEGRCDYRLLTQRWDHPTYHPYNRNRRLQQLDLNHFCRARISLAMEETSPFPDSKTMRSPLTDASNRINNCHTPTTERRLMREEHALTSPVPMSIVDSPLSPRNNAENNGPPPVGDSRACSKRNSAVSAASIVSAKGKRKTHVGPWQLGRTLGSGATGRVRLAKHAVTGQTAAVKIVSKKCAAISQSDSIAAMDRNAGTFIGAGGRQMPSGIEREVVIMKLIEHPNVISLYDVWENRGELYLVLEYVEGGELFDYVSNHGPLPEEEAVRLFRQIIAGLGYCHRFNICHRDLKPENILLDGEHNIKLADFGMAALQPAGHWLNTSCGSPHYAAPEIIYGRKYRGDKADLWSCGIILFALLTGFLPFDGEDLHATLQLVRKGDYMIPPHVSAEAADLIQRILQKKPDDRISMKDIWKHPLLKKYEKFHQAICNHYLGPPPPLSPQDCGPPVVRQDIDVDLLRNLQTLWHDVKPERLIEKLISLEPTQERLFYHALVKFRNEQLENYEGQPLRYSTSDYHHISRGQARLSKHLRSRSQNGSQRRSRAPSVKETGKRRPSTRELKPSASVETYDPYRSPFNRVPDKSPQYAHVTIHREAPETSPKPAEVEVDSSNPFLDDEQEIECQQSPPFTLVRKRKQNFNSVKSFQSKTSLISSRRALNSASTPRSVSYKRNVTFHHNRNRSQSSASAKAKRAHCNRQPSEASLISGFDDDPFSDSRSSSLLPAQPAVVRGAGIAVKNSVQRRVQHSDFVWRDEARKVSHELSQICEEAFNGSSLSTGCTDTTCVSPETPATSVSLASPGVSNHQMDSSSSTVCLAATPPADSPKTSHVRRELEETRRRLIEHSMKDGSKEIPQCLAPVIDHLDRLIEQEKTRRPGKVSTKEDYSSMSDLFCGSPVEPTQLSVLSEELNTGRRSDDTPSSKKDRQVSGSTAASSQISRGKRSIRMVPHSSYQSISNTEPRAVHRPAAALIDRPENDRGNALASRVGSNHRHNRTPCELDPIDEHPASPRRSAVRSTDHKKWSWFRKSQNIEEDFVKAPTVVKPLHPSSATVIVHEVHPARNTAENQPKLGKPPSDSQKVSFWSFIKRKKGKNADPESTATNPVLESRRDDERQRAHPGPKLSENKTATKPRRSIRSSGISNNWFARVFQFKPATRVVALNASKIKGRKEIYKMLRDWKQYGMEDIYLDKPNSIIYGRVGESNFLHLRPVDFSADFYTVIEDGRQANLSVVRFRQERGAASSFNRVVDTLCMVMKQRGLLVEDPARAKRMAQVLDAFPNA

SEQ ID NO: 4085 - protein, 772 aa, Bradyrhizobium japonicum
MRIVCIGGGPAGLYLGLLMKRRHPDHVITVVERNKPYDTFGWGVVFSDAMMSAMRLADPESATEIEDAFNHWDDIELVFKGTRQRTTGHGFIGIGRKHLLNILQRRCEALGVELVFERDVESDLEFPEADLIVACDGVNSRIRARYAEQFQPDMVIRPNRYIWLGTKKAFDAFTFDFQRTEHGWFQAHIYKFDAETSTFIVETTEEAYNAHGLGELDQQASIDFCEKIFAETLDGAKLLTNARHLRGSAWLNFSRLICGKWSVFNGKSHVVLMGDAAHTAHFAIGSGTKLALDDAIELANQFDRHGHGRAGIETVLEAYEEVRRVDVARIQNAARNAMEWFEVVGRRYADTLEPPQFFYSMLTRSQRISHENLRLRDRTWLEGFERWFAARSGIAVKDGERVLPPMLTPHRVRGLSLANRIMVSPMAMYSAEDGLINDFHIAHLGARAMGGAALIFAEMTCVSPDARITPGCLGLWNDAQEAQWRRLVGLIHSLGHAKVGIQLGHAGRKGATRVPWEGIDQPLESGEWPLISASALPYLPHSQLPRAMDRSDMDRVRDDFVAATHRAASAGVEWLELHCAHGYLLSSFLSPLTNRRTDEYGGSHENRARFPLEVFKAMRAAWPSDRPMSVRLSCHDWTEGGNTPADAAIFAAMFKEAGADVIDCSSGQVWKEERPIYGRLFQTPFADLIRNEVGIETIAVGAISEADHANSILAAGRADLCAIARPHLADPAWTLHEAARIGITSVNWPKQYLSAKGQYESNLARAAAASAQ

SEQ ID NO: 4086 - protein, 203 aa, Thalictrum thalictroides
KRRNGLLKKAYELSVLCEAEVALIVFSSRGRLYEYSNNSVKKTIERYKKASTDSPNSGSVSEANVQFYQQEASKLRNQIASLQNHNRNLLGESLSNLNIRELKQIEKKIEGGISKIRAKKNELLFAEIEYMQKREIDLQTDNKYLRAMIAANERAPEHMNLMPANEYHVMSSAPFDSRNFMPANLLDHNNNYCRSDQTTLQLG

SEQ ID NO: 4087 - protein, 367 aa, Azotobacter vinelandii
MPLFNFRGTQRMWYDGFLDPTPWQLIMVTLLITHLTVVSVTVYLHRYSAHRALELHPAVKHAFRFWLWLTTGMNTREWTAVHRKNHACCETPEDPHSPRYKGLANVLWRGAELYKAEAGNTETLRIYGKNCPDDWIERHVYSRFPNGGAMLMLLIDLALFGAFGLSVWAVQMLWIPFWAAGVVNGLGHAVGYRNFECRDAATNLVPWGILIGGEELHNNHHTYPGSAKLSVRPWEFDMGWAWIRLLVLLGLAEVKRTVPVAHRVADKRHLDMDTARAILNNRFQIMAHYRSRVIAPQVRMEAARAEASVRHLFHRDKGLLARESSLLEARQQARIQSLLEQSQTLRVVYERRLALQQVLDPDQRQRA

SEQ ID NO: 4088 - protein, 441 aa, Thermosynechococcus elongatus
MLSPFPLPVRGIFLWGDDRIGARCFEWLCRVKHWAILGVGVALLGMPPAVGGTSTLKDAPKALVDEAWQIIYKSYLDRSFNRLDWQAIRRELLSQPYRDREAAYRVIQQTLVRLNDPYTRFLPPHEYRQLLLQTQGQQVDVGLTLVEAGELFRIQAIQPGSVAAKADLKVGDEILAINGRGSDRLTLERATLALRGPAGTKLRLLVRREGKPQPFSVELTRAGEIPRTVNFQILNSPRVGYIRLSGFNSRSQQQMQEAIEILQREKVQGFILDLRHNPGGLLEAGIEISRQWLDSGVIVRIQQNQREETIRARQGALSQLPLVVLVNQASASASEILAAALQDQGRAIVVGTPTFGKVRVQAVHELADGSALVVTVARYLTPKGRDIAAGGISPDVLVTVDASTDLELRLNPNLVARPTDPMVAKALELLSTKISNARHVQ

SEQ ID NO: 4089 - protein, 268 aa, Unknown
  Burkholderia sp. 383
MNELEYVPVPAFDDNYIWLVSDGRDAIAVDPGEAAPVRRVLAERGWRLTAILLTHHHADHVGGVAALRDSQPDDAPLTVYGPAAEAIGVVTRPLSGGDRVTLDAPAATFDVLDVPGHTRGHIAYFQAAGQGNAAPHVFCGDTLFSCGCGRLFEGTPAQMLASLDALAALPGDTHVHCAHEYTLSNIRFALACEPGNTALATWRDDAQALRARGVPTLPTTIAHERAVNPFMRADSDAIRATLEAELHETVPDRLTAFTLMREWKNRFR

SEQ ID NO: 4090 - protein, 235 aa, Lycopersicon esculentum
MRVIRSRAILIVLFLVSAFGLSEQGKSGGFCSEEMATLGGVHDSHGSSQNSDEIHSLAKFAVDEHNKKENAMIELARVVKAQEQTVAGKLHHLTLEVMDAGKKKLYEAKVWVKPWLNFKELQEFKHVEDVPTFTSSDLGVKQVEQNSGLKSVPVHDPVVEEAAEHAIKTIQQRSNSIHPYKLQEIVHANAEMADDSTKLHLVIKTSRGGKEEKFKVQVQHNNEGAFHLNRMEPDN

SEQ ID NO: 4091 - protein, 94 aa, Lycopersicon esculentum
GGIREAGGSENSLEINDLARFAVDEHNKKQNALLEFGKVVNVKEQVVAGTMYYITLEATEGGKKKAYEAKVWVKPWQNFKQVEDFKLIGDAATA

SEQ ID NO: 4092 - protein, 154 aa, Unknown
  Mesorhizobium sp. BNC1
MTFTIRSALAYDLALLLFRPQDAIKFPDIIHAVKPEPDRGFPQAQSAHDTFWDFISLTPESMHMIMWVMSDRAIPRSFRFMEGFGVHTFRFVNAKDESTFVKFHWKPKLGLQSVAWNEAVKINGADPDFHRRDLWQAIELAREICTAGISGVSA

SEQ ID NO: 4093 - protein, 156 aa, Lycopersicon esculentum
AHLEYVENLNVKEQLVAGTLYYITLVATDAGKKKIYETKIWVKEWEDFKKVVEFKLVGDDSPNPGGITNVPFPNLPQFKDLARFAVQDYNKKENAHLEFVENLNVKEQVVAGIIYYITLVATDAGKKKIYETKILVKGWENFKEVQEFKLVGDATK

SEQ ID NO: 4094 - protein, 471 aa, Lentinula edodes
MSDVVKKGSDDSSATVTSQVTDSPTIPDVDNYVAYTIKNTKALPPVTWSNLLNELNWLSVYILTIPPLVGFVGAFYVKLQWETAVWAVAYYFLTGLGITAGYHRLWAHRAFNASLPLQYVLAILGAGSLQGSIKWWSRGHRAHHRYTDTELDPYNAHKGFWFSHVGWMLVKPRRKPGVADVSDLRHNPVVKWQHKHYLSLILFMGFILPSIVAYVGWGDAKGGFIYAGVIRLVFVHHSTFCVNSLAHWLGETPFDDKHTPRDHMITAFVTIGEGYHNFHHQFPMDYRNAIKWYQYDPTKWTIWVLAKLGLASHLKVFPDNEVRKGQLTMELKKLRRTQDKLSWPSDSNDLPVISWESFTSQSEKRPLILISGFIHDVSDFIEEHPGGAHFVRNYIGKDATTAFFGGVYDHSNAAHNLLAMKRVGVLHGGSPHGLDDKRAIPPSQRLKIARYTELLSPGSSSAYSDGEDGLL

SEQ ID NO: 4095 - protein, 356 aa, Limnanthes douglasii
LRLSLYFPISISLSLSLEAMASFIATTTPAMPAFASVLDPKIPTKPEPKTETPKPKDDLERFRTSEVVLERKAKGFWRRKWNPRDIQNAVTLLVLHALAAMAPFYFSWDAFWISFILLGFASGVLGITLCFHRCLTHGGFKLPKLVEYFFAYCGSLALQGDPMEWVSNHRYHHQFVDTERDVHSPTQGFWFCHIGWVLDKDLFVEKRGGRRNNVNDLKKQAFYRFLQKTYMYHQLALIALLYYVGGFPYIVWGMGFRLVFMFHSTFAINSVCHKWGGRPWNTGDLSTNNMFVALCAFGEGWHNNHHAFEQSARHGLEWWEIDVTWYVIRTLQAIGLATNVKLPTEAQKQKLKAKSA

SEQ ID NO: 4096 - protein, 134 aa, Alcanivorax borkumensis
MRLVRKLDFPEMKFSLYFLGYLSEEEAGDVPKNDAQRLTFTFGREAMLELTHNWGSEEDPDFSYHDGNAEPQGFGHIGITVPDVYAAAERFEKMDVTFVKRPDDGKMKGLAFIKDPDGYWIEILQADMMEQQQS

SEQ ID NO: 4097 - protein, 106 aa, Triticum aestivum
DGELREYFPRPFCYIEVEMPFICRHLQEEHCFDTRNAVCPTCAENLGRDMSAHFRFQHSHLVKRRKTSRPSSSPWPAAAAPPAYDVNPYMMSSWPCPEPEPDPLVF

SEQ ID NO: 4098 - protein, 665 aa, Oryza sativa
MEEFELQQQPYYSKLLLGSPLEIANVDDSDLQLVAGVPSDPPPAPPTAVKKKKKRSLPGTPDPSAEVVALSPRTLLATNRFVCEICGKGFQRDQNLQLHRRGHNLPWKLRQRGGAGGGGGGEPPRKRVYVCPEASCVHHSPSRALGDLTGIKKHFCRKHGEKKWKCDRCGKRYAVHSDWKAHSKVCGTREYKCDCGTVFSRRDSFVTHRAFCDALAQENNKLAQPMNMAAVTSALQGQQQAHHPVADDDDAAGVKSPHLKMFPDVDNIVAAATAGNPLLPPPLSMAGCMLSSLAAPLSSPFLPGCKLGVDAARDAAMVFPPPPPPAGSAAAIMSATALLQKAAELGATTSTGCYGGVAFPAMGIAGGLDRLPAIGHHLAPYDDVVVPAALQGQTATQLVGFDLGGLLPGQLYGGGGGAMTRAIGSLMHGGDQHAALDHRACSKIPRFRMEDGGKHFVFVHGLGHGAWCWYRVVAALRAAGHRATALDMAAAGAHPARADEVGSLEEYSRPLLDAVAAAAPGERLVLVGHSLGGLSLALAMERFPDKVAAAVFLAACMPAAGKHMGITLEEDLTLATMLVRPGTNYIDDPIMKDETLLTEGNYGSVKRVFLVAMDDASSDEEMQRWTIDLSPGVEVEELAGADHMAMCSKPRELCDLLLRIAAKYD

SEQ ID NO: 4099 - protein, 203 aa, Thalictrum thalictroides
KRRNGLLKKAYELSVLCEAEVALVVFSNRGRLYEYANNSVRKTIDRYKKTCGEGSSTLTVSEANLLFYQQESSKMKQQIEILQNSNRHLMGEALSRLSIKELKQLESRLEKGLSRIRSKKNETLLAEIEYMQKREIELHNDNIYLREQITANERAQQHMNSLPGNVYEAITSAPHSSRDFFQVNLRDSKPNQYCSDATVLQLC

SEQ ID NO: 4100 - protein, 642 aa, Digitalis lanata
MTNESNHTDHNVTRASFNFSNGEKFVFGSATSAYQIEGCAMEFGKGLSVWDTWTLDKPGHIIDGTNGNVAANQYHLFKEDMKIMKRAGLEAYRFSISWPRILPGGKLSTGVNKEGIKYYNDLIDAIIAEGMQPYVTLFHWDLPLALELEYGGFLDKDKRIVEHFRDYAELCFWEFGDRVKHWITINEAWSYTVEGYVNGTCPPGRGASAPSDDMALQTAEILRNRTLSTILDAIGSQAIAELKDIEKLIYTLIPNNIKDLISKFHIEEFVKNIIPEVLKQKCPQLVDFIVDILQSFHVDYKRTGMARACSNGDPGTEPYIVAHNIILAHAAAVRLYKTKFQAYQGGKIGMTNNVTYYLPYDEKYHEDVEASKRGVDFMLYWFVEPIVTGKYPERMVKRVGKRLPCFTVEEEEMVRGSYDFLGVNYYTTYYAINLPIPPIAPPNYFSDMGVLSTPTRGGVPIGIQCGQGGWIYIYPRGLYLILIEMTNKFKDKNDQGPLIYITENGASENANTTFTVCEARYDPIRVLYHNDHLWYLKKAMEDGVNLKGYFIWSFADNFEWNAGYTSRFGIFYVDFVNGQYTRYPKSSALWWTNFLHDVQELKVPDTSNVTNKRSRNTEEENATAKKPKNTSVNSLGFLDNLD

SEQ ID NO: 4101 - protein, 1146 aa, Hordeum vulgare
MSSSRSNSRSACSRGSSARSRHSERVAQTPVDAQLHAEFESSHRHFDYSSSVSALNRSGASTSSAVSAFLQNMQRGRYIQPFGCLLAIHPESFALLAYSENAAEMLDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDGNLSQPISLCGSTMRAPHGCHAQYMANMGSIASLVMSVTVNEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSAPSEGEIKKIAAWLLECHDGSTGLSTDSLLEAGYPGASALGEVVCGMAAIKISSKGFIFWFRSHTAKEIKWSGAKHEPGDADDNGRRMHPRSSFRAFLEVVKWRSVPWEDVEMDAIHSLQLILRGSLQDEDANDNNVRSIVEAPSDDVRKIQGLLELRIVTNEMVRLIETATAPILAVDIVGSINGWNGKVAEITGLPTTEAIGMLLVDLVEGDSVEVIKQMLNSAMQGTEEQNFEIKLKTFHQQESNGPVVLMVNACCSRDLSDKVVGVCFVAQDLTGHKMVMDKYTQIQGDYVAIVKNPNELIPPIFMINDLGSCLEWNEAMQKITGIKREDAIDKLLIGEVFTLHDYGCRVKDQATITKLSILMNTVISGQEPEKLAFGFFSTDGKYMESLLTANKRTDAEGKITGALCFLHVPSPELQHALQVQKMSEQAAARSFKELTYIRQELKNPLNGMQFTRKLLEPSDLTEEQRQLFASNVLCQEQLKKILHDNDLEGIEQCYMEMNTVEFNLEEALNTVLMQGMSLSKEKQISLDRDWPVEVSSMYLYGDNLRLQQVLADYLACTLQFTRPAEGPIVLQVIPKKEHIGSGMQIAHLEFRVVHPAPGAPEALIQEMFRHGPGVSREGLGLHISQKLVKTMSGTVQYLREAESSSFIVLVEFPVAQLNSKRSKPSTSKWSKPSTSKSNF

SEQ ID NO: 4102 - protein, 373 aa, Nicotiana tabacum
MEAISGDQGVQSNFKGVPTHGGRYAQYNVYGNLFEVSKKYVPLRPVGRGAYGIVCAAMNSETREEVAIKKIGNAFDNRIDAKRTLREIKLLRHMDHDNVIATKDIIRPPQTENFNDVYIVYELMDTDLHQIIRSNQQLTDDHCRYFLYQILRGLKYIHSANVLHRDLKPSNLFLNANCDLKVGDFGLARTTSETDFMTEYVVTRWYRAPELLLNCSEYTAAIDIWSVGCILGEMMTRQPLFPGKDYVHQLKLITELIGSPDDASLGFLRSDNARRYVRQLPQYPRQQFAARFPNSSPGAVDLLEKMLVFDPSRRVTVDQALCHPYLAPLHDINEEPICPKPFSFDFEQPSFTEENIKELIWRESVKFNPDPTH

SEQ ID NO: 4103 - protein, 765 aa, Unknown
  Tolypothrix sp. PCC 7601
MLQLIYNNFIVSLSPENSPENAAIAPFEVDLTNCDREPIHIPGSIQPHGMLLALTEPELTIVQVSRNTDEILGVAATEFINQPLSRLLDAQQIDFFRNCLAQEDLTLVNPIELTIAVGENARAFDGIIHRSDRLLILELEPVLHQKNYTFFNFYHLVKAALSKVQNASTLDELCQIIVKHVRQMNGFDRVMIYRFDENWHGTVIAEDKSAHLSPYLSLRYPASDIPKQARQLYRDNWLRLIPDVDYQPVALLPHHNPVTNQPTDLSHSVLRSVSPLHIEYLHNMGVKASMSISLLKNQKLWGLIACHHESPKYVPYEIRSACEFLGQMTSLELAAKEDSENTEYKMQLKAVQSKLVEYMAAANNFVDGLIGQEPNLLDLVNATGAAVCINGEYQTLGRTPQHREIEQLINWLSQHTQEEVFHTNCLSELLPEASEWKDVASGLMALSISKSQKSYLLWFRPEALQTVDWAGNPHKPVELADDGSLRLSPRKSFDLWKEIVQRQSLPWESYEIEAVWNFRSAIVGVVLRKADELAKMNVELQRSNDELDAFAYIASHDLKEPLRGIHHYSSFLIEDYGNRLDDEGIGRLRTLIRLTQRMENLIDSLLHFSRLGRVELGIQPTDLNDLVQRVIDVLSARIQETGATIRIPRPLPTIMCDRVQVSAIFTNLIANGIKYNDKPEIWVEIGYLEPITLYVRDNGIGIRDRHFESIFRIFKRLHGPTQYGGGTGAGLTIAKKVVERHGGKIWVESTYGEGSTFYFTLQEVK

SEQ ID NO: 4104 - protein, 555 aa, Sulfolobus solfataricus
MDLSKLLVPIRVGDVVLKNRIAMSPMISNLGTPEGYPSDAHIAYLAERAKGGVGLIITEYTYVNHVDARGSVNELGMYSDELTPKFTRLTELIHALGSKIFVQLVHVGRKTRKDIIWGNKPIAPSPIPIMDEVREMTKEDIERVKNDFINAAIRAKRAGFDGIELHGAHGYLIAQFLSPATNKRGDEYKDGVKFVEEILKGIREKVRITVGIRISVTEFDNGGLTPEIVAEIGKRLEKAGIDYIHLSAGRDGPLGSSMPYYYKRTSFLEEAKVVRDTVKIPIFLVGSIITPQDAIKAREIADVVVLGRQLLADPYWLEKAKRDLPIRPCIRCNQSCRGVVYKEVRCDVNPELGWELLPPLEKGRGEVTVVGGGVMGLEAARVLALRGFAVTLYEQNNKLGGQFLLYRDPWKVNEFQALIDYYERELRRLNVEIKLNVKMECSDCIMAIPDYEIPKMPDVKGEKVLIDSNLYVYHDYAFELAKYNEVYMTERSFKGLDRTREYLLRKELSEVGVKFIEESNSIKFDVEIHDIVDDQPSIGKAIQRGYWLGRSFKSY

SEQ ID NO: 4105 - protein, 483 aa, Oryza sativa
  misc_feature (286)..(286): Xaa can be any naturally occurring amino acid
MAAPSVAVDNLNPKVLNCEYAVRGEIVIHAQRLQQQLQTQPGSLPFDEILYCNIGNPQSLGQKPVTFFREVIALCDHPCLLEKEETKSLFSADAISRATTILASIPGRATGAYSHSQGIKGLRDAIAAGIASRDGYPANADDIFLTDGASPGVHMMMQLLIRNEKDGILCPIPQYPLYSASIALHGGALVPYYLNESTGWGLEISDLKKQLEDSRLKGIDVRALVVINPGNPTGQVLAEENQRDIVKFCKNEGLVLLADEVYQENIYVDNKKFNSFKKIARSMGYXRDDLPLVSFQSVSKGYYGECGKRGGYMEITGFSAPVREQIYKVASVNLCSNITGQILASLVMNPPKAGDASYASYKAEKDGILQSLARRAKALENAFNSLEGITCNKTEGAMYLFPQLSLPQKAIDAAKAANKAPDAFYALRLLEATGIVVVPGSGFGQVPGTWHIRCTILPQEEKIPAIISRFKAFHEGFMAAYRD

SEQ ID NO: 4106 - protein, 612 aa, Chlamydomonas reinhardtii
MSSKRKATEAPAAGEDGAAGPSSKKQAAASASAAAAAAGAGSAAAGGALVNPKRVRVLKPGSIGKGPVVYWMSRDQRLADNWALLHAIEAAQGAAGSSQVAVAFNLVPAFLGAGARQFGFMLRGLRQLAPRLEARGIKFYLLKGDPAHTLPQLVSGLGAGLLVTDYSPLRLGRTWRDQVCSALGSVPVHEVDAHNVVPVWAASEKREVGARTLRPKIHKALPEFLREFPEVPTLPAWTPAVAPEAVDWDGLISEVLSRGADVPEVEWCTPGEEAALEALTGPRGFLSPARLSLYDTKRNDPATPSALSGLSPYLHFGQLAPQRAALEAAKHRAKYKAAVESYLEELVVRRELADNFCHYCPTYDSLEAAAEWARDSLDKHRTDKREFLYTRDQLECGATHDELWNAAQLEMVHVGKMHGFMRMYWAKKILEWTQGPEQAIEWAIYLNDRYELDGRDPGGYTGVLWSMAGVHDMGWAERAVFGKIRYMNYNGCKRKFDIKAYVAYVSKAVAEAKAKGRAAKLPSAAAAGASGAAAAGATAAAAAAAAPGPSGAQAAKAAKAKAEPKEAKPKAAKAAAKAKGPKDEKAAAAGAKRKAAKPAKSASSGEEGSDDE

SEQ ID NO: 4107 - protein, 468 aa, Zea mays
MALSTTNTNAAESQLHCSTFASRYVRTALPRFKIPEQSIPKEAAYQIINDELMLDGNPRLNLASFVTTWMEPECDKLIQSSINKNYVDMDEYPVTTELQNRCVNMIAHLFNAPIGDDETAVGVGTVGSSEAIMLAGLAFKRKWQNKMKAAGKPYDKPNIVTGANVQVCWEKFARYFEVELKEVKLKEGYYVMDPEKAAEMVDENTICVAAILGSTLNGEFEDVKLLSDLLTAKNAETGWLEWDFRLPLVKSINVSGHKYGLVYAGVGWVIWRSKEDLPDELIFHINYLGADQPTFTLNFSKGSSQIIAQYYQLIRLGFEGYKDVMQNCRDNAAVLREGINKMGYFDVVSKDSGVPLVAFSLKDSSKYTVFEVAESLRRFGWIVPAYTMPADAEHVAVMRVVIREDFSRGLAERLIADLGKTMADMDAHAGRKQAPEQPKKSVHDIEKEVTTFWRRLVANSKKKSSMVC

SEQ ID NO: 4108 - protein, 674 aa, Clostridium perfringens
MTLVEVKDDKLEIKPVRLRKEKYKTQLKNKIFNEDDLYLFHEGRNYNAYNFMGAHFTSENRKRGVRFTLWAPRAKNIFLVGDFSNWETKEENKLERINETGLWSIFIPRLKEGIKYKYYIEQEDGKAVLKADPYGIYSEVRPNTASILCEKTKIRWSDKKWLNKREETNYFESPINIYELHLGSWKRKDEDEFLSYDELSIILPKYIKEMGYTHVEFMPLNEHPLDASWGYQVTGYYSITSRYGDIKGLKRLINALHKEDIGVILDWVPGHFCKDEQGLYMFDGTPTYEYEEKWKADNKGWGTFNFDLGKPEVKSFLISNAFYFINEFHIDGLRVDAVSNMLYLNYGRNHGEWVPNIYGGNENLEAIQFIKELNEAIKTYSKGVITIAEESTSWPNVTNDTEYGGLGFDFKWNMGWMNDTLEYNELDPIYRKYHHNKLTFPMMYNHSEKFILPISHDEVVHGKKSLIDKMQGDYWNKLANLRAYMAYMYGHPGKKLMFMGCEFGQFIEWREYEELEWKLIDKFDMHRKTHNFFKDLNNFYKNNSELWELDYDQDGFQWIDADNNEQSIYIFIRKSKNIEKYKIFVCNFTPMVYYDFNIGVPEKGVYREIFNTDKEEYGGSGQVIKGNLFSRKGWCHNQQYTLTIKVPPMAVSVFERIIEENKTEEKIVKEDKYI

SEQ ID NO: 4109 - protein, 213 aa, Brassica rapa
MVRGKTQMKRIENATSRQVTFSKRRNGLLKKAFELSVLCDAEVSLIIFSPKAKLYEFASSNMQDTIDRYLRHTKDRVSTKPVSEENLQHLKHEAANMMKKIEQLEASKRKLLGEGIGSCSIEELQQIEQQLEKSVKCIRARKTQVFKVQIEQLKQKEKALAAENKKLTEKWGSHEIEVWSNKNQESGRGDEESSPSSEVETELFIGLPCSSRK

SEQ ID NO: 4110 - protein, 554 aa, Yersinia pestis
MCSIFGVLELKTDPIELRKKALEMSRLMRHRGPDWSGVWANDKAILAHERLSIVDVNTGAQPLYNAAHTHILAVNGEIYNHQALRQQYSDRYAFQTGSDCEVILALYQEKGPAFLDDLQGMFAFVLYDTEKDAYLIGRDHLGIIPLYMGHDEHGNMFVASEMKALVPVCRTIKEFPAGSYLWSQDGEIREYYHRDWFDYDHVKDNVTDKIQLANALEDAVKSHLMSDVPYGVLLSGGLDSSVISAITKKFAARRVEDNERSEAWWPQLHSFAVGLIGSPDLRAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKNFLDVAMRINPQDKMCGNGKMEKHILRECFESYLPHSVAWRQKEQFSDGVGYSWIDTLKEKAAEQVTDQQMETAHFRFPYNTPGSKEGYLYREIFEELFPLPSAAECVPGGPSVACSSAKAIEWDESFKNMDDPSGRAVGVHQDAYK

SEQ ID NO: 4111 - protein, 170 aa, Glycine max
IRLEEERDDTLRIQRLRKKFYFHFQDYVDLIIWKVQFLDRHHLLIKFGSVDGGVSRNADHHPAFVAVYNMDTTEIVSFYQNSPDELYLLFEQFCDHFHATSRNSMYMNFISSHSNNIHALEQLRSIKDKASSSAQFVKKMLASLPFSCQSQSPSPYFDQSLFRFDDKVYY

SEQ ID NO: 4112 - protein, 153 aa, Arabidopsis thaliana
MSMIPSFFNNNRRSNIFDPFSLDVWDPFKELTSSSLSRENSAIVNARVDWRETPEAHVFKADLPGLKKEEVKVEIEEDSVLKISGERHVEKEDKNDTWHRVERSSGQFTRRFRLPENVKMDQVKAAMENGVLTVTVPKAETKKADVKSIQISG

SEQ ID NO: 4113 - protein, 497 aa, Chlamydophila pecorum
LAEAVKVTLGPKGRHVVIDKSFGSPQVTKDGVSVAKEIELEDKHENMGAQMVKEVASKTADKAGDGTTTATVLAEAIYSEGLKNVTAGANPMDLKRGIDKAVKLVVDELKNISKPVQHHREIAQVATISANNDSEIGNLIAEAMEKVGKNGSITVEEAKGFETVLDVVEGMNFNRGYLSSYFSTNPETQECVLEDAHILIYDKKISGIKDFLPVLQQVAESGRPLLIIAEDIEGEALATLVVNRIRAGFRVCAVKAPGFGDRRKAVLEDIAILTGGQLVSEELGMKLENTTLAMLGKARKVIVTKEDTTIVEGLGNKADLEARCENIKKQIEDSTSDYDKEKLQERLAKLSGGVAVIRVGAATEIEMKEKKDRVDDAQHATLAAVEEGILPGGGTALIRCIPALESFLSTLTNEDEKIGARIILKSLSAPLKQIAVNAGKEGAIIYQQVLERSANEGYDALKDTYTDMIEAGILDPTKVTRSALESAALLPGLLLTT

SEQ ID NO: 4114 - protein, 444 aa, Glycine max
  misc_feature (130)..(130): Xaa can be any naturally occurring amino acid
MSGMKVAKGRILVGKYELGKTIGEGSFAKVKFARNVQNGNYVAIKILDRKHVLRLNMMEQLKKEISTMKLINHPNVVRIHEVLASKTKIYIVLELVDGGELFNKIAKNGKLKEDEARRYFHQLINAVDYXCHSRGVYHRDLQPENLLLDSNAILKVTDFGLSTYAQQEDELLRTACGTPNYVAPEVLNDRGYVGSTSDIWSCGVILFVLMAGYLPFDEPNHATLYQKIGRAQFTCPSWFSPEAKKLLKRILDPNPLTRIKIPELLEDEWFKKGYKPTTFVEEEDVNVDDVAAAFNDSKENLVTERKEKPVSMNAFELISRSQSFNLENLFEKQTQGIVKRETHFTSQRPANEIMSKIEEAAKPLGFNVHKRNYKMKLQGDKSGRKGHLSVATEVFEVAPSLHMVELRKTGGDTLEFHKFYKSFSSSSGLQDIVWHSEGKKNMKN

SEQ ID NO: 4115 - protein, 572 aa, Saccharomyces cerevisiae
MCGIFAAFKHEDIHNFKPKALQLSKKIRHRGPDWSGNAVMNSTIFVHERLAIVGLDSGAQPITSADGEYMLGVNGEIYNHIQLREMCSDYKFQTFSDCEPIIPLYLEHDIDAPKYLDGMFAFCLYDSKKDRIVAARDPIGVVTLYMGRSSQSPETVYFASELKCLTDVCDSIISFPPGHVYDSETDKITRYFTPDWLDEKRIPSTPVDYHAIRHSLEKAVRKRLMAEVPYGVLLSGGLDSSLIAAIAARETEKANADANEDNNVDEKQLAGIDDQGHLHTSGWSRLHSFAIGLPNAPDLQAARKVAKFIGSIHHEHTFTLQEGLDALDDVIYHLETYDVTTIRASTPMFLLSRKIKAQGVKMVLSGEGSDEIFGGYLYFAQAPSAAEFHTESVQRVKNLHLADCLRANKSTMAWGLEARVPFLDKDFLQLCMNIDPNEKMIKPKEGRIEKYILRKAFDTTDEPDVKPYLPEEILWRQKEQFSDGVGYSWIDGLRDTAERAISDAMFANPKADWGDDIPTTKEAYWYRLKFDAWFPQKTAADTVMRWIPKADWGCAEDPSSRYAKIHEKHVSA

SEQ ID NO: 4116 - protein, 686 aa, Colwellia psychrerythraea
MAQFDALFQPLKINQLTIRNRVVSTAHAEVYATEGGMTTERYVKYYEEKAKGGVGLSICGGSSVVSIDSPQDWWKSVNLSTDRIIPHFQNLADAVHKHGGKIMIQITHMGRRSRWDGGNWSTLVSPSGIREPVHRATCKTIEIEEMQRIVGDYAKAAGRAKAGGLDGIELSAVHQHLIDQFWSPRVNQRDDEYGGSFENRMRFGMEVLHAIREEVGRDFAVGLRICGDEFHPDGLNHEDMKQVAAYYDATGLLDFFSVIGSGCDTHNTLANVIPNMSYPPEPFLHLAAGIKEVVNVPVMHAQNIKDPNQAQRILEAGYVDFVGMTRAHIADPHLIAKIKLGQVDQIKQCVGANYCIDRQYQGLDVLCIQNAATSRESTMPHIIAKTEGKVRKVVVIGGGPAGMEAARVCAERGHDVTLIEKNPELGGQITIASKAPQRDQIAGITRWFALELDRLGIDLRLDTAADEAMIRSLNADVVILAVGGQPFLAQNPHWGVEEGLSVSTWDILSGKVAPGKNVLVYDTICEFSGLSAADFLAQNGSLVEMVTDDIKPGAAVGGTTFPTYYRNLYEKEVIMSSDLILEKVYREGDKLVAVLENEYTGQQEERVVDQVVIENGVRPDEEIYLQLKSDSRNKGQIDIEALYAALPQPMLSEEGEGYLLYRIGDCVSQRNTHAAIYDALRLCKDF

SEQ ID NO: 4117 - protein, 257 aa, Populus tomentosa
CQSIAGRMDWDNNQENHQDSHQNQRECRNGINGTNVNVNVNGNGGNNTLYVKVMTDEQLETLRKQIAVYAAICEQLVEMHKTLSAQQDLAGGRLGNLYCDPLMASGGHKITARQRWTPTPVQLQILERIFDQGNGTPSKQKIKEITSELSQHGQISETNVYNWFQNRRARSKRKQLVASSNNAESEVETEVDSLNEKKKPEIFHAQQNPPRAEDLCFQGPEISSELHFLGDDHLTGKMGVPGNYNLYDQAEDYGMAG

SEQ ID NO: 4118 - protein, 321 aa, Zea mays
PTRPITCGATPAMEILSWCGADPGNAFLVPSPYYPGWDRDIKWRTGVELIPVPCRSTDNFNVSVTALEIAYKQAKKRGIRVRGVLISNPSNPTGGIVPKEILHDLLQFAAEKNIHLISDEIFAGSTYGSDKFVSVADVVDELEDFDKGRVHIIYGLSKDLSLAGFRVGVIYSYNEHIVSAAAKIARFSSVSSPTQRLLVSMLSDQKFISEYIKVNRERLRKMYLLFSDALKQLGIECFKSSGGFYCWADMSRYIRSYSEKGERKLWDRLLEEAKVNVTPGSSCHCIEPGWFRCCFTTLSEEDIPVLVERLRRVTDSFKSKR

SEQ ID NO: 4119 - protein, 404 aa, Streptococcus thermophilus
MKTFDKSSKLEHVAYDIRGPVLDEANRMIAKGEKILRLNTGNPAEFGFTAPDEVIRDLIMNVRNSEGYSDSKGIFSARKAIMQYCQLKGFPNVDIDDIYIGNGVSEMIPMSMQALLDDGDEVLVPMPDYPLWTACVSLAGGNAVHYVCDEKSNWYPDIDDIKSKITSNTKAIVIINPNNPTGALYPKDVLEQIVDIARQNDLIIFADEIYDRLVMDGKKHIAIASLAPDVFCVSMNGLSKSHRICGFRVGWMVLSGPKKNVRGYIEGLDMLSNMRLCSNVLSQHVIQTSLGGYQSVDELLIPGGRIYEQREFITNTVNDIPGLTAVKPDAGLYIFPKIDRNMYDIDDDEEFCLRLLKKEKVLLVPGKGFNWNEPDHFRIVYLPRVEELADLGNKIERVLLYYKR

SEQ ID NO: 4120 - protein, 278 aa, Lactobacillus acidophilus
MEKFVTLNNGIKMPRLGFGVYQIDDLAQAQQVVEDGLEVGYRLVDTAQIYGNEQAVGDAIKHSNVPREDIFITSKIWVDDYGYDNTLKAFDDSMKKLQLDYIDLYLIHKPYNDYYGTWRALERLYQEGRIRAIGVSSFWNERLADLITFNDVKPAVNQIETNVWNQEWKSQQYMEKEGVQPEAWAPFAEGANHIFTNPLLEEIAEKHHKTTAQVMLRWFLQRNYVVIPKSVHKKRLAENYDVFDFELDADDMKKIKTLDQGHSILEDEMDPEIAESFR

SEQ ID NO: 4121 - protein, 346 aa, Zea mays
  misc_feature (124)..(124): Xaa can be any naturally occurring amino acid
FFTTLDSQLSYGGPKPANCRSVARYLSRDLPYELSPDDVYLTNGGAQAIEIVCSALARPGANILLPRPGYKLYEARAVFSGMEARYFDLVPGEGWEVDTDGVRALADKNTVAVVIINPGNPCGXETARKLGVFVVADEAYAHLTFGERRFVPMGVFGAVAPVITLGSISKRWLVPGWRLGWIATSDPSGVFQRTKVASSIKTYHYICSDPTTFVQGAVPNLLENTSEEFFRRNIRTLKESADMCWEKLKGVNGIACPSRPMGSMFVMVKLDLSCLQGIEDDMDFCCRLAKEESVVVLPGRVVGCEDWLRITFAIDPSSLEDGLDRLRSFCSRHSKPAAQGSAASVV

SEQ ID NO: 4122 - protein, 475 aa, Solanum tuberosum
TTNSGAPVWNNNSSLTVGARGPVLLEDYHLVEKLANFDRERIAERVVHARGASAKGFFEVTHDIAHLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLHMFTFLFDDIGIPQDYRHMDGSGVHTFTLINRAGKSTYVKFHWKPTCGVKSLLEEEAIRVGGANHSHATQDLYDSIAAGNYPEWKLFIQIMDPDHEDKFDFDPLDVTKTWPEDILPLQPVGRLVLNKNIDNFFNENEQLAFCPSIVVPGVYYSDDKMLQTRIFSYSDTQRYRLGPNYLQLPANAPKCAHHNNHYDGSMNFMHRDEEIDYFPSRYDQVRHAEVYPIPSTVCSGKREKCIIQKENNFKQPGERYRTFTPDRQERFIRRWVEALSDPRITYEIRSIWISYWSQADKSLGQKLASRLNVRPSI

SEQ ID NO: 4123 - protein, 497 aa, Chlamydophila abortus
LAEAVKVTLGPKGRHVVIDKSFGSPQVTKDGVTVAKEIELEDKHENMGAQMVKEVASKTADKAGDGTTTATVLAEAIYSEGLRNVTAGANPMDLKRGIDKAVKVVVDQIKKISKPVQHHKEIAQVATISANNDAEIGNLIAEAMEKVGKNGSITVEEAKGFETVLDVVEGMNFNRGYLSSYFTTNPETQECVLEEALVLIYDKKISGIKDFLPVLQQVAESGRPLLIIAEDIEGEALATLVVNRLRAGFRVCAVKAPGFGDRRKAMLEDIAILTGGQLISEELGMKLENTTLSMLGKAKKVIVSKEDTTIVEGLGNKEDIEARCENIKKQIEDSTSDYDKEKLQERLAKLSGGIAVIRVGAATEIEMKEKKDRVDDAQHATLAAVEEGILPGGGTALVRCIPTLEAFIPVLTNEDEQIGARIVLKALSAPLKQIAANAGKEGAIICQQVLARSSNEGYDALRDAYTDMIEAGILDPTKVTRCALESAASVAGLLLTT

SEQ ID NO: 4124 - protein, 492 aa, Triticum aestivum
MDPYKYRPSSSFNAPMWSTNSGAPVWNNDNSLTVGSRGPILLEDYHLVEKIADFDRERIPERVVHARGATAKGFFEVTHDVSHLTCADFLRAPGVQTPVIVRFSTVIHERGSPETLRDPRGFAIKFYTREGNWDLVGNNFPVFFIRDGMKFPDMVHALKPNPKTHIQENWRILDFFSHHPESLHMFTFLFDDIGVPADYRHMDGSGVNTYTLVNRAGKAHYVKFHWKPTCGVKSLLEEEAVTVGGTNHSHATKDLTDSIAAGNYPEWTFYIQTIDPDYEERFDFDPLDVTKTWPEDVVPLQPVGRLVLNRNIDNFFSENEQLAFCPGIIVPGVYYSDDKLLQTRIFSYSDTQRHRLGPNYLLLPANAPKCSHHNNHYDGLMNFMHRDEEVDYFPSRFDPAKHAPRYPIPSRTLNGRREKMVIEKENNFKQPGERYRSMDPARQERFINRWIDALSDPRLTHEIKAIWLSYWSQADKSLGQKLASRLSSKPSM

SEQ ID NO: 4125 - protein, 512 aa, Arabidopsis thaliana
MDHSSNRFGNNGVESILPNYKLGKTLGIGSFGKVKIAEHVVTGHKVAIKILNRRKIKNMEMEEKVRREIKILRLFMHPHIIRQYEVIETTSDIYVVMEYVKSGELFDYIVEKGRLQEDEARNFFQQIISGVEYCHRNMVVHRDLKPENLLLDSRCNIKIADFGLSNVMRDGHFLKTSCGSPNYAAPEVISGKLYAGPEVDVWSCGVILYALLCGTLPFDDENIPNLFKKIKGGIYTLPSHLSSEARDLIPRMLIVDPVKRITIPEIRQHRWFQTHLPRYLAVSPPDTVEQTKKINEEIVQEVVNMGFDRNQVLESLRNRTQNDATVTYYLLLDNRFRVPSGYLESEFQETTDSGSNPMRTPEAGASPVGHWIPAHVDHYGLGARSQVPVDRKWALGLQSHAHPREIMNEVLKALQELNVCWKKIGHYNMKCRWVPGLADGQNTMVNNQLHFRDESSIIEDDCAMTSPTVIKFELQLYKAREEKYLLDIQRVNGPQFLFLDLCAAFLTELRVI

SEQ ID NO: 4126 - protein, 497 aa, Chlamydophila pneumoniae
LAEAVKVTLGPKGRHVVIDKSFGSPQVTKDGVTVAKEIELEDKHENMGAQMVKEVASKTADKAGDGTTTATVLAEAIYSEGLRNVTAGANPMDLKRGIDKAVKVVVDELKKISKPVQHHKEIAQVATISANNDSEIGNLIAEAMEKVGKNGSITVEEAKGFETVLDVVEGMNFNRGYLSSYFSTNPETQECVLEDALILIYDKKISGIKDFLPVLQQVAESGRPLLIIAEEIEGEALATLVVNRLRAGFRVCAVKAPGFGDRRKAMLEDIAILTGGQLVSEELGMKLENTTLAMLGKAKKVIVTKEDTTIVEGLGNKPDIQARCDNIKKQIEDSTSDYDKEKLQERLAKLSGGVAVIRVGAATEIEMKEKKDRVDDAQHATIAAVEEGILPGGGTALVRCIPTLEAFLPMLANEDEAIGTRIILKALTAPLKQIASNAGKEGAIICQQVLARSANEGYDALRDAYTDMIDAGILDPTKVTRSALESAASIAGLLLTT

SEQ ID NO: 4127 - protein, 342 aa, Bordetella bronchiseptica
MNLLSPIDIAGIALRNRIAVAPMSRTQADAHGHPAAETAAYYARYARHGAGLVITEALYTAGPAARAYFNQPGLASEAQAEHWRATVRAVHQEGGRVIAQLQHAGKLAEPGLHARPLGPVDGAAQGLSWQTQQPNAPAHAATAEEIERIIEGFALSARLAHYAGFDGVEIHGARGYLVNDFLSAYNVRDDEWGADRARIAEAVLRAVRQSCPLPIGFNYSIYKMDEYRYQPPGGGAEIAALLARLCQAGADILHISSRRVLKPEPWGGLLAQLARAAAPKALMVNGGLATLQDCETALAATQADLVSLARPFLANPDWLARSLAGEPLRAYEPGMEQRPLLD

SEQ ID NO: 4128 - protein, 281 aa, Physcomitrella patens
MGRGKIEIKKIENTTSRQVTFSKRRGGLLKKAHELAVLCDAEVALVIFSSTGKHFEFASSGSMRDIIERYRKNSDGAVKRGTNTDLLGREVIKLKQQVERLESSQRHMLGEDLSALKVSDLLELEQQLDQGASRVRARKNQLILEEIEDLRRKEHELMIANEALRKKIADAEGAAEAAARANFPDARLESPKPFASDFSRDMSVSSQLAASVYPHPNLLQAQRSQTSLQLGRLSEQQIPSTEEGCAGESSLKWDHPHFHIPNRLHANISPSVRTYKLHVDR

SEQ ID NO: 4129 - protein, 408 aa, Saccharomyces cerevisiae
MSNDEGETFATEQTTQQVFQKLGSNMENRVCFDCGNKNPTWTSVPFGVMLCIQCSAVHRNMGVHITFVKSSTLDKWTINNLRRFKLGGNHKARDFFLKNNGKQLLNTANVDAKTKYTSPVAKKYKIHLDKKVQKDMELYPSELVLNGQDSSDSPLDTDSDASRSTSKENSVDDFFSNWQKPSSNSSSKLNVNTGSLAPKNNTTGSTPKTTVTKTRSSILTACRKKPVLNSQDKKKHSILSSSRKPTRLTAKKVDKSQAEDLFDQFKKEAQQEKEDEFTNSSSSTKIRQNDYDSQFMNNSKGNNNNSIDDINTQPDEFNDFLNDTSNSFDTTRKEQQDTLTPKFAKLGFGMTMNDANDLAKQQKESQKIAQGPRYTGRIAERYGTQKAISSDQLFGRGSFDEAANRGSA

SEQ ID NO: 4130 - protein, 496 aa, Listeria monocytogenes
MEESPQNEPNKVEKDEEQKSKPGNGYIKMKLFPFIMLLFAFVFVTALVTTIVMSLGDDKQVKVSIPERKEFTKLYDVYDEITSKYYKDTNSTTMIDGAISGMVNSLDDPYSTFMSKKESSEFNDTISASFEGIGAEIQEKDGAIVIVSPIKNSPAEKAGLRPQDIITQVDGKSVKGDTATEATQKIRGEKGTKVTLTIQRSNEDKPFDVTITRDEIPIETVYKEMGSDKIAHVTISTFSETTYDELEKALKSLEKDGMKGLVLDLRGNPGGLLDQAVSISSLFVPDGKIVVQEQDKDGDKSAIKADSSSHGDYKVKVPTTMLIDGGSASASEILAAAAKESGGIKLVGTKSFGKGTVQTATTLSDDSTLKLTVAKWLTPNSEWIHEKGITPDVVVNMPDYATMTIPSSTKVYKNGDFGDDVKTIETLLKALDYNVGKVDGLYDTDTEYAVQRFQTANKLDVTGIMTGVTTDKLVELTQKHLKETDPQLQKAKALVK

SEQ ID NO: 4131 - protein, 373 aa, Yarrowia lipolytica
MAPALFSPINVGDTHLLNRVVMAPLTRFRADEGGVPSDLQKDYYVQRSQTPGTLLVAEATYVSPGAGGMKTFGGHVPGLWNEAQIAGWKKVIDAVHAKGCKFYIQLWDLGRTANQQVLEKEGLPFTGPSAIPQKGDKFGDKIRALTVPEIKQKIKDYATAAENAIKAGADGVEIHSANGYLPDQFIHWNSNHRTDEYGGSIENRCRFSLEIVDAISASIGSDKLAIRLSPWTDVQDVEVDQVNTLPTFEYIFRQLQKRADNGQKLAYVHLIEPRVNGTKTKREDIAWQTNEPFRKIWKGPLVRAGGFTRETALEAAASDPLTLVAFGRFFISTPDLVERLEKDEKLNPYNRKTFYSSGPVGYIDYPTYEKAKL

SEQ ID NO: 4132 - protein, 265 aa, Triticum aestivum
VIHRTSLYKKAGWYRSGIPGISSTHASDFGLSNVMRDGHFLKTSCGSPNYAAPEVISGKLYAGPEVDVWSCGVILYALLCGTLPFDDENIPNLFKKIKGGIYTLPSHLSGPARDLIPRMLVVDPMKRITIREIREHPWFEAQLPRYLAVPPPDTAQQVKKIDEESLVKVISLGFDKNLLVESIHNRLQNEATVAYYLFLDNKSRTTTGYLGAGYQEAMESSFSPITPSETQSPAHGNRQQPYMESPVGLRPHFPADRKWALGLQS

SEQ ID NO: 4133 - protein, 177 aa, Arabidopsis thaliana
  misc_feature (44)..(44): Xaa can be any naturally occurring amino acid
PAKDPGLSTNRDEATRGYIMQQTMFRIKDPKAPLHFYSRVRGMXLLKRLDFSEMKFRLYFLGYEDTTTAPTDPTERTVWTFGQPATIELTEKWGTESDPECGGYHNGHSHPRGFGHIGVTVDHVHKACERFEELGVEFAKKPNDGKMKNIAFIKDPHRYWIEIFDLKTIGTTTVNAA

SEQ ID NO: 4134 - protein, 610 aa, Arabidopsis thaliana
MDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVSSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSKRVKPEEEEERDMKKSRGFDERELFSTAESSSSSSVFFVSQSCSLASEGKNLEGIQDSSDQITTSLGKNGCK

SEQ ID NO: 4135 - protein, 261 aa, Triticum aestivum
MSSSAMEALHALIPEQHQLDVEAAAAVSSATSGEESGHVLQGWAKRKRSRRQRSEEENLALCLLMLSRGGKQRVQAPQPESFAAPVPAEFKCSVCGKSFSSYQALGGHKTSHRVKQPSPPSDAAAAPLVALPAVAAILPSAEPATSSTAASSDGATNRVHRCSICQKEFPTGQALGGHKRKHYDGGVGAAASSTELLAAAAAESEVGSTGNGSSAARAFDLNIPAVPEFVWRPCAKGKMMWEDDEEVQSPLAFKKPRLLTA

SEQ ID NO: 4136 - protein, 160 aa, Xylella fastidiosa
MNVVRYTPWPGQAALQNEIKQVFDRFFEHNGDTDESAVVTAQWVPRVDIKEEPNQFVLYADLPGIDPADIEVQMDKGILSIKGERKTESSSQTEHFSRIERRYGSFHRRFALPDSADADGITASGSHGVLSIFIPKRAATTPRRIQVGNAVSNDVALQSM

SEQ ID NO: 4137 - protein, 635 aa, Pisum sativum
MMESCECIDTPYPPDELLVKYQYISDVLIALAYFSIPVELIYFVQKSAFFPYRWVLMQFGAFIVLCGATHFINLWTFSAHSKAVAVVMTIAKVSCAIVSCATALMLVHIIPDLLSVKTRELFLKNKAEELDREMGLILTQEETGRHVRMLTHEIRSTLDRHTILKTTLVELGRTLGLEECALWMPSRSGLNLQLSHTLTYHVQVGSTVPTNLPIVNEVFNSPRATRIPHTCPLARIRPLVGRYVPPEVVAVRVPLLHLSNFQINDWPDLSAKSFAIMVLILPTDSARKWRDHELELVDVVADQVAVALSHAAILEESMRARDQLMEQNVALDLARREAEMAIHARNDFLAVMNHEMRTPMHAIIALSSLLLETELTPEQRVMIETVLKSSNVLAALINDVLDLSRLEDGSLELEMGKINFHGVLEEVIELIKPIASVKKLPITLILAPDLPDNAIGDEKRLMQTLLNVVGNAVKYTKEGYVSIRASVAKPESLQDWRPPEFYPASSDGHFYIRVQVKDSGCGILPQDIPHLFTKFTQSQSGAGRSSSGSGLGLAICKRFVNLMGGHIWMESEGPDKGSTATFVVKLGICGNPDSSDHQATTRGQAYSGSGGLARFKHLVNDGDIGFSNRRNQRSF

SEQ ID NO: 4138 - protein, 341 aa, Glycine max
FGSRDHSADAQRTDLMTITRFVLNQQSNHPESRGDFSILLSHIVLGCKFLCSAVNKAGLAKLIGLAGETNVQGEEQKKLDVLSNDVFIKALVSSGRTCILVSEEDEEATFVEASKRGKYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 4139 - protein, 396 aa, Zea mays
  misc_feature (55)..(55): Xaa can be any naturally occurring amino acid
MPNGGGKRWLLLLPLSRWVLLLGSLQLPAVGGSGHVVTRMRGFDGPLPFYLETGXYVEVDEQQGVQLFYYFVRSERDPYEDPLLLWLSGGPGCSGISGLAYEIGPLKFDARGQGEFPTLLYRPETWTKVSNIIFVDSPVGTGFSYAKSEEGLETGDTKQVKQLVIFLRKWLQDHPRFVMNPLYIAGDSYSGLIIPTLALVAWARPRYIAGNPLTGGQFDTDSQIPYFHAMGLVSDELYKNARENCGGKYSAPLNAVCAEAVQAINNCTRDINKQYILDPACPDDDLLSPKTVAETDGTSRLMLESADFLLGSKSLYILSYAWGNDDTVQESLGIRKGTIGAWKRYSHALPYNYDIESAVDYHSRLATKGYRALIYSGDHDAVVPPRPAAPSWAGSM

SEQ ID NO: 4140 - protein, 147 aa, Deschampsia antarctica
QIFMGLMVNPPKPGDISYLKYATESKSILESLRRRAQIMTDGFNSCRNVVCNFTEGAMYSFPQIRLPQRAMDTAKSAGKAPDVFYCLMLLEATGISTVPGSGFGQKEGVFHLRTTILPAEEDMPAIMSSFKKFNDSFMEQYQDYSKL

SEQ ID NO: 4141 - protein, 310 aa, Zygosaccharomyces rouxii
MVTLQNSTSTLKLNTGQTIPQVGLGTWRSKENEGYKAVIEALKAGYRHIDGAAVYGNEGEVGKAIQDSGVPRNEIFLTTKLWCTQQRNPQEALDQSLQRLGLDYVDLYLIHWPVPLRTENIKDGNLFQFAEKPDGSKDVDLEWNFIKTWELMQKLLESGKTKAIGVSNFSVNNLKDLLAAPTTKVTPAVNQVELHPLLPQEDLIKFGKENGIVIEAYSPLGGENAPILSDPTVQEIAKANGVEAGHVVISWAVQKGLVTLPKSVTPSRIVGNLKVLTLSDSDVAKVDGLLKAKGERRTCYQDFSPFPIFQ

SEQ ID NO: 4142 - protein, 660 aa, Prosthecochloris aestuarii
MAPLKPTPVQEEAEKYISSYLRQHHFRRVSVNDSLSQEILSRYLDEIDNAKTYFLASDIERFKTKYGDILDDQFLVGKADAGFAIYNRFLEQARKKMKFVISLLDTARFDYSLIETFDLKRDDAPWPTDQKELHRLWRQEVKYQLLNMKYSGEEADSSALVLSKRYTNRLSLLDQQNAEDAFRVFSNAITTSFDPHTSYFSPMDFENFQIDMSRSLEGIGAKLQIENEYTMVNEVIPGGPAFKSKLLNKGDKIIGVGQGARGEIVDIVGWRINDVVHLIRGKKGSLVRLKILPVSQGGKGPSKIIQIVRDEVTLEEQSAQKSIVERDGRKIGLITVPAFYLDFEGQKHNRPDYKSTSRDVRKIIEELKLEGVQGIILDLRNNGGGALEEAVKLTGLFIADGPVVQIRNSQGGKLVLRDEEPDVLYSGPLAVLVNRYSASASEILAAAIQDYGRGIVIGGRTFGKGTVQSILNITRPFNFFYKSDDLGQLKLTVAKFYRITGESTQHLGVTPDLVFPSFIDSEVVGEDTYPSSLPWDKISPSDYDRSSNLSDESIERLRQRYLGRLATDSLYTGYVKDLNALKIFRKKDVVSLYEPAFKAEFEKVKNFEANWSRDEEEAENTADDKPDLMVLHAASVVGDMAVGAGQIPRGAASAPWHSQQ

SEQ ID NO: 4143 - protein, 622 aa, Streptococcus agalactiae
MSNKDELYTFGIGENFHLQNYLGVHSENESFCFRVWAPNAENVQVIGDFTDWRNRPLQMNKNQAGVWEANSLDAREGDLYKYLVTRKGGQVVEKIDPMAVYMERRPGTASVIKVLRNKKWEDGLWMGRRKRLGFQKRPINIYEVHAGSWKKDDFGHPMTFSQLKDYLIPYLVEMNYTHVEFMPLMAHPLDMSWGYQLMGYFAFEHTYGTPEEFQDFVEACHKNNIGVLVDWVPGHFIQNDDALAYFDGTATYEYQNHDRAHNYRWGALNFDLGKNQVQSFLISSALFWIEHYHIDGIRVDAVSNMLYLDYDEGPWEANQFGDNRNLEGYYFLRKLNKVIKERHPNVMMIAEESTASTPITKDLESGGLGFDFKWNMGWMNDILRFYEEDPLYRQYDFNLVTFSFMYIFNENFVLAFSHDEVVHGKKSMMHKMWGDRYNQFAGLRNLYAYQMCHPGKKLLFMGSEFGQFLEWKYNDQLEWENLNDDMNQKMQRYTKQLNQFYKDHKCLWRIDDSFDGIEIIDADNKSETVLSFIRKDDKGDLLLCVFNMTPVERPNFTIGVPQAGIYEEVLNTEMEEFGGVWKNHNPVTKTQVATWKDYDHTLSFTLPALGASVWRIKRRLRK

SEQ ID NO: 4144 - protein, 561 aa, Oryza sativa
MELAMDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKISWLSLHNYYSLTDMIMLQNCTKMFKQVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 4145 - protein, 280 aa, Streptococcus agalactiae
METYTLSNTLNIPKIGFGTWQLTEGEEAYKAVTHALKVGYTHIDTAQIYGNEHSVGRAIRDSGLARESIFLTTKIWNDKHDYHLAKASIDESLQKLGVDYIDLLLIHWPNPKALRENDAWKAGNAGTWKAMEEAYKEGKVKAIGVSNFMKHHLEALFETAEIKPMVNQIILAPGCAQEDLVRFCKGNDILLEAYSPFGTGAIFENESIKAIAEKYGKSVAQVALRWSLDNGFLPLPKSATPKNIEANLDIFDFQLNEDDITTLIQLDSGIKPKDPDNVSF

SEQ ID NO: 4146 - protein, 606 aa, Zea mays
MCGILAVLGCADEAKGSSKRSRVLELSRRLKHRGPDWSGLRQVGDCYLSHQRLAIIDPASGDQPLYNEDQSVVVAVNGEIYNHLDLRSRLAGAGHSFRTGSDCEVIAHLYEEHGEEFVDMLDGVFSFVLLDTRHGDRAGSSFFMAARDAIGVTPLYIGWGVDGSVWISSEMKALHDECEHFEIFPPGHLYSSNTGGFSRWYNPPWYDDDDDEEAVVTPSVPYDPLALRKAFEKAVVKRLMTDVPFGVLLSGGLDSSLVATVAVRHLARTEAARRWGTKLHSFCVGLEGSPDLKAAREVAEYLGTLHHEFHFTVQDGIDAIEDVIYHTETYDVTTIRASTPMFLMSRKIKSLGVKMVISGEGSDELFGGYLYFHKAPNKEELHRETCRKVKALHQYDCLRANKATSAWGLEARVPFLDKEFINAAMSIDPEWKMVQPDLGRIEKWVLRKAFDDEEQPFLPKHILYRQKEQFSDGVGYSWIDGLKAHATSNVTDKMLSNAKFIFPHNTPTTKEAYYYRMVFERFFPQKSAILTVPGGPSVACSTAKAIEWDAQWSGNLDPSGRAALGVHLAAYEHQHDPEHVPAAIAAGSGKKPRTIRVAPPGVAIEG

SEQ ID NO: 4147 - protein, 130 aa, Streptococcus agalactiae
MPFLHTCIRVKDLDASIAFYQEALGFKEVRRNDFPENQFTLVYMALEDDPSYELELTYNYDHEAYDLGNGYGHIAVGVDDLETTYDAHQKAGYSVTKISGLPGKPNMFYFIQDPDGYKIEVIRLSQFKAD

SEQ ID NO: 4148 - protein, 444 aa, Unknown
  Silicibacter sp. TM1040
MTDFTFTRRDFPGDFLFGCATSSYQIEGHQYGGAGPTHWDSFAATPGNVVRSEDGARACDHYHRFEEDLDLAAAAGFECYRFSTSWARVLPEGRGTPNAEGLDFYDRLTDAMLERGLKPCATLYHWELPQPLADMGGWRNRDVSNWFAEFTEVIMSRIGDRMYSVAPINEPWCVGWLSHFLGHHAPGLRDIRATARAMHHVLLSHGRAIEVMRGLGMNNLGAVFNFEWAEPLDQSAQAQAAAETYDAIYNRFFLGGVFKGAYPEAALRGLEPHLPQGWQDDFATITQKVDWCGLNYYTRKVIGPDNGPWPHYAELVGELPTTQMGWEIYPDGLYKFLKRTAEDYTGGLPLIVTENGMANPDVLLEGEVPDAARIAYVEAHLARVRQAIAEGVPVKGYFLWSLLDNYEWALGYEKRFGLVHVDFETLKRTPKASYRALQRALTAS

SEQ ID NO: 4149 - protein, 531 aa, Propionibacterium acnes
MAAKQLQFDEEARRSLERGVDTLADTVKVTLGPKGRYVVLDKKWGAPTITNDGVTVAKEVDLTDPYENLGAQLAKEVATKTNDVAGDGTTTATVLAQALVHEGLRAVASGANPVGLKRGIEKAVDAVVEELRSISRAIDTTSDMASVATISSRDETIGALIAEAFDKVGKDGVITVDESQTFGTELDFTEGMQFDKGYLSPYMVTDQDRMEAVIEDPYILIHSGKISSMNDLLPLLEKVIAAHGSLFIVAEDVDGEALSTLVVNKIRGTFSSVAVKAPAFGDRRKAMLQDIATLTGGQVVAPEVGLKLDQVGLEVLGRAKKVVVTKDNTTIVDGAGDKADVEGRVIQLRAEYDNSDSEWDREKLQERIAKLAGGVCVIRVGAATEVELNEKKHRIEDAVSATRAAIEEGIVAGGGSALIHAAHVLDGDLHLEGDEKAGVQIVAKAVREPLRWIAENGGEPGYVIVSKVAEMEPGHGYNGKTGQYVDLIADGVIDPLKVTRSALANAASIASLLLTTETLVVDKPEEDNEDK

SEQ ID NO: 4150 - protein, 610 aa, Wolinella succinogenes
MCGIAGTLNSSCFSSKKLLAALAHRGPSGHGEFSHQGVNLFHARLSIQDLSPAGAQPMHRHHLSIVFNGEIYNHLELRAKVADYPFSTRSDTETILALFERFGERSLEWMDGMFALAILDQRTHKLFLARDRMGKKPLFYYQEGEEFLFASELNALLTLKPLQIDHAKLSAFLRCGFFPHDGAPYQGVQSLPQGSYAFIDLHHPRPLSPQRYFDLLSLYQAPKIEGFEASKEAVELALKESVKNRLESSDLEVGSFLSGGIDSSLITALASFFTPKLKTFTVAFEGAYDESSLAELVAKRYKTDHTTLHLNPSKLKEEVKGILACYGRPFMDSSAIPSYYVSQEAKKHLTVILNGDGADELFGGYRRYVPMSHGWLKLARPLSLLLPLLPLPKEKKSLYNYLHRLLAMSRKRGLDFYLSATIDSFEDAYAFSPNPHTQTLDQEITQILEDSSLSSLSKMLYLDSQNLLLSDLLPKMDIATMAHSLEGRSPFLGKSLLEVAPRIKDEYKIFGKSTKFILRELAKKYLPHALLEQPKRGFEVPLRAWVEGELKELIFDSLSKNCLSRELIESRFVDALLDKPQDFAPEKRAKMLWSLFSLEVWHEHYQKACE

SEQ ID NO: 4151 - protein, 279 aa, Glycine max
  misc_feature (231)..(232): Xaa can be any naturally occurring amino acid
MENRTSSVLPPGFRFHPTDEELIVYYLCNQATSRPCPASIIPEVDIYKFDPWELPEKTDFGEKEWYFFSPRERKYPNGVRPNRATVSGYWKATGTDKAIYSGSKHVGVKKALVFYKGKPPKGLKTDWIMHEYRLIGSRRQANRQVGSMRLDDWVLCRIYKKKNIGKSMEAKEEYPIAQINLTPANNDSEQEMVKFPRTSSLTHLLEMDSLGPISHILSDATYNSPFDFQIXXANGGIDPFVKPHPVEIPYAADSGKYQVKQNSTINPTIFVNQVYYQRG

SEQ ID NO: 4152 - protein, 618 aa, Wolinella succinogenes
MCGIVGYSQNHPQAIQEMLQSIRHRGPDDLGIYCDEGFSLGHTRLSILDLSHAGHQPMEFEHLVIVFNGEVYNFRAIQKELLGLGYTFFSDSDTEVILKAMHCWGEKAVDKFIGMFAFALWDKRKEELLLYRDRVGVKPLYYYFEGGELLFASELRAITAIKPNLALSQAGLYEYFQFGYISSNLSIHQAIHKLPAGHYLRFKAGKIEVKPYWSIHTFLEMPPFEKSEEELIDELEELLVDAFKLRMVADVPVGVFLSGGIDSSLVAAILQKHHGHIHTFTIGFENPRYNEALYAKGVAEHLGTEHTERILSAEEAREILYRFPEVYDEPFGDSSGIPTLLVSKVAKESGVKVVLSADGGDEIFCGYERYPIAHSLSRKILSLPYPLRAFAGRAMESFGAKRAGYLFKVRNLEHKFNQLSEMLRAKDLEEFYELLVHNSKNYEIKELLGETFPPKSRAFKVGERIHPMQGMMSWDYERYMVDDILVKVDRATMFHSIEGREPLLDHRIAEFAARLPFNMKFREGKTKYILRKVLERYLPKEMIERPKMGFGIPMFEWFSQDLRSLFETHFTPERLKSSGVLNPSYVLRELGKLQRGEPVNVNKLWLILVFLMWQEKAR

SEQ ID NO: 4153 - protein, 413 aa, Nicotiana tabacum
MPEKPLFGKYELGKLLGCGASAKVYHAREINNGQSVAIKMINKNNKDNIPNENIEREISILRQLRHPYIVKLYEVLATKSKIYFVMEYVKGGELFTKIADHGRFSEDLSRKYFQQLISALNYCHSRGIYHRDLKPENILIDENGDLKISDFGLSATTDQIQKFDGLLHTVCGSPAYVAPEILTIKGYDGAKTDIWSCGIILYVMIAGYLPFYDQNLMLMYKKIYKGEFKCPKWMSPDVIRILSRLLDTNPATRITIDEIIKDPWFRKGLKFIKFAGEEEDKYSLSSNCLNAFDLISFSQGLDISGLFKSNNPANDLERTVVEQSPESVIERVEEMAKKENFRLRKKKEWGIEMKVQNGKLTMSVDIYRLTERFVIVEVKREAGNGDLYTDLWRNKLKAVILGQQIAEIQDSGS

SEQ ID NO: 4154 - protein, 674 aa, Unknown
  Burkholderia sp. 383
MTSRYPHLTTPLELGFTSLRNRVLMGSMHVGLEEAPNGFERMAAFYAERARGEAGLIVTGGFAPNERGRPAPGGAMLTTEAEAERHRVVTRAVHAEGGKIALQILHFGRYAYHPALAAPSALKAPINPFTPHALSSDEVDETIADFVRCAALAQHAGYDGVEIMGSEGYLINEFIAARTNHRDDAWGGAYENRIRFPVEIVRRVRERVGTNFILIYRLSMLDLVEGGSTLDEVIRLAQAIEAAGATIINTGIGWHEARIPTIATKVPRAAYAWVTRQLMGQVGIPLVATNRINTPEVAEQLLADGYCDMVSMARPFLADAEFVRKAREGRADEINTCIGCNQACLDHTFSGRITSCLVNPRACHETELVIRPAQQRKRIAVVGAGPAGLGFAVTAAERGHAVTLYEAGAEIGGQFNIAKKVPGKEEFNETLRYFRRQIELRGVTLHLNTRATAEMLVQGEFDEVVIATGIVPRTPPIDGVGHAKTLGYLDVLRDDQAVGSRVAIVGAGGIGFDVAEYLVHRAGAEHVDAERFFTEWGVDPSYANAGGLRHAQPEPAARQIHLLQRKASKVGDGLGKTTGWIHRTGLKARGVGMSSAVTYRRIDDDGFHVTIDGVEQTLPVDNVVICAGQEPLRELAEQLEAAGRKVHVIGGAYEAAELDAKRAIHQGTSLAATL

SEQ ID NO: 4155 - protein, 324 aa, Candida tropicalis
MSTTPTIPTIKLNSGYEMPLVGFGCWKVTNATAADQIYNAIKTGYRLFDGAEDYGNEKEVGEGINRAIKEGLVKREELFITSKLWNNFHDPKNVETALNKTLSDLNLDYVDLFLIHFPIAFKFVPIEEKYPPGFYCGDGDNFHYEDVPLLDTWKALEKLVEAGKIKSIGISNFTGALIYDLIRGATIKPAVLQIEHHPYLQQPKLIEYVQKAGIAITGYSSFGPQSFLELESKRALNTPTLFEHETIKLIADKHGKSPAQVLLRWATQRNIAVIPKSNNPERLAQNLSVVDFDLTKDDLDNIAKLDIGLRFNDPWDWDNIPIFV

SEQ ID NO: 4156 - protein, 546 aa, Silicibacter pomeroyi
MAAKDVKFNTEARNKMLKGVNILADAVKVTLGPKGRNVVLDKSFGAPRITKDGVSVAKEIELEDKFENMGAQMVKEVASRTNDEAGDGTTTATVLAQAIVREGMKSVAAGMNPMDLKRGIDLATAKVVEAIKAASRPVNDSAEVAQVGTISANGESEIGRQIAEAMQKVGNEGVITVEENKGLETETDVVEGMQFDRGYLSPYFVTNADKMIAELEDCMILLHEKKLSSLQPMVPLLEQVIQSQKPLLIIAEDVEGEALATLVVNKLRGGLKIAAVKAPGFGDRRKAMLQDIAILTGGQVISEDLGMKLESVTMDMLGTAKKISITKDETTIVDGAGEKAEIEARVAQIRTQIEETTSDYDREKLQERVAKLAGGVAVIRVGGMTEVEVKERKDRVDDALNATRAAVQEGVVVGGGVALVQAGKVLADLEGANADQTAGINIVRKAIEAPLRQIAENAGVDGAVVAGKVRESGDASFGFNAQTEEYGDMFKFGVIDPAKVVRTALEDASSVAGLLITTEAMVADKPQKDAPAGGGMPDMGGMGGMM

SEQ ID NO: 4157 - protein, 346 aa, Cytophaga hutchinsonii
MERNLSTVKTLVQFITESQKHVFGASGDLSKILNDIAVAAKIINREVNKAGLLDILGMEGGMNVQNEEVKKLDVYANDQFISALRSGGQCCAIASEENTDIIPIENNGHSKSNYVVLIDPLDGSSNIDVNVAIGSIFSIYRRVSESGPGETVDCMQVGNKQVAAGYIIYGSSTMMVYTTGDGVNGFTLDPSIGEFCLSHPNLKIPEDGFIYSVNEGNYADFPREIQEYIYYCKTPDFETSRPYSSRYIGSMVADFHRNLIKGGIFMYPATAKYPLGKLRLMYECNPLAFIVEQAGGKAIDGEGRILDIEPTNIHQRTGIIIGSKNMVEKVEAFIQMNVGLNVYRLK

SEQ ID NO: 4158 - protein, 546 aa, Vibrio vulnificus
MAAKDVKFGNDARVKMLEGVNILADAVKVTLGPKGRNVVLDKSFGAPTITKDGVSVAREIELEDKFQNMGAQMVKQVASQANDVAGDGTTTATVLAQAIVNEGLKAVAAGMNPMDLKRGIDKAVAAAVEELKALSKDCSTSTEIEQVGTISANSDSSVGKIIAEAMEKVGRDGVITVEEGQALHDELDVVEGMQFDRGYLSPYFINNQESGSVELESPFILLVDKKISNIRELLPALEAVAKASRPLLIIAEDVEGEALATLVVNNMRGIVKVAAVKAPGFGDRRKAMLQDIAILTGGTVISEEVGLELEKATLEDLGQAKRVSITKENTTIIDGVGEEAMIQGRVAQIRQQIEDATSDYDKEKLQERVAKLAGGVAVIKVGAATEVEMKEKKDRVEDALHATRAAVEEGIVAGGGVALIRAASKIVDLQGDNEEQNVGIRVALRAMEAPLRQITKNAGDEESVVANNVRAGEGSYGYNAATGVYGDMLEMGILDPTKVTRSALQFAASVAGLMITTEAMVTDLPQKDSGMPDMGGMGGMGGMGMM

SEQ ID NO: 4159 - protein, 407 aa, Bacteroides thetaiotaomicron
MESKLFTPVTFGPLTLRNRTIRSAAFESMCPGNAPSQMLLDYHRSVAAGGVGMTTVAYAAVTQSGLSFDRQLWLRPEIISGLREVTGAIHTEGAAAGIQIGHCGNMSHKKICGTTPISASTGFNLYSPTFVRGMKREELPEMARAYGRAVHLAREAGFDAVEVHAGHGYLISQFLSPYTNHRKDDYGGLLQNRMRFMEMVMNEVMTAAGSDMAVIVKMNMRDGFKGGMETDESLQVAKRLLALGAHALVLSGGFVSKAPMYVMRGAMPIRSMAYYMDCWWLKYGVRMFGKWMIPTVPFREAYFLEDALKFRAALPEAPLIYVGGLVSREKIDEVLDAGFDAVQMARALLNEPEFVNRMRREEQARCNCGHSNYCIGRMYTIEMACHQHLKEKLPPCLQREIEKLEKQ

SEQ ID NO: 4160 - protein, 394 aa, Oryza sativa
LATTPLSTPQISPLSISHLPAAMAEDAPSAAAAEGSQHASAAEGGSAAAAASAAPAAKAAEALLPSLSIWPPSQRTRDAVVRRLVQTLVAPSILSQRYGAVPEAEAGRAAAAVEAEAYAAVTESSSAAAAPASVEDGIEVLQAYSKEVSRRLLELAKSRAAPSPAAAAPAEGAASESEAAAAPAPAEDCYVVLNGIPVISAMFFHKCELMIKQDNCIFALAIPLTAVVTSVTVTARVEVELSGGWDEIGLGLSGFGVLFSFLGIIMLFDKGFLAIGNILFVSGVSLTIGPKSTVQFFTKPKNHKGSIAFGIGFFLVLIGWPFFGMLAEAYGFVKLFRGFWPTAAVYLQKSPTFGWIFHHPLVTSVQGKTSPGVIVALLLELDHSKGCRVTSKET

SEQ ID NO: 4161 - protein, 541 aa, Rhodobacter sphaeroides
MSAKEVRFGTDARGRMLKGINTLADTVKITLGPKGRNVILDTSYGAPRITKDGVTVAREIELSDRFENVGAQMVKEVASRTNEEAGDGTTTATVLAQAIAKEGMKAVAAGMNPMDLKRGIDRAVAIVIAEIRSMSRPVGDSAEIAKVGALSANGEAAIGRQIADAMAKVGTAGVIKVENKGLETETEVVEGMQFDRGYLSPYFITHAQKMVVELDDCAILLHEGKLTSLASMVPLLEAVVQAEKQLLVVAEDVEGEALTTLVVNKLRGGLKVAAAKAPGFGDGRAAMLEDLAVLTGAHLISAELGTKLETVTLDMLGFAKKVVLTKDSTILIDSAGDKAAIASRIGQIRNQIEDTTSAYNKEKLQERLARLAGGVAVIRVGGATEIEVKERRDRVEDTLNATRAAVQEGVVPGGGAALIHAGKALAGLKGDNPDQDAGIKIIRRAIQAPLRQIADNAGIDGSVVAGKVIENDSATFGFDAQLETYGDMLQAGIIDPTKVVRIALEDAASIAGLLITTEVIIAHKPERGERMSQMDEMGGMM

SEQ ID NO: 4162 - protein, 510 aa, Saccharomyces cerevisiae
MPTSGTTIELIDDQFPKDDSASSGIVDEVDLTEANILATGLNKKAPRIVNGFGSLMGSKEMVSVEFDKKGNEKKSNLDRLLEKDNQEKEEAKTKIHISEQPWTLNNWHQHLNWLNMVLVCGMPMIGWYFALSGKVPLHLNVFLFSVFYYAVGGVSITAGYHRLWSHRSYSAHWPLRLFYAIFGCASVEGSAKWWGHSHRIHHRYTDTLRDPYDARRGLWYSHMGWMLLKPNPKYKARADITDMTDDWTIRFQHRHYILLMLLTAFVIPTLICGYFFNDYMGGLIYAGFIRVFVIQQATFCINSMAHYIGTQPFDDRRTPRDNWITAIVTFGEGYHNFHHEFPTDYRNAIKWYQYDPTKVIIYLTSLVGLAYDLKKFSQNAIEEALIQQEQKKINKKKAKINWGPVLTDLPMWDKQTFLAKSKENKGLVIISGIVHDVSGYISEHPGGETLIKTALGKDATKAFSGGVYRHSNAAQNVLADMRVAVIKESKNSAIRMASKRGEIYETGKFF

SEQ ID NO: 4163 - protein, 84 aa, Kandelia candel
MDLRVMGLDSPLFSTLQHMIDAGNEEAEKSSHGPTRVYMRDAKAMAATPADVKELPNAYVFVIDMPGLKSGDIKVQVEEDNVLI

SEQ ID NO: 4164 - protein, 133 aa, Kandelia candel
DPLDGFFSSAVANVPFNSANEAAAFANARFDWKETPEAHVFKADLPGLKKEEVKVEVEEGRILQISGERRKEQEEKNDKWHRLERSSGKFLRRFRLPENAKMYQVKASMENGVLTITVPKEEEKKPEVEAIEI

SEQ ID NO: 4165 - protein, 651 aa, Oryza sativa
MAGSERTVVWFRRDLRIDDNPALASAARDGAVLPVFIWCPADEGQFYPGRCSRWWLKQSLPHLSQSLESLGCPLVLIRAESTLEALLRCIDSVGATRLVYNHLYDPVSLVRDDKIKKELSALGISIQSFNGDLLYEPWEIYDDSGLAFTTFNMYWEKCMELPIDASPSLAPWKLVPVPGLESVRSCSVDDLGLESSKDEESSNALLMRAWSPGWRNAEKMLEEFVSHGLLEYSKHGMKVEGATTSLLSPYLHFGEVSVRKVYQLVRMQQIKWENEGTSEAEESIHFFMRSIGLREYSRYLCFNFPFTHEKSLLGNLKHYPWKVDEERFKSWRQGMTGYPLVDAGMRELWATGWTHNRIRVIISSFAVKFLLIPWTWGMKYFWDVLLDADLESDILGWQYISGSLPDGHELSRLDNPEVQGQKYDPDGVYVRTWIPELARMPTEWIHHPWDAPSCILEVAGVELGFNYPKPIVDLHIARECLDDSISTMWQLDTAEKLAELDGEVVEDNLSNIKTFDIPKVVLRETSPCALPIDQRVPHASSKDHNLKSKVLKASNRSSICVDMIRSSKMEATSSVANSPVSRKRSFCETAFHVPSYSSSAEVHSHIQDHGGSLVGPSRYLLQEAGRNCVDEVEDSSTADSGSSISRQRKAA

SEQ ID NO: 4166 - protein, 932 aa, Unknown
  Acinetobacter sp. ADP1
MSNFNKKLSKRLQLNHAYGQLIALIFVPIMVLASVGTVLVLNETSAAAKSQQRHTAAALLTRYEHTASNLLELVERRPEQYDQAQRIMQNMFNERYLKRAAIIDQQGRVYLSIGYRDTRFWPQIPNMVFFGPVTHNHNNIYGQRIQSPLHQAAWLVVEMDNQPLQIAHYRVFLVLIVTGLITLLLLLLCLNFYSRRWIAPMYEIRMQLQRLNADTLDQHMVINSTGELRLLQRDIANVVKRLHFSFLELKEHTEQTEDDLRRTLDTLEVQNITYRQARDQAISANQAKSVFLANISHELRTPLNSIDGFIHLMLRQQNLSNEQRLYMQTIRKSSAHLLALINDVLDFSKIDAGKLELETAAFNLEEAIFDVMDMLSPLAAQKHIDMAFYYGDNIPEIVIGDALRVKQILTNLISNAIKFTPDGEIIVRVRMEHDDIDQCLLHFSVQDSGIGLSGTDRKKLFESFSQGDASVTRQFGGTGLGLAISKQLVQLMHGHIGFEDNQERAPTEKGSTFWFTAQFKTQEAHIIDHPEFPQLQVVSYLAHPATANILRHYLENYEVQHTEITSILELFSRLNHLSSKENTWLIVDHSGDTEALLKEIRQRYTGNLAVYGYQMALEPNMLNEYRARPLYQPLSRSALIQLLSNQPIFEQPPEQFNGRGLHVLAVDDHLPNLIVLEALLSELNVTTSKALSGQEALNIIEQRIEQNEKPFDVVFMDIQMPVMSGIDTTRAIRSLESTLDTQMRLPIIALTAHALADEKQKLLKVGMDDYVTKPIQMEQIIHILNQWSKADFDHPPQNDHQILIDALDPTILDWQQSLQLAANKEDLAYDLLKMLVDSFETELGEMEQLIELEDFPQLEHVLHRLYGATRYVGTPKLQHVTGEFEQFVSTLRKERRKADADFVQNVLKRFEELHLTIREVEGAAKHILSEQQ

SEQ ID NO: 4167 - protein, 541 aa, Unknown
  Bradyrhizobium sp. BTAi1
MSAKDVKFAADARERLIRGVDILANAVKVTLGPKGRNVLIEKSFGAPRITKDGVTVAKEIELEDKYENLGAQLLRQVASKTNDLAGDGTTTATVLAQAIVREGAKAVAASLNPLDLKRGIDLAVAEAIKDIEKRARKVQSSEEVAQVGTISANSDAAVGKIIATAVKKVGNDGVITVEEAKSLETELDVVEGLQFDRGYLSPYFVTNSDKLLVEFEEPYILIHESKLTSLQPLLPVLEAVVQTGRPLLVIAEDVEGEALATLVVNKLRGGLKVAAVKAPGFGDRRKAQLEDIAILTGGQTISQDLGIKLENVTLSQLGRARRIRIDKENTTVVGGTGKKKDIDARIAQIRAQIEETTSDYDREKLQERLAKLSGGVAVIRVGGATEVEVKEKKDRVDDALNATRAAIAEGIVPGGGVALLRAKAAVSKLTNPNPDIQAGIQIVLKALEAPIRQIADNAGVEGSIVVGKILENRSPTFGFDAQKEEYVDLIEAGIVDPAKVVRTALQDAASVAALIVTTEALVVELPKEKAALPAAGAGADF

SEQ ID NO: 4168 - protein, 741 aa, Unknown
  Fragaria x ananassa
MEACNCIEPQWPADELLIKYQYISDFFIALAYFSIPLELIYFVKKSAVFPYRWVLVQFGAFIVLCGATHLINLWTFNMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTALELQLSYTLRQQNPVGHTVPIHLPVINQVFSSNRAVKISPNSPVARLRPLVGKHMPGEVVAVRVPLLHLSNFQINDWPELSTKRYALMVLMLPCDSARQWHVHELELVEVVADQVAVALSHAAILEESRRARDLLMEQNIALDLARREAETAIRARNDFLAVMNHEMRTPMHAIIALSSLLQETELTPEQRLMVETILKSSNLLATLINDVLDLSRLEDGSLQLDIATFNLHSVFIEVHNLVKPVASVKKLSVTLNLAADLPVYAIGDERRLLQIILNVVGNAVKFSKEGSISITAFVAKSESLRDFRAADFFPVQSDNHFYLRVQVKDSGSGINPQDLPKLFTKFAQNQSLATRNSGGSGLGLAICKRFVNLMEGHIWIESDGLGKGCTTTFIVKLGYPERSNESKLPFVPKMHTTHVQTNFPGLKVLVMDDNGVSRSVTKGLLEHLGCDVTTVSSSDEFLQVISQEHKVVFMDVCMPGIDGFELAVQIHEKFTKRHERPVLVALTGNINKMTKESCMRVGMEGVILKPVSVDKMRSVLSELLEHRVLFEAM

SEQ ID NO: 4169 - protein, 248 aa, Unknown
  Rosa hybrid cultivar
MAYENKPNTVLDADAQRRLGRGKIEIKRIENTTNRQVTFCKRRNGLLKKAYELSVLCDAEVALIVFSNRGRLYEYSNNSVRETIERYKKACADSSNNGSVSEATTQYYQQEAAKLRAQITTLQNSNRGYMAEGLSNMSIKELKGVETKLEKAISRIRSKKNELLFAEIEYMQKRELDLHNNNQLLRAKIADNERHQQSINAIAGGHGSYEIMQPTQPFHEARNYFQVNALEPNIHQYSRHDQISLQLV

SEQ ID NO: 4170 - protein, 404 aa, Mannheimia succiniciproducens
MELFPKSNKLEHVCYDIRGPVHKAALRLEEEGHKILKLNIGNPAPFGFEAPDEILIDVIRNLPTAQGYCDSKGLYSARKAIVQYYQSKGIHGATVNDVYIGNGASELITMAMQALLNDGDEVLVPMPDYPLWTAAVTLAGGKAVHYLCDEEQDWFPAIDDIKSKITSRTKAIVIINPNNPTGAVYSKELLLEIAEIARQNGLLIFSDEIYDKILYDGAVHHHIAGLAPDLLTITMNGLSKAYRICGFRQGWMILNGPKDKARGYIEGLDMIASMRLCANVPMQHAIQTALGGYQSINELIVPGGRLYEQRNRAYELLNQIPGVSCVKPMGALYMFPKIDIKKFNIYDDEKLVLDLLAQEKVLLVHGRGFNWHAPDHFRIVTLPYVHQIEEALNKFARFMENYHQ

SEQ ID NO: 4171 - protein, 279 aa, Thermosynechococcus elongatus
MTSSLELQPQTSRLNWGFVLFLGAVHILAAVALFFFSWSALAVTIFLHWLFGSIGICLGYHRLLSHRSFQVPQWLEYVIAVVGALAMQGGPIFWVAGHRLHHAHTEDEIKDPYSARRGFWWSHMLWLVYPQSQFFNAEEYARFAPDLTRDPFYRWLDRYFLLLQLPLALLLYGLGGWSWLLWGMFMRAVFLWHSTWLINSATHKWGYRRFETEDNSRNLWWAALLTYGEGWHNNHHAYPHVAKAGWYWWEVDPTWWVIRTLQGLGLAAKVQLPPPKALS

SEQ ID NO: 4172 - protein, 829 aa, Arabidopsis thaliana
  misc_feature (337)..(337): Xaa can be any naturally occurring amino acid
  misc_feature (344)..(344): Xaa can be any naturally occurring amino acid
  misc_feature (403)..(403): Xaa can be any naturally occurring amino acid
  misc_feature (437)..(437): Xaa can be any naturally occurring amino acid
  misc_feature (449)..(449): Xaa can be any naturally occurring amino acid
MSEPKVRRWVGKYEVGRLIGECNFGKLRSAVDTETGDPVALMILDKDKVLKHKMAEQIKREISIMKLINHPNVVQLYEVLASKAKIYIVLEFISGGKLFDKIKNDGRMNEDEAQRYFQQLINAVDYCHSRGVYHRDLKPENLLLDAQENLKVAEFGLIALSQQAGGDGLRHTACGNPDYPAPEVLNDQGYDGAKADLWSCGVILFVLLAGYLPFEDSSLTTLYKKISSADFSCPPWLSSGVKNLIVRILDPNPMTRITIPEILEDVWFKKDYKPAVFEEKKEANLADVEAVFKDSEEGRVQLRSFPCVICSGGTSCGDVRSTTKLMHGFIETGRPQXSHSIKEXYKMRLENVTAGRKGNLRVATEIFQVSPSLHMIEVRKTKGDTLEFHKFYKKLSTSLNDVXLEIWRELWSKQIRKKTDDSSPCFDYLLFSFLLIXFFQDSILLNIRXKSHEIDDSVDIEACAVSLCCSYNCKLRLCCVTNILSKNGVKPDVVTFNTLAKAYARIGSTCTAEDMIIPRMLHNKVKPNVRTCGTIVNGYCEEGKMEEALRFFYRMKELGVHPNLFVFNSLIKGFLNINDMDGVGEVVDLMEEFGVKPDVVTFSALMNAWSSVGDMKRCEEIYTDMLEGGIDPDIHAFSILAKGYARAGEPEKAEQILNQMRKFGVRPNVVIYTQIISGWCSAGEMKKAMQVYKKMCGIVGLSPNLTTYETLIWGFGEAKQPWKAEELLKDMEGKNVVPTRKTMQLIADGWKSIGVSNSNDANTLGSSFSTSSKLNIPNNIASSRSPLFLKGMPEKPKLCIKSQFGLRQTLLVVLCRDQIGEAGRFCKFM

SEQ ID NO: 4173 - protein, 1317 aa, Cytophaga hutchinsonii
MEEIEFLKKSLQEEIISRKQLEIELEKNKLEIEKLKKKFSNSHKEILENYIRKEQDLLSNSSRLSSLIVNLDSAILLEDENRKIVLVNQKFCDIFGIPLSPQELIGTDCSNSAQQSKIKFKNPDQFISRIEELLENKKKVLSDELQLIDGKILKRDFIPVYHNNEYLGHLWNYEDLTNYINVKKKIESLSRFPKESPNPILRCSADGMVIYANAAAKPFVSVLSTTKYNSNNNVTYDSLVSNVKASFKTRMLLKNEIRIKDRTYNVSYVPVEHEDYVNIYATDITSTKESEEKIYLLKELLNQLDEFIQVIDKEGNFVFINESSANRFQRTIEEFETLNIKNIVPSFYNNMTWEEQFDFFKQKQNFLLESTHTKPDKTSYPIESSVKYTTVHEKEYIISFSKDISERKRTEQALQDQKQFYEDILNNIPSDIAVFNTNYQYLYVNPAAIKDEETRKWIIGKTDLDYCRYRGKDDSLAIMRRKNHDILHEFKKPIEWEDVFTDKDGNVSYVLRKFHPVLDENDNIKIIIGNGINITEIKQVQEKLAKSEELYRLVIHAANDGIWDWDIASGSLYLSERWKSMLGYTDETLANHISSWEKTMHPDDLSIAKEILQNHFEKRKPYNYTLRYLHVDGSIRWIMCRGFAIRNRKGEPYRMVGSCTDVTDTQIAEEKLKENEEKLQAIFNHSHDAKFLVDPCTNKIIEFNKRTLELFETDKPDTLYTIPLTSLRKYPLTDAELADTQNQFKQLGYWNQEVLYITQKKNEFWGNIVAKTIFINKKEVILVRITDISENKKIEQELIKAKQIAEESTKAKEMFLANMSHEIRTPMNGILGMAELISRTSLDVTQKKHVQLIKNSADNLLIIINDILDIAKIESGKLTIEQIPFDICEVIKSAIQTLTYKAEEKGIDLIIHPIKLDHRVVIGDPFRLTQALLNLINNAIKFTENGSVEISGRIPHSSSTDITFEFTVKDTGIGIPQEKLDSIFEGFTQASPDTSRKYGGTGLGLTISKNLIQMQGGNIWVESVVGKGSKFIFSITYKKGDLLDVSPNNKNKINLYQLHDLKVLLAEDNEVNQYFAKTLMDEIGVKVDVANNGIEAFQFFEQNEYDIILMDIQMPYMGGIETTSKIRSHANKTKAKIPIIALTANALVGDSEKYIEAGMSDYISKPFDRETLFRKLQLHAGSNKNIFQDAKNIHLFQSDTNDAYLPNYSHLEKNFQNNTVFLKKIFTLFIESTPEIVNELKLFSEGKDYEKLQATAHKLKASVDAFKIVALHQTIRNIEKFAANKTNLDEIPDLVKSTDDILKIAQEDITKKLKQIE

SEQ ID NO: 4174 - protein, 610 aa, Arabidopsis thaliana
MDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSKRVKPEEEEERDMKKSRGFDERELFSTAESSSSSSVFFVSQSCSLASEGKNLEGIQDSSDQITTSLGKNGCK

SEQ ID NO: 4175 - protein, 244 aa, Arabidopsis thaliana
  misc_feature (178)..(178): Xaa can be any naturally occurring amino acid
RALCQAPFLLDDPNVGMIFPADAIARAKHYLSLTSGGLGAYSDSRGLPGVRKEVAEFIERRDGYPSDPELIFLTDGASKGVMQILNCVIRGQKDGILVPVPQYPLYSATISLLGGTLVPYYLEESENWGLDVNNLRQSVAQARSQGITVRAMVIINPGNPTGQCLSEANIREILRFCXMRRRARMMTDGFNSCKNVVCNFTEGAMYSFPQIKLPSKAIQAAKQAGKVPDVFYCLKLLEATGIST

SEQ ID NO: 4176 - protein, 610 aa, Arabidopsis thaliana
MDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAMKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDIARELLAKAISRTREAQIMIGAAPDEIVADSFEALGANTIKEPGLCPSVSSNDQQVPSAVRYNGSKRVKPEEEEERDMKKSRGFDERELFSTAESSSSSSVFFVSQSCSLASEGKNLEGIQDSSDQITTSLGKNGCK

SEQ ID NO: 4177 - protein, 537 aa, Corynebacterium efficiens
MAKLIAFDQDAREGILRGVDALANTVKVTLGPRGRNVVLDKAFGGPLVTNDGVTIARDIDVEDPFENLGAQLVKSVAVKTNDIAGDGTTTATLLAQALIAEGLRNVAAGANPIELNKGIEAATQKTLDELRARATPISAPQEVASVATVSSRDEVVGKIVAEAMEKVGKDGVVTVEESQSLETTLDITEGISFDKGYLSPYFINDTDTQTAVLENPAILLVRNKISSLPDFLPLLEKIVESNRPVLIIAEDIEGEPLQTLVVNSIRKTIKAVAVKSPYFGDRRKAFMDDLAVVTNATVVDPEVGINLSEAGVEVLGTARRVTVSKDETILVDGAGDAEAVEARRQQIRREIETTDSTWDREKAEERLAKLSGGVAVIRVGAATETEVNERKLRVEDAINAARAAAQEGIIAGGGSALVQIAETLKAYAEEFEGDQKVGIRALAAALSKPAYWIAANAGLDGAVIVARIADLPNNEGFNAATLEYGNLVDQGVIDPVKVTHSAVVNASSVARMVLTTEASIVDKPAEETADHGHGHHH

SEQ ID NO: 4178 - protein, 127 aa, Brassica napus
MSMSSEEENHRKNVEDKAEMGRRKRAIWERKWRRLDIVKAFASFFVHFLCLLAPFNFTWPALRVALVVYTVGGLGITVSYHRNLAHRSFKVPKWLEYLFAYCGLLAIQGDPIDWVSTHRYHHQFTDS

SEQ ID NO: 4179 - protein, 711 aa, Psychrobacter arcticus
MTASHTANSIDTASLNEHYPHLFEPLDLGFTTLKNRLVMGSMHTGLEDRFYNYGKLAAYFAERAKGGVAMMITGGISPNREGWLLPASGTMNTRADVLNHQRVTRAVHKYDSKIIMQILHSGRYGYHPFVVSSSPIKSPISPFKPRKMSIKNIEQTVKDYARSAKLAKQAGYDGVEIMGSEGYLLNQFLSRHVNKRTDEYGGDIQGRMKLAVDVVKAVREAAGEDFIMLFRLSVIDLVKDGNVMDEVIIVAKALEEAGVTIMNTGIGWHEARVPTIVTSVPRAAFVDFTAEIKKHISIPMMAANRINMPETAEEIVASGQADLIQMARPFLADAHWVNKAKDGQADRINTCIACNQACLDHTFDNKRSTCLVNPQACYETELVYKKTKKPRKVAVIGGGVAGMSAAHVAALRGHEVTLFEAKDILGGQFNYAKVIPGKEEFFETIRYYINELEHLGVEIKLNTKVDKAMLEKAKFHHVIVATGVVPRSLAGKLEGADLPQVMSYAELLSGEKSVGATVAVIGAGGIGFDVSEYLTAKHGQPLDELDPELLKDSSYRPKAQSIEEWREEWGVTSATDYQTEGGLIKTGDITPVRQVYLIQRTKGRLGSGLNKTSGWVHRAHVKSHGVIQVSGAQYDKITNEGIWITNNQGQSQLLRVDSVVVCAGQESVVELMPNVGDAPDAQYHLIGGAKLAAELDAKRAIRDGAEVAASI

SEQ ID NO: 4180 - protein, 367 aa, Psychrobacter arcticus
MAHDNLFEPVKMGTQTLKNRIIMAPLTRLRSVEPGDVPTALASEYYAQRSGAGLIIAEATQVSFQAKGYAGAPGIHTEEQMTAWKTIVDNVHAKGCKIVVQLWHTGLVAHESVQPDGKAPISASDVNVGVRTSLRDSNNQAIRVDATTPRPATLEEIQQVIADFGLATKNAKEAGFDGVEIHGAHGYLLHQFWVEHTNQRTDEYGGSRENRARLMLAVIDACVDAWDADHVGIRISPLGTFNNVEAGYNEDENIWLIEQINQRGLMYLHLSEPDWAGGTPYSTEFRQRVREAFGQMIIAAGGYTAEKAETNIKDGYIDAVAFGRDYIANPDLAERIREGAPLNEQHPQSFYGGGTEGYTDYPFLNQA

SEQ ID NO: 4181 - protein, 374 aa, Yarrowia lipolytica
MTHLFSPIQVGASQLSNRVVLAPLTRIRAEKHVPSDLAVEYYTQRASSSGTLLISEATYIHPSCAGHKNRPGLVPGVWSDDAVLTGWKRVIEGVHSKGSKMYIQLWDLGRVADYETLQDIGGYDLVGPSAIAQEGDDEGSKHIRALSVSEIKQKVRYFVEAAKNAIAAGADGVEIHSANGYLPDQFLHWNSNHRTDEYGGSVENRARFLLEIVDAVADSVGADRVGVRFSPWTTYQDMDVDEDKTLPQYKYLFEQLEKRAVEDETKRLSYIHVVEPRVDGVNDVTTKSWQSNEPFRKIWTGNLIRAGGFKRQSAIEVAQQDNKTLVAFGRYFISNPDLVKRLEEDKALTQYDRATFYLPGAQGYTDYSFYDETE

SEQ ID NO: 4182 - protein, 919 aa, Pseudomonas aeruginosa
MSRLCLVLLLLCCALPARAQPPAPLDGEDLRLSLGAYAEYYRDAGGKARLGDILALPAQAFAALRGDHANFGKNAAAWWFRVRLDNRNGADLAGFLEVNYPLLDDLKVYLLTADGRIEQQESGDLFAFSQRPVQVRNFWFPLRLPPGESTLLLRVQSTSTVYLPLYFSTYAASAASQETLMGFNGAFYGVLFGLFCYNLFLFVSLREATYAWYLLYNLSLGLFSASFDGLLFKLLPGHVALESAGIYLLMYLSCLVSIQFSRGYLYTRRDFPRLDRFLRGLLLACVVLLASEPLVGLRAWNVLASLTVMLVSLSLLLAGVHVWRQGLRYGLYYILAWGALLLSFLVTTAASLGFELFGLFGSSVVKIGMTVELVTLSIGLADRINALKEEGFRSRQAAEQARVENEAKSRFLAKMSHEIRTPLNGVLGMLQLLRDTPLDRGQAAYVETIASSGSALMSVINDILDYARIESGKLHLERIDFDLEELLSDTLALFSAQAVEKRLHLHLGLDRGVPRRLNGDPTRLRQVLMNLLSNALKFTAEGHVAVRVQRRFDEGGRERLLYSVSDSGIGISAQAQKTLFESFSQADSSTTRRYGGSGLGLAISRELVQMMGGRIEVSSEPGKGTRFSVDLPLSPALDAGEADELAQLLQHRPALLASEDNLTLDCLQALLERWGLRVERCLQPRRLNAYLEDFSAPPLLVLAAPWPGPPSIWLDTLYAQLEQGQRILLLCPPQHCQDLPPHEGLRLLALAQPVAVKALREALLELYRERRRQPGRSSEAAPDERPPDAPCILVAEDNPVNQLVVRGFLAKRGYAVRLAGNGRLALDEYLRDPNGIQLILMDGEMPEMDGFEATRLIRREERAQGWPRVPIVALTAHILDEHRRAGIEAGMDAYLGKPVDRAELYATLERLLGQPSRQA

SEQ ID NO: 4183 - protein, 224 aa, Zea mays
HSIIDNNVACESPQQQRVGHLDPFSLDLWWDPFDMFRSIVPSAASSGGGSETAAFANARVDWKETPEAHVFKADLPGVKKEEVKVEVEDGNVLVISGKRSREEEEEDKNGKWHRVERSSGQFMRRFRLPENAKLDEVKAGLENGVLTVTVPKTEVKKPEVKAIEISGWPSVGRRLELRCTATGPWMSCMLHCSGGCSLRLLRIICSVCVVFVFPVYGLCIVPYR

SEQ ID NO: 4184 - protein, 633 aa, Unknown
  Fragaria x ananassa
MMESCDCVEAQWPPDELLVKYQYISDVFIALAYFSIPLELIYFVHKSAFFPYRWVLMQFGAFIVLCGATHFINVWTFSMHTKTVAIVMTIAKVSCAVVSCATALMLVHIIPDLLSVKTREIFLKNKAEELDREMGLILTQEETGRHVRMLTHEIRSTLDRHTILKTTLVELGRTLGLEECALWMPCRSGMNLQLSHTLNYDAQIGSTVPFSLPIVNEVFKSSQAMRIPYTCPLARIRPLVGRYMQPEIVALRVPLLNHSNFQMNDWPDVYAIMVLILPTDSTRKWRDHELELVDVVADQVAVALSHAAIVEESMRASDQLVEQNVALDLARREAELAIRARNDFLAVLNHEMRTPMHAIIALSSLLLETELTPDHRVMIESVLKNSNLLETLINDVLDLSRLEDGSLDLDIGKFNLHGVFREAIDLIKPIATVKKLSMTLILAPDVPVCAVGDENRLMQTILNVAGNAVKFTKEGYVSVIASIARPESSRDWRPPEFYPAPSDGHFYLRVQVKDSGSGILPQDIPRIFTKFTQPRNGSNRVNDGAGLGLAICKRFVNTMGGHIWIESEGIDKGTLVVFIVKLSICDSCSTTIAHQTVPKGEANHGSADLIGYKPALRDGYGLASTNARYQRSL

SEQ ID NO: 4185 - protein, 468 aa, Streptococcus pyogenes
MTKTLPKDFIFGGATAAYQAEGATHTDGKGPVAWDKYLEDNYWYTAEPASDFYNRYPVDLKLSEEFGVNGIRISIAWSRIFPTGKGDVNPKGVEYYHNLFAECHKRHVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDGGYSGEIGVVHALPTKYPFDANNPDDVRAAELEDIIHNKFILDATYLGKYSDKTMEGVNHILEVNGGELDLREEDFVALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDDGRIDYVKKHLEVISDAISDGANVKGYFMWSLMDVFSWSNGYEKRYGLFYVDFETQERYPKKSAYWYKKVAETQVIE

SEQ ID NO: 4186 - protein, 552 aa, Pseudomonas stutzeri
MAAKEVKFGDSARKKMLVGVNVLADAVKATLGPKGRNVVLEKSFGAPTITKDGVSVAKEIELKDRFENMGAQLVKDVASKANDEAGDGTTTATVLAQAIVNEGLKAVAAGMNPMDLKRGIDKATIAIVAELKNLAKPCTDSKAIAQVGTISANSDSSIGDIIAEAMERVGKEGVITVEEGSGLENELSVVEGMQFDRGYLSPYFINKPDTMVAELDSPLLLLVDKKISNIRELLPVLEAVAKAGRPLLIVAEDVEGEALATLVVNNMRGIVKVAAVKAPGFGDRRKAMLQDIAILTGGTVISEEVGLSLETATLEHLGNAKRVVLNKENTTIIDGAGQQADIEARVAQIRKQVEDTTSDYDKEKLQERLAKLAGGVAVIKVGAGTEVEMKEKKARVEDALHATRAAVEEGVVPGGGVAWVRALQAISELKGENEDQNVGIALLRRAVEAPLRQIVTNAGGEPSVVVDKVKQGEGNYGFNAASDTYGDMIEMGILDPAKVTRSALQAAASIGSLMITTEAMIAEVAEDKAAGGMPDMGGMGGMGGMGGMGGMM

SEQ ID NO: 4187 - protein, 610 aa, Arabidopsis thaliana
MDKKTIVWFRRDLRIEDNPALAAAAHEGSVFPVFIWCPEEEGQFYPGRASRWWMKQSLAHLSQSLKALGSDLTLIKTHNTVSAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVEKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLGKAISRTREAQIMIGASPDEIVADSLEALEANTIKEPGLCPSVSSNDQQVPSAVRYNGSKRLKPEEEEERDMKKSRGFDERELFSTAESSSSSSVFFVSQSCSLASEGKNLEGIQDSSDQITTSLGKNGYK

SEQ ID NO: 4188 - protein, 462 aa, Listeria monocytogenes
MFKTNVEQNNVPVFGSFESGQDLPEKRMNKESVDPRIAYQLVKDQLIDEGSARQNLATFCQTYMEPEAEQIMAETMEKNAIDKSEYPQTAKLESSCVNMLADLWNVDESEHYMGTSTVGSSEACMLGGMAMKFRWRSAALKNGLDIHAKKPNLVISSGYQVCWEKFCVYWDIELREVPMSEEHLSINTDIIMDYVDEYTIGIVGILGITYTGKFDDIMTLNDLVEDYNNTHDNEVVIHVDGASGAMFTPFVEPGLEWDFRLPNVVSINTSGHKYGLVYPGVGWILWRDKEYLPEELVFDVSYLGGHMPTMAINFSRSASQIIGQYYNFLRFGYEGYRQIHMRTRDGALQLSQAVAETGLFEIYNDGANLPIVCYKLKDDANVAWTLYDLADRLQMKGWQVPAYPLPKEMGNTIIQRYVCRGDLGQNMVTAFKNDLSESIEELNNAHILYHDVNTSKTHGFTH

SEQ ID NO: 4189 - protein, 158 aa, Triticum aestivum
MAAISSTSYFSSQPHLPASSAAATTSISKGRQPRRHRTGSCVMLEEASGGGAVGRRTRSLTEEDLEELKGCLDLGFGFSYHEIPGLCGTLPGLELCYSMTRRFLDEQRTLVGQLEPAAVAAPPIPDWKISGPGDDPDQVKARLRYWAQTVACTVKLCT

SEQ ID NO: 4190 - protein, 614 aa, Symbiobacterium thermophilum
MCGIAGWADWKRDLSREGPVLETMIAPLADRGPDAGGIWCSGHCAFGHRRLAVVDLVGGAQPMVRSRGDRTYVLVYNGQLYNTQELKEELTARGHAFSTQSDTEVLLVAYMEWGPECTRRLNGIYAFAVWDEAGQQLFLARDRFGVKPLFYKTMGSAILFGSELKALLAHPLVQPEVDAEGLAEVLYLGPSRTPGHGVFRGVREVLPGHWLLFDRAGVRTQPYWQLESRPHTDGPAETAERVRELLREAVRRQLVADVPVATLLSGGLDSSAITAFAAEAFRAQGRGPLHTWSIDYAENDRHFRAHAFQPDPDSAYAGTMAESLGTVHHEVVIDTPQLVDALEKAALIRDLPGMADVDAALFLFCREIKKGATVVLSGECADEVFGGYPWFHRPGPETGRTFPWIRSLEARTALLQPGVTGPIRAEDYVAQRYSNTVARVPRLPGEEPEEARIRELFYLNLAWFMATLLDRNDRMSMAVGLEARVPFCDHLLVEYVWNIPWRLKTYGGREKGILREALRGVLPEAVRTRRKSPFPKTHHPEYFRAVRDRVLALLDDPACRLHKIVRADRVRALARQDHEATDLPWFGQLMSGPQYFAWLIQLEAWLRHYKVVLV

SEQ ID NO: 4191 - protein, 464 aa, Listeria monocytogenes
MLYSKENKESYLEPVFGSSAEDRDIPKYTLGKEPLEPRIAYRLVKDELLDEGSARQNLATFCQTYMEDEATKLMSETLEKNAIDKSEYPRTPELENRCVNIIADLWHAPKDQKFMGTSTIGSSDACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVCYKLKTTANVNWTLYDLADRLQMRGWQVPAYPLPKSLENIIIQRYVCRADLGFNMAEEFIQDFQASIQELNNAHILFHDTQQSGVHGFTH

SEQ ID NO: 4192 - protein, 790 aa, Burkholderia fungorum
MRIVCIGGGPAGLYFGLLMKSRNPAYDVTVIERNRPYDTFGWGVVFSDQTLGNLRIADAPSADAILDAFNHWDDIEINFRGRQIRSSGHGFCGIGRKRLLNILQARCEELGVKLVFETQVTDDSAYEADLIIACDGANSAIRQKYAHTYRPAVDMRDCRFVWLGTRKLFDAFTFAFEETEFGWFQAHAYRFDDQTSTFIVETPERVWRAAGLDEMSKEDSIAFCEKLFAKYLDGNALLSNAAHLRGSSQWIRFPRVVNEEWVHWRDNADGTRTPVVLMGDAAHTAHFSIGSGTKLALEDSIELANSIGAHPGDLAAALKHYTDVRSIDVLRIQNAARNSTEWFEHVDRYTSFEPEQFAYSLLTRSQRISHENLRERDAGYLSGFEDWLARRSGVDRAPEKHSVPPMFTPFTLRGVTLKNRVVVSPMAQYSAVDGVAGDYHLMHLGARAMGGAALVMTEMTCVSPEARITPACPGMYAPEHLTAWKRIVDLVHRQSDAKIGIQLGHSGAKGSTRVAWEGIDQPLTEGNWPLVSASPQQYLRGVSQHSREATQDELREIEAQFVRATQMSAEAGFDWLELHCAHGYFLSSFLSPLTNHRTDEYGGSLDNRLRYPLQVFKAIRAVWPQDKPISVRISANDWVEGGTTPDDAVQIARAFKAAGADMIDVSSGQVSKDEKPVYGRMFQTPFADRVRNEAGIATIAVGAISEADHVNSIIAAGRADLCAIARPHLANPAWTLNEAAKIGYFDVTWPKPYTAAKSQLERNLERERAQAAANAGLSPQERAQRAEGTT

SEQ ID NO: 4193 - protein, 166 aa, Triticum aestivum
  misc_feature (139)..(139): Xaa can be any naturally occurring amino acid
MGNSLGCSASGERLVSAARDGDAVEARMLLELSPALARYSTFGGLNSPLHFAAAKGHLDIVTLLLEKGADVNARNYCGQTALMHACRHGHWEVVQMLLLFRCNVTRADYLSGRTALHFAAHDGLVRCVRLLLADFIPSXPLEDTASSVADGGDSQMNSGSSSTSSL

SEQ ID NO: 4194 - protein, 731 aa, Mycobacterium bovis
MSRSEKLTGEHLAPEPAEMARLVAGTHHNPHGILGAHEYGDHTVIRAFRPHAVEVVALVGKDRFSLQHLDSGLFAVALPFVDLIDYRLQVTYEGCEPHTVADAYRFLPTLGEVDLHLFAEGRHERLWEVLGAHPRSFTTADGVVSGVSFAVWAPNAKGVSLIGEFNGWNGHEAPMRVLGPSGVWELFWPDFPCDGLYKFRVHGADGVVTDRADPFAFGTEVPPQTASRVTSSDYTWGDDDWMAGRALRNPVNEAMSTYEVHLGSWRPGLSYRQLARELTDYIVDQGFTHVELLPVAEHPFAGSWGYQVTSYYAPTSRFGTPDDFRALVDALHQAGIGVIVDWVPAHFPKDAWALGRFDGTPLYEHSDPKRGEQLDWGTYVFDFGRPEVRNFLVANALYWLQEFHIDGLRVDAVASMLYLDYSRPEGGWTPNVHGGRENLEAVQFLQEMNATAHKVAPGIVTIAEESTSWPGVTRPTNIGGLGFSMKWNMGWMHDTLDYVSRDPVYRSYHHHEMTFSMLYAFSENYVLPLSHDEVVHGKGTLWGRMPGNNHVKAAGLRSLLAYQWAHPGKQLLFMGQEFGQRAEWSEQRGLDWFQLDENGFSNGIQRLVRDINDIYRCHPALWSLDTTPEGYSWIDANDSANNVLSFMRYGSDGSVLACVFNFAGAEHRDYRLGLPRAGRWREVLNTDATIYHGSGIGNLGGVDATDDPWHGRPASAVLVLPPTSALWLTPA

SEQ ID NO: 4195 - protein, 190 aa, Isoetes velata
DEHGEVVAEIRRSDLEPYLGLHYPATDIPQASRFLFMKNRVRMIYDCSAPPVKIIQDKDLRQPISLAGSTLRAPHGCHSHYMGIMGSIASLVMAVITNDNDEEYGGRGYQQKGRKLWGLVVCHHTSSRAVPFPLRSACEFLMQVFGLQLNMEVELAAQLREKHILRTQTLLCDMLLRDAPIGIVSQSPNI

SEQ ID NO: 4196 - protein, 223 aa, Zea mays
  misc_feature (35)..(35): Xaa can be any naturally occurring amino acid
  misc_feature (86)..(86): Xaa can be any naturally occurring amino acid
MVQSKKKFRGVRQRHWGSWVSEIRHPLLKRRVWLXTFETAEEAARAYDEAAVLMSGRNAKTNFPVPRSGTGELLAPAVPAARGGAXGGGGGTSLSQILSAKLRRCCKTPSPSLTCLRLDPEKSHIGVWQKRAGARADSSWVMTVELNKDAPPPPSSGEEPAPSYGGAATTSTSTPTSSTITAGSPPPEMMDDEESVALQMIEELLGSHGMMLQVQGAAGSLVI

SEQ ID NO: 4197 - protein, 192 aa, Juniperus phoenicea
DDHGEVISEIRRADLEPYLGLHYPATDVPQASRFLFMKNKVRMICDCYANPVEVVEDKRLLRELILCGSSLRRPHGCHAEYMSNMGSIASLVIAVTINAKEEDVDTDAQQQQQKGRRLWGLVVCHHTSPRFVPFPLRYACEFLMQVFAIQLNKEDDLADQLREKHILRTQTLLCDMLLRDAPMGIIREKPNI

SEQ ID NO: 4198 - protein, 251 aa, Shigella flexneri
MNLNSIPAFDDNYIWVLNDEAGRCLIVDPGDAEPVLNAITANNWQPEAIFLTHHHHDHVGGVKELVEKFPQIVVYGPQETQDKGTTQVVKDGETAFVLGHEFSVITTPGHTLGHICYFSKPYLFCGDTLFSGGCGRLFEGTALQMYQSLKKLSALPDDTLVCCAHEYTLSNMKFALSIFPHDLSINDYYRKVKELRAKNQITLPVILKNERQINVFLRTEDIDLINGINEETLLQQPEERFAWLRSKKDRF

SEQ ID NO: 4199 - protein, 329 aa, Kluyveromyces lactis
MTYLAETVTLNNGEKMPLVGLGCWKMPNDVCADQIYEAIKIGYRLFDGAQDYANEKEVGQGVNRAIKEGLVKREDLVVVSKLWNSFHHPDNVPRALERTLSDLQLDYVDIFYIHFPLAFKPVPFDEKYPPGFYTGKEDEAKGHIEEEQVPLLDTWRALEKLVDQGKIKSLGISNFSGALIQDLLRGARIKPVALQIEHHPYLTQERLIKYVKNAGIQVVAYSSFGPVSFLELENKKALNTPTLFEHDTIKSIASKHKVTPQQVLLRWATQNGIAIIPKSSKKERLLDNLRINDALTLTDDELKQISGLNQNIRFNDPWEWLDNEFPTFI

SEQ ID NO: 4200 - protein, 420 aa, Solanum demissum
MGNCVGSSARVEATLSSTTPSAYEASRFPDRKSNSSVPSSLSIPSYGRKSSSESLPTPRSESEILFSPNVKSFSFNELKNATRNFRPDSLLGEGGFGCVFKGWIDAQTLTASKPGSGIVIAVKKLKPEGFQGHKEWLTEVNYLGQLRHPNLVKLIGYCIDGDNHLLVYEFMPKGSLENHLFRRGPQPLNWATRIKVAIGAARGLAFLHDAKEQVIYRDFKASNILLDAEFNSKLSDFGLAKAGPTGDRTHVSTQVMGTQGYAAPEYVATGRLTAKSDVYSFGVVLLELLSGRRAVDNAKVGIEQNLVDWAKPYLGDKRKLFRIMDTKLEGQYPQKGAYTAANLAWQCLSNEPKLRPKMSEVLTALEELQSPKGVSKLSHTEHRAIPSPVAVSPMRHHRSPLHMTPSASPLQAYQKSPRGR

SEQ ID NO: 4201 - protein, 636 aa, Zea mays
MMESCDCIDTQYPPDELLVKYQYISDVLIALAYFSIPVELIYFVQKSAFFPYRWVLMQFGAFIVLCGATHFINLWTFSPHSKSVAVVMTIAKVSCAIVSCATALMLVHIIPDLLSVKRRESILKNKAEELDREMGLILTQEETGRHVRMLTHEIRSTLDRHTILKTTLVELGRTLGLEECALWMPSRSGLNLQLSHTLTYHVQVGSTVQTNNPIVNEVFNSPQAMRIPPTCPLARIRPLVGRYVPPEVVAVRVPLLNLSNFQINDWPDISAKSYAIMVLILPTDSVRKWRDHELELVDVVADQVAVALSHAAILEESMRARDQLMEQNVALDLARREAEMAIHARNDFLAVMNHEMRTPMHAIIALSSLLLETELTPEQRVMIETVLKSSNVLATLINDVLDLSRLEDGSLELEMGKFNLHGVLGEIVELIKPIASVKKLPITLILSPDLPTHAIGDEKRLTQTLLNVVGNAVKFTKEGYVSVRVSVAKPESSQDWRPPEFYPASSDGHFYIRVQVKDSGCGILPQDIPHLFTKFAQSRSGPARPSSGAGLGLAICKRFVNLMGGHIWIESEGLDKGSTATFIVKLGICGNPDPSDHQAANRSQAYSGSGGLARFKPFITDENDTGFSTRRNQRSF

SEQ ID NO: 4202 - protein, 199 aa, Sulfolobus tokodaii
MMIVKRFILGEYSTNTYLVVSGDEGILIDVAENPSEVIDYILTNNIKLKSIYATHGHFDHVLGVTEVKKYFNVPFFLHRSDLDLLRRDERTKGIVPDGFIDEKSIIKIGNEELKVIETPGHTMGSVCYIFDDGIFTGDTLFNGSIGRYDLGGDKNLLKKSLNRLMELNDGLTVYPGHGFFTTLGYEKLTNPFLNGEFEW

SEQ ID NO: 4203 - protein, 192 aa, Triticum aestivum
  misc_feature (106)..(106): Xaa can be any naturally occurring amino acid
MSKYGTIPTSSSAAAGAPHLGGASPLDFISRAKARGATALATRRPWRELADVHAVGLPPSLGDAYLRVRANLAHFAMNYAIVVLVVVFLSLLWQPISLIVFLVCMXVGWLRGGEGLRHKPIVLFGRVVGDGVVLAVLAAVTLILLLLTGATSNILTSLLIGFVLVVVHAALHKAEDNVDEEVGRWYAPVPAQ

SEQ ID NO: 4204 - protein, 705 aa, Pseudomonas fluorescens
MRYQLPPRRISMKHLFPSTALALFIGFGLLPMSTNTFAANSWDQLQPDRDEVIASLNVVELLKRHHYSKPPLDDARSVIIYDSYLKLLDPSRSYFMASDIAEFDKWKTQFDDFLKSGDLNAGFTIYKRYLDRVKARLDFALAELNKGVDKIDFNTKETLLIDRKDAPWLKTTAELDDLWRKRVKDEVLRMKIAGKEPKQIQETLTKRYKNQLARLDQTRAEDIFQAYINTFAMSYDPHTNYLSPDNAENFDINMSLSLEGIGAVLQSDNDQVKVVRLVPAGPADKTKQVAPADKIIGVAQGDKEMVDVVGWRLDEVVKLIRGPKGTLVRLEVIPASNAPNDQTSKIVPITREAVKLEDQAVKKSILNLKQDGKDYKLGVIEIPAFYLDFKAFRAGDPDYKSTTRDVKKLLTELQKDKVDGVVIDLRNNGGGSLQEATELTSLFIDKGPTVLVRNADGRVDVLEDENPGAFYKGPMALLVNRLSASASEIFAGAMQDYHRALIIGGQTFGKGTVQTIQPLNHGELKLTLAKFYRVSGQSTQHQGVLPDIGYPSIIDTKEIGESALPEAMPWDTIRPAIKPAVDPFKPFLAQLKAEHESRSAKDPEFVFIRDKLALAQKLMAEKTVSLNEADRRAQHADIEAKQLALENARRKAKGEEPLKELKKEDEDALAAAEPDKTKPEDDAYLSETGRILLDYLKLNTSVAKH

SEQ ID NO: 4205 - protein, 392 aa, Stigmaphyllon puberum
DLEPVNPVDVPVTAAGALKSYKLAAKAISRLQSLPSGNISLLCDVLVKEVRDLTGYDRVVVYKFHEDEHGEVVSECRISDLESYLGLHYPATDIPQASRFLFMKNKVRMICDCLAPPVKVIQDERLPQPLSFCGSTLRSPHGCHAQYMTNMGTIASLVMSVTINEDDDTMDGDQQQMTRKLWGLVVCHHNSPQFVPFPLRYACEFLIQVFGVQINKEVELAAQVREKHILQIQTMLCDMLLRDAPVAIITQSPNVMDLVKCDGAALYFKNKIWLLGVTPSKEQIRDIAQWLLEYHSGNTGLSTDSLMEAGYPGASALGDAVCGMAAVSITSRDFLFWFRSHTAKAVKWGGAKHDPDDKDDLRKMHPRSSFKAFLEVVKWRSMPWEDVEMDAI

SEQ ID NO: 4206 - protein, 392 aa, Mascagnia dipholiphylla
DLEPVNPADVPVTAAGALKSYKLAAKAISRLQSLPSGNISLLCDVLVKEVRDLTGYDRVMVYKFHEDEHGEVVSECRRSDWESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHAGPRFVPFPLRYACEFLIQVFGVQIHKEVELAAQVREKHILQIQTMLCDMLLRDAPVVIITQSPNVMGLVKCDGAALYFKNKIWLLGVTPAEEQIRDIAEWLLKYHSGNTGLSTDSLMEAGYPGASVLGDAVCGMAAVSITSRDFLFRFRSHTAKEIKWGGAKHDPDDKDDGRKMHPRSSFKAFLEVVKWRSTPWEDIEMDAI

SEQ ID NO: 4207 - protein, 487 aa, Yersinia pestis
MSTHLVWFRNDLRVTDNLALHAACQDPQASVIAVFIATPVQWAAHGMAPRQAAFLRQNLQHLQAALAARGIPLHYHQCDDFQASNTWLVDFCQQQQVDSLFYSQQYELNERLRDDALAVQLSERAITCQSFHDSVLLAPGTVLTGNNEMYKVFTPFRRAFIQRLLMSDNHCVPAPKARHAPPVLLSPLPFDYPQQSVDSQLFPAGEDAALQRLRRFCREQVQDYRQYRDLPAVPGTSCLSPYLVLGVLSPRQCFNRLWAESPEMLENADSGAFTWLNELIWREFYRHLLVAYPRLCQHHPFIGWTDGLVWNRSESQLKAWQQGQTGYPIVDAAMRQMNETGWMHNRLRMISASFLVKDLLIDWRQGERYFMSQLVDGDLAANNGGWQWAASTGTDAAPYFRIFNPTTQGERFDKDGVFIRRWLPELAAVPDSDIHQPWRWAERQQQHLDYPVPLVDHKQARLATLAAFEAAKRDSTRIPNRKEPSCY

SEQ ID NO: 4208 - protein, 276 aa, Arabidopsis thaliana
MTLGCKQAIELAVDILAKPKANVLLPSPGFPWDLVRSIYKNLEVRHYNFLPEKNFEIDFDSVRALVDENTFAIFIINPHNPNGNTYSEAHLKQLAELAKELKIMVVSDEVFRWTLFGSNPFVPMGKFSSIVPVVTLGSISKGWKVPGWRTGWLTLHDLDGVFRNTKVLQAAQDFLQINNNPPTVIQAAIPDILEKTPQEFFDKRQSFLKDKVEFGYSKLKYIPSLTCYMKPEACTFLWTELDLSSFVDIEDDQDFCNKLAKEENLVVLPGHVVCWI

SEQ ID NO: 4209 - protein, 541 aa, Corynebacterium pseudotuberculosis
MAKLIAFNQEAREGILKGVDTLANAVKVTLGPRGRNVVLEKAFGSPTVTNDGVTIAREIDVEDRFENLGVQLVKSVAVKTNDIAGDGTTTATLLAQAVITEGLRNVAAGANPVELNRGILAAADKAVEKLGERAAEVASAADIANVATVSSRDAEIGDMVAAAMEKVGKDGVVTVEESQSIESYLDVTEGVSFDKGYLSPYFITDTDSQRAELDDPYILLVRNKISSLPDFLPLLEKTVEANKPVLIIAEDVEGEPLQTLVVNSIRKTLRAVAVKSPYFGERRKAFMDDLAVVTNATVVDPEVGINLNEAGVEVFGTARRVTVTKDETIIVDGAGTSEAVENRRQQIRREIENTDSSWDREKAEERLAKLSGGVAVIKVGAATETEVSERKLRVEDAINAARAAAQEGVIAGGGSALVQIAKELRVYAEEFEGDAKVGVNALANALSKPAYWIADNAGLDGAVVVSKIADLPNGEGFNAATLEYGNLIEQGIIDPVKVTHSAVVNATSVARMVLTTEASVVEKPVEAKPQAGGHHHHHHHH

SEQ ID NO: 4210 - protein, 1820 aa, Anabaena variabilis
MNRQHKHHRCNPVNFLSKQNLLPFLLGIVILLVVVMLWLRLQAEEEIKIQQLIKQQAIATQTELVTQLKTRILALKRIGKHWEMHGSIPQAQWELEARAYLEDYGGYQAIKLVDPSWQVLRSVSVAKNKAAENLEIMPKFPQCKGATAQPSHETTLTHTVNLNQGDRVFFACVPLWMGDKFGGAVLGIFQVKQFFESVLHIAPGYKIRVFDGQELIYGQDRQSSTLPSWQQSVNINFDGMTWQLQIYPTPELLKDLYSPLPTVVLVAGIFNAGAVTLLIYFAQATKLSNHQIGRINQELADRIEKQTQVEIALRASENRLRELLETVRVIPWEVDLKTQHFTYVGPQAETLLAYPIAQWYEENFWDNHLHPHDRDWAVRFCQEAANKGQNHELEYRMLAADGRVVWLRDVVNVVEVDGTPVMLRGFMFDITDLKRVEETLRLRERALAASSNGIVISDAKLPNYPVIYVNSAFEQITGYKATEIVGRNCRFLQGNDTTQPAIEELRSALKAGKNCKVILRNYRKDGSLFWNQLSVSPIYNDNGQLSHFIGIQTDISDRQQAEASLRRQALTFENIYDGVIITNLQGQILDWNPAAERMFGYSKDHICGQSISILHKVEEDAALNSAIIAEITKQGRWSGEINFVRQDGSQGICETTIVALQDDQGQTVATISVNRDITERKHAELLLRRSEERFQAFMNHSPTPAWITDIDGTIVYLSETYRRTFQLPTQELIGTNIFDIYPPELIQTFRETIQIVARTHQVMETVESVPCSDGTVRDFLVYKFPISSKPDECLIGGIAIDITERKQAEAALRKSEERWQLVIEGNQDAIWDWNIITNETFRSARWAELIKEQNYQPIADHADCISRIHPDDYERVMAVRQDCLSRKIPNYVVEYRLRCNDDSYKWVLVHATGQWDERGNPVRMVGSIKDITERIEAQEALQRQLHRTLLLEKITQKIRQSLDSKEIFETAATQIGQALAVDRCLIHSYISHHDPHIPLVAEYNNVLDYCSMQKWEFTTTGNRHILQMMSQDKAIASANVYTDPLLQTAVPSCCEIGVKSMLAVRTSYQGEPNGAICLHQCKYFRQWTPEEIELLEAVAAQLGIALAQAQLLEQETRQREELTIKNFALEQAKRAAEAANRAKSEFLAMMSHEIRTPMNAVIGMTGLLLDTELTSQQRDFVETVLTSGDALLSIINDILDFSKIESGKLELEEQPFEVRTCVEQVIDLLAAKAAQKDIELAYLIHPQVPMQIAGDLTRLRQILTNLLNNAIKFTPEGEVVVSVRSQPSPNQKTKNCCEIIFTIKDTGIGIAPETMDLLFQPFVQADASMTRKYGGTGLGLVISKRLGEMMGGYLWVESRGCVGGNPPPGWQRKNSISSASVATGSTFYFSMTVPVVAHADLETSITSPVQLSGKRLLIVDDNPTNRQILRLQAEPWQMETYTAPSGAEALALIDQGMAFDIAILDVQMPEMDGLTLARQIRQRPSYQHLPLVILTSWGQPDTDLSDIEFAACLNKPIKQSQLFDVLAASLGNQPIRASVVPDRSAQVNSCLAQQIPLRILLAEDIVVNQKVALLILKKLGYRADVVANGLEVLEALQRQSYDVVLMDVNMPEMDGLKASQIICQTWSPRSRPYIIAMTANAMRGDREACLAAGMDHYISKPLQLEELAKALGKCHPSTSSTEKALEKTSSQNQTFTDISDLKFATIDTKILQALRDMLGGDKVAFAELINCYLTESPKLIENLNVAINTEDTQGIWKTAHKFKSSSGSVGAVFLAQLCKLLEAKGRNNNLEGCIELGSQLCQEYELVKTALYREVNKETP

SEQ ID NO: 4211 - protein, 451 aa, Oryza sativa
MMAAAAEEGEGKKGGGTVLQGRYEMGRVLGHGNFGRVHVARDLRTGRSVAVKVVAKEKVVRAGMMEQIKREIAVMKRVSHPNIVELHEVMATRSKIYLALELVRGGELFGRIVRLGRVREDAARHYFRQLVSAVDFCHSRGVYHRDLKPENLLLDEAGNLKVVDFGLSALADHARADGLLHTLCGTPGYAAPEVLRDKGYDGAKADLWSCGVILYVLLAGSLPFPDDNIVTLYRKAQRGDYRCPAWLSTDARRLIPRLLDPNPTTRISVAQLVETPWFKKTSISRPVSIELPPAFADPAPAKEEAEKDEPETLNAFHLISLSEGFDLSPLFEGDSAKGRRDGGMLFATREPASGVISRLEGVAARGGGRMRVTKSGARGVRLEGAERGGAKGRLAVAADIFSVAPSVLVVDVKKDGGDTLEYRSFCSEELRPALQDIVWGAAADPTPTAAV

SEQ ID NO: 4212 - protein, 547 aa, Caulobacter crescentus
MAAKDVYFSSDARDKMLRGVNILANAVKVTLGPKGRNVVIEKSFGAPRTTKDGVSVAKEIELADKFENLGAQMIREVASKTNDKAGDGTTTATVLAQAIVQEGLKSVAAGMNPMDLKRGIDKAVAIAIEDIKTSSKKVTTNAEIAQVGTISANGDKEVGEMIAKAMDKVGNEGVITVEEAKTAETELDVVEGMQFDRGYLSPYFITNADKMEVQLEEPLILLFEKKLSSLQPLLPVLEAVVQSGRPLLIIAEDVEGEALATLVVNKLRGGLRVAAVKAPGFGDRRKAMLEDIAILTGAQVVSEDIGIKLENVSLEMLGRAKKVSITKDDTTIVDGVGEKADIEARIAQIKRQIEDTTSDYDKEKLQERLAKLAGGVAVIRVGGSTEVEVKEKKDRVDDALNATRAAADEGIVPGGGTALLKASKALAGVVGDNDDQTAGIAIVRRALQAPIRQIAENAGVEGSIVVGKILENDNSAFGFNAQTEQYVDLVVDGVIDPAKVVRTALQNAASVAGLLITTEAAIVEAPKKGGGAPAGGGMPGGMGDMDF

SEQ ID NO: 4213 - protein, 184 aa, Hordeum vulgare
MAPRRRTLLKVIVLGDSGVGKTSLMNQYVNKKFSQQYKATIGADFLTKEVLIEDRLVTLQIWDTAGQERFQSLGVAFYRGADCCVLVYDVNAKRTFNTLGTWHDEFINQAGPSDPKQFPFILVGNKVDLDSGSRRVVPEKKAKDWCVAKGDIPYFETSAKDDCNVDTAFLCIAKLALEHEHDQD

SEQ ID NO: 4214 - protein, 192 aa, Lilium longiflorum
ELSVLCDAEVALIVFSTRGRLYEYANNSVKATIERYKKASTDISNTRSVSEANAQYYQQESTKLRQQINSLQNSNRNLLGESLSNMNLRDLKQLENRLEKAINKIRTKKNELLYAEIEYMQKREMELQSDNMYLRNKVAENEREQQQQMNMMPSTSEYEVMPHFDSRNFLQVNIVDPNQHYSCQQQTALQLG

SEQ ID NO: 4215 - protein, 448 aa, Yarrowia lipolytica
MPGTQIFGTLPAEGMTNTEVITEMSKYHDMKRTFWEKGRVSGAVYHGGKELTDLQSEAFSQFTVANQLHPDVFPGVRKMESEVVAMVLALFHGPEGSCGTSTSGGTESLLLTSLAAKMKAYNERGVTHPEIIAPITVHAGFDKAAYYFGMKLRHAPVDPKTMKVDLKAVRRMVTRNTVLLVGSAPNFPHGIIDDIEGLSDIALKHKIPLHVDACLGSFIVPYLERAGFDKILFDFRVPGVTSISCDTHKYGFAPKGSSIIMYRTPELRHYQYFVAPDWTGGIYGSPTLAGSRPGAIMVGCWATMLSVGDNGYLESCKEIVGAARKFRKAVDEEIPDLQIIGDPRASVIAFGSDSVNIYDLSDAMSKKGWHLSTLQNPPAAHVAFTKPAVAAVDDLVSDLKSCIIEMKKAGNTKVEDGTAAFYGVAGSIKTAGVADRLVCGFLDGLYKL

SEQ ID NO: 4216 - protein, 218 aa, Brucella suis
MGQLQAIIVPVTPFQQNCTILFDGETKKGVVIDPGGDLARIREAIESQGIDVEAIWITHGHIDHAAAALNLKEALGVDIIGPHRDDKFLLDNLVAAGLKYGITEGVRNVTPDQWLEEGDKVCVAGHVFDVFHCPGHVPGHVVFFNPEARFAIVGDVLFNGSVGRTDLPGGDHATLIRSIKEKLLPLGDDIGFICGHGPGGRFGEERRSNPFLTDTGYA

SEQ ID NO: 4217 - protein, 109 aa, Debaryomyces hansenii
MSTTNDFPIVLVKNLPYDVSTKSLYELAGNFGNIHQIRIPVDEQNKGTCFIVYNNLSNAIRASKSLNGINFQGRYLVSMHYSVDKSKLSEEDFKYRKEQLEKLKLEHSI

SEQ ID NO: 4218 - protein, 333 aa, Oryza sativa
MVINLEFIRAIVTADEILLLDPLTIDVIPFVEQLTHHLPLKNLVCGNGQPGGDDHGEKHDDSHGDQVPRLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWYARWKKLLGP

SEQ ID NO: 4219 - protein, 392 aa, Aspidopterys elliptica
DLEPVNPADVPVTAAGALKSYKLAAKAISRLQSLPSGNISLLCDVLVKEVRDLTGYDRVMVYKFHEDEHGEVVSECLRSDLESYLGLHYPATDIPQASRFLFMKNKVRMICDCVAPPVKVIQDERLPQPLSLCGSTLRSPHGCHAQYMTNMGIIASLVMSVTVNEDDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASALGDAVCGMAAVSITSRDFLLWFRSHTAKEIKWGGAKHDPDDKDDGRKMHPRSSFKAFLEVVKWRSMPWEDIEMDAI

SEQ ID NO: 4220 - protein, 371 aa, Burkholderia fungorum
MSTLFSPLQLRGLQVPNPIVVSPMCQYVAVDGRAGSWHVMHYGGLALSGAGTLFIESTAVEPEGRITPGDLGLWDDATHSALAHVVDGIRAHTPTRVILQLSHAGRKASSEVPWRNGQLLTPEAGGWRPYGPSATPHHPEEAAPVALDTAGLDRVRNAYVAAARRAVRLGVDGIELHGGHGYLLHQFLSPIANERTDAYGGSLENRMRFPLEVIEAVREVLPSGMPLGIKLSASDWMDAGWDLSQSVEFSRQAKRRGIDWVTASSGGISPLQKIQVAPNYQVPFSKRIREEAGVDTIAVGLVTAPTQAEDIVASGSADLVAIARGMLFNPRWGWHAAADLGGTIDGVPPSYWRAAPQGNSGIFAQATFGSR

SEQ ID NO: 4221 - protein, 392 aa, Caucanthus auriculatus
DLEPVNPADVPVTAAGALKSYKLAAKAISRLQSLPSGNISLLCDVLVKEVRDLTGYDRVMVYKFHEDEHGEVVSECHRSDLESYLGLHYPATDIPQASRFLFMKNKVRMICDCVAPPVKVIQEERLPQPLSLCGSTLRSPHGCHAQYMTNMRIIASLVMSVTVNEEDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASALGDAVCGMAAVSITSRDFLLWFRSHTAKEIKWGGAKHDPDDKDDGRKMHPRSSFKAFLEVVKWRSMPWEDIEMDAI

SEQ ID NO: 4222 - protein, 496 aa, Staphylococcus aureus
MDDKQHTSSSDDERAEIATSNQDQETNSSKRVHLKRWQFISILIGTTLITAVITVVAYIFINQKISGLNKTDQANLNKIENVYKILNSDYYKKQDSDKLSKAAIDGMVKELKDPYSEYLTKEQTKSFNEGVSGDFVGIGAEMQKKNDQIMVTSPMKGSPAERAGIRPKDVITKVNGKSIKGKALDEVVKDVRGKENTEVTLTVQRGSEEKDVKIKREKIHVKSVDYKKKGKVGVITINKFQNDTSGELKDAVLKAHKDGLKKIVLDLRNNPGGLLDEAVKMANIFIDKGKTVVKLEKGKDTEAIQTSNDSLKEAKDMDISILVNEGSASASEVFTGALKDYNKAKVYGSKTFGKGVVQTTREFKDGSLLKYTEMKWLTPDGHYIHGKGIKPDVTIDTPKYQSLNVIPNTKTFKVGDDDKNIKTIKIGLSALGYKVDNESTQFDQALENQVKAFQQANKLEVTGEFNKETNNKFTELLVEKANKHDDVLDKLINILK

SEQ ID NO: 4223 - protein, 392 aa, Malpighia emarginata
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCVAPPVKVIQDDRLPQPLSLCGSTLRSPHGCHAQYMTNMGIIASLVMSVTVNEDDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASALGDVVCGMAAVSITSRDFLFWFRSHTAKEIKWGGAKHDPDDKDDGRKMHPRSSFKAFLEVVKWRSMPWEDVEMDAI

SEQ ID NO: 4224 - protein, 110 aa, Sandersonia aurantiaca
MATLGAPRDVPAGGENSADVEELARFAVAEHNKKENALLEFGRVVKAKEQVVAGTLHHLTVEAIDAGNKKLYEAKVWVKPWLNFKELQEFRHAGDSPSVTPADLGAKRGD

SEQ ID NO: 4225 - protein, 392 aa, Madagasikaria andersonii
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCVAPPVKVIQDERLPQPLSLCASTLRSPHGCHAQYMTNMGIVASLVMSVTVNEEDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLEYHSGNTGLSTDSLMEAGYPGASALGDAVCGMAAVSINSRDFLLWFRSHTAKEIKWGGAKHDPGDKDDGRKMHPRSSFKAFLEVVKWRSMPWEDMEMDAI

SEQ ID NO: 4226 - protein, 189 aa, Psychrobacter arcticus
MNNNDTFNNDHSIQEQPESSVKADGVQPISAQTTGYTFNHTMLRVKDPVRSLEFYTGVLGMTLLAVKKFPAMGFDLYFLAKLTESERENLPSGNDLEIFAFRQRGILELTHNYGTETKADFSYHDGNQEPQGFGHICFNVPDLNAAVAWFDENHVEFKKRPDEGSMKNIVFIKDVDGYWIEIVQADLMA

SEQ ID NO: 4227 - protein, 80 aa, Glycine max
VKQLNDLLTEKNKDTGWDVPIHVDAAIGGFIAPFLYPELEWDFRLPLVKSINVSGHKYGLVYPGVGWVIWRSKDDLPEEL

SEQ ID NO: 4228 - protein, 475 aa, Lactobacillus gasseri
MKEFKFPKGFYFGGATAAYQCEGATKEDGKGEVIWDKYLREQGTINPDPACDFYHRYPEDLELCKEFHINAIRVSIDWARIFPEGEGRIEPRGVEYYHKLFKKCHEEGVEPFVTLHHFDTPQALQDKGGWLSQEMLDAFVEYAKFCFKEYAGEVRYWITINEPTSMAGQQYVGGTFPPAYKDQFDKCFKAEYNQNLVHARIVNAYKEAGYTGQIGIVHALQTVYPATDSEGDKHAAELKDVLENKFYLDGTLAGKYSKHTLALVKEIIDANGQQMIDIKPEDEKVLLKAAKQLDFVGVNYYFSKFMKEYHGDTEIIHNGTGEKGTDVNRMKGVGEEIHPKDLPATDWDWIIYPQGMYDQLKRVYDDYPLVHSIYITENGMGYKDKFEGEDKIIDDTPRIDYLKQHMEEVAKAIEAGIPVNGYFVWSLQDMFSWTNGYSKRYGLFYVDFKTQKRYAKKSAYWYKKLAETREIPPVD

SEQ ID NO: 4229 - protein, 137 aa, Glycine max
  misc_feature (28)..(28): Xaa can be any naturally occurring amino acid
  misc_feature (101)..(101): Xaa can be any naturally occurring amino acid
  misc_feature (110)..(110): Xaa can be any naturally occurring amino acid
  misc_feature (121)..(121): Xaa can be any naturally occurring amino acid
GSRIKPSISMFLTSCNIKSTGHKMGISXKGSDQILERYLYLHNVPNNEDFDPDTRLKNHALHKYDSVPAIQLTFASGTHTRVLYLDKTTVTTSMNIDPDCXKRSRSDTGXILKCTPRRASXDEQHSYLPQPILYSQK

SEQ ID NO: 4230 - protein, 591 aa, Oryza sativa
MCGILAVLGVADVSLAKRSRIIELSRRLRHRGPDWSGIHCYQDCYLAHQRLAIVDPTSGDQPLYNEDKSVVVTVNGEIYNHEELKANLKSHKFQTASDCEVIAHLYEEYGEEFVDMLDGMFAFVLLDTRDKSFIAARDAIGICPLYMGWGLDGSVWFSSEMKALSDDCERFISFPPGHLYSSKTGGLRRWYNPPWFSESIPSTPYNPLLLRQSFEKAIIKRLMTDVPFGVLLSGGLDSSLVASVVSRHLAEAKVAAQWGNKLHTFCIGLKGSPDLRAAKEVADYLGTVHHELHFTVQEGIDALEEVIYHVETYDVTTIRASTPMFLMSRKIKSLGVKMVLSGEGSDEIFGGYLYFHKAPNKKEFHEETCRKIKALHLYDCLRANKSTSAWGVEARVPFLDKNFINVAMDIDPEWKMIKRDLGRIEKWVLRNAFDDEEKPYLPKHILYRQKEQFSDGVGYSWIDGLKDHANEHVSDSMMMNASFVYPENTPVTKEAYYYRTIFEKFFPKNAARLTVPGGPSVACSTAKAVEWDAAWSKNLDPSGRAALGVHDAAYEDTLQKSPASANPVLDNGFGPALGESMVKTVASATAV

SEQ ID NO: 4231 - protein, 345 aa, Bacillus anthracis
  misc_feature (274)..(274): Xaa can be any naturally occurring amino acid
  misc_feature (277)..(277): Xaa can be any naturally occurring amino acid
MNSELFSPYTIKDVTLKNRIVMSPMCMYSSENEDGQVTNFHLIHYGTRAAGQVGLVMIEATAVLPEGRISNKDLGIWDDSLIEGLHKTTTFIHDNGAKAAIQLAHAGRKAELETDALAPSAVPFNETMKIPVEMSIHQIKNTILAFQQAAIRSKQAGFDVIEIHGAHGYLINEFLSPLSNKRTDEYGGSPENRYRFLREIIDSINEVWNGPLFVRISANDYHPDGLTVQDYVQYTKWMKEQGVDLIDCSSGAVVPARIDVYPGYQVQYAKHIKXHAXIATGAVGLITTGAQAEQILNNNEADLIFIGRELLRNPYFPRIAANELGFELEEPHQYERAPGKISTNK

SEQ ID NO: 4232 - protein, 394 aa, Triticum aestivum
MGLAENHLSLDLVREWMEEHAGPAMTPARGDEERDLTISGLATYQPYDGILALKMALAGFMRQIMHESVSFDPSQMVITSGATPAMEILSSCIADPGNAFLVPSPYYPGWDRDIKWRTGIELIPVPCRSTDNFNISITALEIAYNQAKKRGVRVRGVLISNPSNPTGSFVPKQTLRDLLDFATEKNIHLISDEVFAGSTFGSGEFVSVAEVVNELEDFDRGRVHIIYGLSKDLSLAGFRVGVIYSYNESIVEAAAKIARFSSVSTPTQRLLVAMLSDQKFISNYLKVNRERLRKAYNLLVDALKQVGIECFKSSGGFYCWADMSKFIRSYSEKGERRLWDRLLEEAKVNVTPGSSCHCIEPGWLRCCFTTLREQDIPVVVERPRRVTDGHKSNC

SEQ ID NO: 4233 - protein, 606 aa, Unknown
  Delphinium 'MagicFountains dark blue'
MDSCACIETQWPADELLVKYQYISDFFIALAYFSIPLELIYFVQKSAFFPYRWVLMQFGAFIVLCGATHLINLWTFSMHSKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRTGMNLQLSHTLRHQIPVGSTVSTNLPIVTQVFNSNQAIKIPHTCPLARIGPTAGRYVPPEVVAVRVPLLHLSNFQINDWPELSAKSYAVMVLMLPTDSARKWHDHELDLIEVVADQVAVALSHAAILEESMRARDMLMEQNIALDMARREAEMAIRARNDFLAVMNHEMRTPMKAVIALSSLLLEIELTPEQRVMIETVLKNSNLLAALINDVLELSRLEDGSLELDIRTFNLHGIFREVLNMIKPITAVKKLSLTLMLSPDLPVVAVGDEKRLMQIMLNVVGNAVKFTKEGYVSVIASVAKAESLREWQAPEIFMVSSDSHFHLCVQVKDSGCGISPQEIPHLFTKFTQLRSGQNRSNDGAGLGLALCKRFLNLMEGHIWVDSDGTDKGCTVTIIVKLGICEGQPEPSNLQVVSRPRLS

SEQ ID NO: 4234 - protein, 641 aa, Rhodospirillum rubrum
MCGLVGIYHPTASRPVDRALVEAMNQRQFHRGPDDGGVFIGPGIGLGHRRLSIVDLGGGRQPMTNDGGGVVLVYNGELYNNAELVAELKAAGHVFRTASDTETVIHAWEEWGEDSVRHLRGMFAYALWDDRSQTLFLARDRLGIKPLHYTCLADGRVMFGSELKSLTGVEDIPKVVDPLAIEDFLAYGYVPDPRSIFKDILKLEAGHTLTFRRGEAPGRPHCYWDVSFTTPSRPAKTDDLCAEVIDRLDEAVRCHLVADVPVGAFLSGGVDSSAMVALMAGATDRPVETCSIAFSEARFDESAYAKTVAERYGTHHRVHTLPAQALSEVGPLTAIYDEPFADSSALPTLKVCQAARETVTVALSGDGGDELFAGYRRYRFHTAEEAVRRILPQAARGPLFGALGRVYPKLDWAPQVLRAKSTFQALGRDRVEGYFNAVSVIPDGLRRGLYSKTMRAELAGYGASEVLRRHMTRAPADHPLSIAQYVDLKTWLPGDILTKVDRASMATSLEVRVPMLDHRFVEWTAGLSPDLKLSGGTGKYLLKRALRPLLPDEVLYRRKMGFSIPLTDWLRGPWSGRTRALAGRSALVTSGLFDGAAVAKLVEQHLGGNWDHGAALYALIVLDDFLTAHVGAACLPARMSA

SEQ ID NO: 4235 - protein, 192 aa, Oryza sativa
MSKYGTIPTSSSSSSSGAAPPPLPLGGGGGASPLDFFSRAKARGATALATRRPWRELADPHALGLPPSLADAYLRVRANLAHYAMNYAIVVLAVVFLSLLWHPASLIVFLVCMVAWLVLYFLRDEPIVLFGRVVGDGAVLAALAAVTLVLLLLTGATANIVSSLLIGVLLVVLHAALHKAEENVDDEVGRWI

SEQ ID NO: 4236 - protein, 254 aa, Brassica rapa
MGRGRVEMKRIENKINRQVTFSKRRAGLLKKAHEISILCDAEVSLIVFSHKGKLFEYSSESCMEKVLERYERYSYAEKQLKAPDSHVNAQTNWSMEYSRLKAKIELLERNQRHYLGEDLESISIKELQNLEQQLDTSLKHIRSRKNQLMHESLNHLQRKEKEILEENSMLTKQIKERESILRTHQNQSEQQNRSHHVAPQPQPQLNPYMISHQASPFLSMGGMYQGEDPTAVRRNRLDLTLEPIYNCNLGYFAA

SEQ ID NO: 4237 - protein, 506 aa, Symbiobacterium thermophilum
MSGIAGILGKPDKARIVRMLEQQAHRGPDGRGIWTATAGFGLGHVRLATVDVAGGGQPLSNEDGSLWLAMTGAIYNHGALRRELEGRHAFRTQSDAEVVVHLFEEYGPACVERLDGMFAIAIWGEEVGLFLARDPLGIQPLYWGEDEEGNVLFASEIKALVGETRFVREFPPGHRWRAGEPLEPYERLPAHTGELADPDQIVLALDRLLHAAVRKQLAADVPVGCLLSGGLDSSLVTAIARQHAEGELHTFAVGLEGSADLEQARMVAGELGTIHHERVLTEKEVTAVLPRVVDALESCDPALVRSAVATYYVAELAAGHVKVVLSGEGADELFAGYDYLAEFERDAGALGAELYEITAAMHNCNLQRVDRMTQVHGVEARMPFADQAVVDFAFRIHPRLKRRDGESKWILRRVAEQYLPPAIVWREKQKFAIGSGIAPLLEHYAAKAVPDAAFRRARSPKGVPFASKEEFLYWSLFRERYGREDVLALMGRSRSLNQGQRWVGAL

SEQ ID NO: 4238 - protein, 420 aa, Solanum demissum
MGNCVGSSARVEATLSSTTPSAYEASRFPDRKSNSSVPSSLSIPSYGRKSSSESLPTPRSESEILFSPNVKSFSFNELKNATRNFRPDSLLGEGGFGCVFKGWIDAQTLTASKPGSGIVIAVKKLKPEGFQGHKEWLTEVNYLGQLRHPNLVKLIGYCIDGDNHLLVYEFMPKGSLENHLFRRGPQPLNWATRIKVAIGAARGLAFLHDAKEQVIYRDFKASNILLDAEFNSKLSDFGLAKAGPTGDRTHVSTQVMGTQGYAAPEYVATGRLTAKSDVYSFGVVLLELLSGRRAVDNTKVGIEQNLVDWAKPYLGDKRKLFRIMDTKLEGQYPQKGAYTAANLAWQCLSNEPKLRPKMSEVLTALEELQSPKGVSKLSHTEHRAIPSPVAVSPMRHHRSPLHMTPSASPFQAYQKSPRGR

SEQ ID NO: 4239 - protein, 548 aa, Yersinia pestis
MAAKDVKFGNDARIKMLRGVNILADAVKVTLGPKGRNVVLDKSFGSPTITKDGVSVAREIELEDKFENMGAQMVKEVASKANDAAGDGTTTATVLAQSIITEGLKAVAAGMNPMDLKRGIDKAVIAAVEELKKLSVPCSDSKAIAQVGTISANSDSTVGELIAQAMEKVGKEGVITVEEGSGLQDELDVVEGMQFDRGYLSPYFINKPETGSIELESPFILLADKKISNIREMLPVLEAVAKAGKPLLIIAEDVEGEALATLVVNTMRGIVKVAAVKAPGFGDRRKAMLQDIATLTAGTVISEEIGLELEKTTLEDLGQAKRVVINKDTTIIIDGVGDEAAIQGRVAQIRQQIEDATSDYDKEKLQERVAKLAGGVAVIKVGAATEVEMKEKKARVEDALHATRAAVEEGVVAGGGVALIRAAHAIAGLKGDNEDQNVGIKVALRAMESPLRQIVVNAGEEASVIANKVKAGEGSFGYNAYTEEYGDMIAMGILDPTKVTRSALQYAASIAGLMITTECMVTDLPRDDKGADMGAGGMGGMGGMGGMM

SEQ ID NO: 4240 - protein, 448 aa, Bacillus pseudofirmus
MSNEREMQNKKDQQLESFRVEDEGKKLTTNQGLKVSEDEFSLKAGERGPTLMEDFHFREKMTHFDHERIPERIVHARGFAAHGEFQVYDSMKEFTKAKFLQDPSVKTPVFVRFSTVAGSKGSAETVRDARGFATKFYTEEGNYDLVGNNIPVFFIQDAIKFPDLVHALKPEPHNEIPQAQSAHDTFWDFIANNQESAHMVMWAMSDRSIPRSFRMMEGFGVHTFRFVNEEGKAHFVKFHWKPVLGIHSLVWDEAQKIAGKDPDFHRRDLWESIENGDYPEYELGVQLISEEDEFNFDFDVLDPTKIWPEEEVPVKIIGKMTLNRNVDNVFAETEQVAFHPGHVVPGIDFTNDPLLQGRLFSYTDTQLIRLGGPNFHELPINRPVCPFHNNQRDGYGRQTINKGQVSYHKNSLAANTPQPASEEEGGYAHYQEKVEGRKVRKRSESFKD

SEQ ID NO: 4241 - protein, 215 aa, Yersinia pestis
MRRVLITGFEPFGGERINPSWEVVKQMNDLMMGGVRIVARQLPCAFGEALTALNTAIDDVQPVLVLAIGQAGGRADITIERVAINVDDARIPDNLGNQPVDQPIIQEGPAAYFTRLPIKAMVQGIREAGIPASVSQTAGTYVCNHVMYGLLHRLNQFNNEVKGGFIHIPYLPEQAVDHPGAPSMSAQSVLVALELAISIALQIEHDLHITGGAVH

SEQ ID NO: 4242 - protein, 1076 aa, Ustilago maydis
MADAHQSPLLLLPLKTTEEVDLGSAVKSLITNSYGEDSKKYSEQTSQLNRARQDAVKGAASDATGRDLLFKWFHMLEMLELRFPELRVPFPWKDAFTQKTISQSSLAYEKASIIFNIAATLSSLASSQPRMPGNADGLKRAYAALRQAAGMLSYINENFLHAPSTDMSKDVVKCLVGITLAQASEVFLEKTIEEKKGAGLISKLASQTAAAYTGLVDDSRENVTKGIFERSWAYLIQVKARHFTSVMQYYKALADDAAGSHGACLVRLTVAETAAKEARNLLTTFSASATASVTADRPSLPSDAASALVAIVNAQVARCTERKESAVKDNDLIYHDILPSESSLPAVDKLVAANPIPIQEIFAAPEVQRVIGPDLFQNLVPLGVHEKASLYSEEKAKIARAESERHDLATGEMQASLDYLGLPSSLQKYRALAQGSGSNAMLDSLADPGPEVMRWSTEEAEGGGGRGADGLGVGATGVDSALQRIESIKSQAANDIDAALAALDDENRECEKQRVRFGHKWSQDPAGLHTKDMRVNLKENKEAMQQASQNDAQIGGLWKSIRQDVQLLVSGREALEAAFAAALTGQTGLYGEGSAPTSLIDTSAEEESASEGEIASVRAKLAQIDEALIKLNKIKKERGEVLADLKEKIQTDDISQVLVLNRRAQNVDSSIFAAELEKFKPHQNRIAVSLHHQQALLAEVETAFKELIELPASKAAGAKWDEKEQARNKLVARLKRARDSNAQVRAGVAKGLQFYADLQEIVKATRQNVNRYVGERKSERSKLVSELEWEEKGSDGLSSSMAGLSGLGGAGGHPAPPTPHRHTSYASAYGGAGAPGPLSPGPPPAALPGVRQTSNSGPPPPPPLPHQQASYQQQPPPAAAAPAHDPYSSMFSSGPFSAALQQPASPQHQRPPTHYGSQLGYACDAPQRAPALPPPPQQFQPSFAPSVASPTQSRYTSPPPVPQGQQTFSGSSGYGMPPAPLQHGGGYGGSQPYAAHDYSSPPPQSPYGVPIGQQQYGGGHAQNQPQYQAYGAPPQQHASQQVYGSRAQPPPPQQQQYQQPSYAQHGGYQGGYQPPY

SEQ ID NO: 4243 - protein, 139 aa, Oryza sativa
MLNISDGQKIGILLTGFGLFFTFLGVVLFFDRGLLAIGNLLFLTGVTLIIGGRKTFRFFFQWRKIKGTACFLGGIALVIIGWPFIGMIVEVFGFINLFGDFFPVALGFARRLPIIGHILELPAVQYVTDRLIDSKRLPV

SEQ ID NO: 4244 - protein, 673 aa, Yersinia pseudotuberculosis
MLAYPHLFTPLDLGFTTLKNRILMGSMHTGLEELPDGPQRLAAFYAERAAGGVGLIVTGGIAPNMKGVVYQGASVLNDAAQIPHHQVVTEAVHQAGGKIALQILHAGRYSYQKHPVAPSALQAPINPFVPQALSHEEILQTIADFAHCAQLAKQAGYDGVEIMGSEGYLINQFLTARTNQRDDEWGGDFTHRMRFAVEIVRAVRQATGHDFILIYRLSMLDLVEEGSNWVEIEQLAQAVEQAGATVINTGIGWHEARIPTIATMVPRAGFSWVTRKLMGKVNIPLITTNRINDPAVAEQVLADGCADMVSMARPFLADAAFVQKAVQGRADEINTCIGCNQACLDQIFDGKLTSCLVNPRACRETEMPELPTDAPKRLAVVGAGPAGLAFAVTAARRGHQVTLFDAAAEIGGQFNIAKQIPGKEEFYETLRYFRRQLVLNGVTLQLNTLVQVKQLAEFDEVILACGIQPRLPCINGIDHPKVLTYLDVLRDKKPVGQRVAIIGAGGIGFDTAEYLSQSGDSPRFDSTAFSTEWGIDQDLAHRGGLSPAGAKVPPSPRQIFLLQRKASKVGEGLGKTTGWIHRTSLAMRGVKMLNSVSYEAIDDKGLHIIRAEQACCLPVDTIIICAGQEPRRELHQPLLDMGKTVYLIGGADKAVELDARRAIDQGTRLALAI

SEQ ID NO: 4245 - protein, 249 aa, Brassica napus
MDEGGSSHDAESSKKIGRGKIEIKRIENTTNRQVTFCKRRNGLLKKAYELSVLCDAEVALVIFSTRGLLYEYASNSVKGTIERYKKACSDAVNPPTVTEANTKHYQQEASKLRRQIRDIQNSNRHIVGESLGSLNFKELKNLEGRLEKGISRVRSKKSELLVAEIEYMQKREMELQHVNMYLRAKIEQGARLNPEQHGSGVIQGTAVYESGLSSSHDQSQHYNRNYIPVNLLEPNQQFSGQDQPPLQLV

SEQ ID NO: 4246 - protein, 552 aa, Mesorhizobium loti
MAAKDVKFSRDARERMLRGVNILADAVKVTLGPKGRNVVIDKSFGAPRITKDGVTVAKEIELEDKFENMGAQMVREVASKTNDIAGDGTTTATVLAQSIVQEGHKAVAAGMNPMDLKRGIDLAVTDVVATLIKNAKKIKTSEEVAQVGTIAGNGDESVGKMIAEAMQKVGNEGVITVEEAKTAETELEVVEGMQFDRGYLSPYFVTNADKMVADLEDVYILLHEKKLSNLQTMLPVLEAVVQTSKPLLIISEDVEGEALATLVVNKLRGGLKIAAVKAPGFGDRRKAMLEDIAILTGGQVISEDLGIKLENVGLNMLGRAKKVSISKENTTIVDGAGKKEEIQGRVAQIKQQIEETTSDYDKEKLQERLAKLAGGVAVIRVGGATEVEVKEKKDRVDDALNATRAAVEEGIVPGGGVALLRASLSINAVGANSDQAAGINIVRRALQAPARQIAANAGAEASIVAGKILENKGATFGYNAQTGEYGDMIAMGIVDPVKVVRTALQDAASVAGLLVTTEAMIAEAPKKESAGGGGMPGGMGGGGMGGMGGMDF

SEQ ID NO: 4247 - protein, 674 aa, Unknown
  Acinetobacter sp. ADP1
MSFYPHLLAPLDLGFTTLKNRIMMGSMHIGLEEAPGGYERMAAFYAERAKGEVGLIVTGGIAPNDAGRTFAHASKLDTREEAVKHKIITQAVHDAGGKIAMQILHTGRYSYQQNIVAPSAIQAPINPIKPQELSSAEVWQTVSDFVNCAKLAQYAGYDGVEIMGSEGYLINEFIAARTNHREDEWGGHYENRIRFPIEIVKRTRAEVGENFIIIYRLSMLDLVEGGSTLDEVIHLAKEIEKAGATIINTGIGWHEARIPTIATKVPRAAFTWVTEKIRPHVKTPLITSNRINTPEMAEHVLANGQADLISMARPMLADPEFALKAGEGRSDEINTCIGCNQACLDHIFTGTVASCLVNPRACHETELKFPQADKVKQIAVIGAGPAGLSFATYAANRGHQVKIFEASEQIGGQFNIAKTIPGKEEFYETLRYFKRQIELQPNIELILNHKATLDELMQASFDEIVIATGVIPRHLNIPGIDHPKVLSYLDVLKNRKPVGKRIAIIGAGGIGFDTAEFLTHEGESASLNPKKFYDEWGIDTSYAHVGGLKQPVIEASEREIYLLQRKASSVGANLGKTTGWIHRTGLKHRNVKMIAGASYEKIDDQGLHIMIGDKATVLEVDNVVICAGQESYTAMYEALRESGKNVHLIGGAKEAGELDAKRAIRQGAELAATL

SEQ ID NO: 4248 - protein, 158 aa, Petroselinum crispum
MDFRLMGFNHPLLNTLSPHCDEDNQDSSNKNKSEQARSYVRDAKAMATTPADVKEYPNSYVFVVDMPGLKSGDIKVQVEEDNVLVVSGERKREEEKEGVKYVRMERKVGKFMRKFVLPENADLENINAVCQDGVLSVTVQKLPPPEPKKPKTIEVKIA

SEQ ID NO: 4249 - protein, 304 aa, Zea mays
SARALVPYYLEEEANWNLDFANIRQAVAEARSKGITVRATVIINPGNPTGQCLSEANIRELVRYCYHENLVLLADEVYQQNVYQDERPFISARKVMFDMGPPISREVQLVSFHTVSKGYWGECGQRGGYFEMTNLPPKTVDEIYKVASIVLSPNVPGQIFMGVMVNPPKPGDISYPKFTAESKSILESLRRRARMMTDGFNSCRNVVCNFTEGAMYSFPQIQLPARAIEAAKRAGKAADVFYCLKLLEATGISTVPGSGFGQKEGVFHLRTTILPAEEDFPTIMSSFKKFNDSFMEQYEGYSRM

SEQ ID NO: 4250 - protein, 242 aa, Unknown
  Petunia x hybrida
MEFQSDLTREISPQRKLGRGKIEIKRIENTTNRQVTFCKRRNGLLKKAYELSVLCDAEVALIVFSSRGRLYEYANNSVKATIERYKKACSDSSNTGSIAEANAQYYQQEASKLRAQIGNLQNQNRNFLGESLAALNLRDLRNLEQKIEKGISKIRAKKNELLFAEIEYMQKREIDLHNNNQYLRAKIAETERSQQMNLMPGSSSYDLVPPQQSFDARNYLQVNGLQTNNHYPRQDQPPLQLV

SEQ ID NO: 4251 - protein, 840 aa, Xanthomonas oryzae
MASAPSGTIDTGRPLARPFAAIVLRNAGGELFGSAGHFHPQLHVIGHPLRIQQVGLDCRAHRTAWLGDMRAIVEAALRRQRLHIRKTAFGQILFAGRLELAHAGRVDQTRTGRQRNQRAVRGGVTAARIVFAHPIGLHLLGAQQGVGQGRFARTGRAHQYRRTAIAQPRPQRSHAGRILGIDRAQRNVLRLQLFQHRQRILGMFGLIGLGQHHHRLRTAAAHQQQIALDATRIEVRIQPAHDEHRIDIGRDHLLVVMRAGRPPLDRSAPRQQRHDALALHQHPIAHRRPLMAGEARPLPLRQRLGLEAGLRRIGHHIAGAVLLHHPRRQRLRMRGEDCLPGRLFRRPRPGPADGLEGGVIGGDVAHGAILAGWPQRLVQSGPAGRLTRHLTSLPMQACPLVIFPIPCQVSRLQPARRMSTAPQKPLAIRERLSEVRYEIRGELARRARELEAQGRKLIKLNIGNPGAFGFRAPEHLQRAIADDMGRTDPYTHQQGLLEAREAVAKAYARRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRALLERIVAIATKHNLLLLVDEIYDQVLYDGAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLSLVAPAGALYAFPAVVGAAARNFDDHAFALDLMNKEGVLVVPGSSFNVPYRHHFRVTLMPEASVMRDVFARIDRALARRAEAVTKVVPLKSRSVA

SEQ ID NO: 4252 - protein, 526 aa, Triticum aestivum
MSAIKPPPPDRPPQAARLPSPSSSSSAAAAAKQGGTGSRGLLMGRYELGRVLGKGTFAKVYHARHVQTGESVAIKVLDREKAVRSGLVSHIKREIAVLRRVRHPNIVHLFEVMATKTKIYFVMELLVRGGELFSRVSKGRLKEDIARRYFQHLISAVGFCHTRGVFHRDLKPENLLVDEAGNLKVSDFGLSAVAEPFQPEGLLHTFCGTPAYVAPEVLARRGYEGAKADIWSCGVILFVLMAGYLPFHDQNLMAMYRKVYKGEFRCPRWFSKDLTSLIMRFLDTNPSTRITLPEVMESRWFKKGFRPVKFYIEDDQLYNVIDAENDMLDLGLPDPLPQPLPPPPPSPSPQQVDGDDSGSESDASVVSCPATSSFEERHRLRGPLPRPASLNAFDIISFSRGFNLSGLFEEKGDEVRFISGEPMPDIITKLEEIANVKSFAVRKKDWRVSLEGTREGVKGPLTICAEIFELTPSLVVVEVKKKAGDKEEYDDFCNKELKPGMQHLVHQMVPVPNTPTISELAERPSR

SEQ ID NO: 4253 - protein, 284 aa, Physcomitrella patens
MGRGKIEIKKIENTTSRQVTFSKRRGGLLKKAHELAVLCDAEVALVIFSSTGKLFEYASSGSIRDIIDRYKKGSDGMQNGARNDFMGCEVVKLREQLEQLKASHRHMLGEDLSLLKVPDLLQLEQQLDLGASRVRARKNQLILEEVESLRRKEHELLIANEDLRQKLADAQGIADAVTARANVSESPRPLTSALTRDIVMSSQQQEVTVHPHPNLRDAQRSQTSLQLGMFSSESYLPSSSRGPSEHPIPVGPEGCAGESAMRWEHPHFHSQNRLHANISPSVRI

SEQ ID NO: 4254 - protein, 436 aa, Thermus nonproteolyticus
MTENAEKFLWGVATSAYQIEGATQEDGRGPSIWDTFARRPGAIRDGSTGEPACDHYHRYEEDIALMQSLGVGVYRFSVAWPRILPEGRGRINPKGLAFYDRLVDRLLAAGITPFLTLYHWDLPQALEDRGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRYFLDPILGRGYPESPFQDPPPAPILSRDLEAIARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQTGGSAH

SEQ ID NO: 4255 - protein, 511 aa, Oryza sativa; identical to SEQ ID NO: 96

SEQ ID NO: 4256 - protein, 471 aa, Pyrococcus furiosus
MCLITGGINLTKEEIVKMIITGKHRGPDSFGVWSDGLVIKSEDFSEIKEIRGGNVVLAQCRLAMTGSKNYTQPFYNDIVLVHNGEIYNHESLRKWLIERGASFESDVDSEVILRLLEYFIFDKKMKVEEAVKKAMLMLRGDYAVAFALNGKIYLFRDPIGVRPLYYSPRGRFGSEKKVLWSVGEEAIPVNPGELVKLPEEEKMKLLSPWDIKGSGKGYYDGLKNLLQDAVRIRTAKKVGVLFSGGLDSSLIALLASKYSKVVLYTAGTEDSKDVEWARKVSDELRLELREYIFTREEVEREIKNVMFAIEEPNPMNLAIAIPLYFATKLARKDDVKVLLSGQGADELFGGYAKYLENPSLMRKDIEEIAERNLGRDDKVGMLNGVEVRYPYLDLPFVSLALRVPLEEKIREGVRKAILRRIALDFGLPEEVAFREKKAAQYGSNAQKILSKIAKKSLREFAQKLFSEVFST

SEQ ID NO: 4257 - protein, 164 aa, Pseudomonas putida
MSLNDLNTLPALLPKRTLPLRNSFQPHHRARQGHREVADSIPACLVSNWWTSDFVEAKFSLYFLALVDPATIPADDDARHQWMKSIPGVLELTHNHGTERDADFAYHDGNTDPRGFGHICVSVPDVVAACERFEALQVPFQKRLSDGRMNHLAFIKDPMVTGSK

SEQ ID NO: 4258 - protein, 719 aa, Xanthomonas axonopodis
MSQTLQALADGLPADAFAVLGPKLLADGRRQVRVLAPGAEAMGLIDPRGKLLARMQASAIDGVFEGTLAVDGPYRLRIVWPDRVQEVEDPYAFAATLDESLLLQIAAGDGQALRRALGAQHLHCGDVPGVRFALWAPHAQRVAVVGDFNGWDVRRHPMRQRIGGFWELFLPRVDAGARYKYAVTAADGRVLLKADPVARQTELPPATASVVPSAATFAWTDAAWMANRDPAAVPGPLSIYEVHAASWRRDGHNQPLDWPTLAEQLIPYVQQLGFTHIELLPITEHPFGGSWGYQPLGLYAPTARHGSPDGFAQFVDACHRAGIGVILDWVSAHFPDDAHGLAQFDGAALYEHADPREGMHRDWNTLIYNYGRPEVTAYLLGSALEWIEHYHLDGLRVDAVASMLYRDYGRAEGEWVPNAHGGRENLEAVAFLRQLNRDIATQFPGVLTIAEESTAWPGVTAAISDGGLGFTHKWNMGWMHDTLGYMQRDPAERAHHHSQLTFGLVYAFDERFVLPLSHDEVVHGTGGLLGQMPGDDWRRFANLRAYLALMWAHPGDKLLFMGAEFGQWADWNHDQSLDWHLLDGARHRGMQQLVGDLNAALRRTPALYRGTHRAEGFDWSVADDARNSVLAFVRHDPDGGAPLLAVSNLTPQPHHDYHVGVPRAGLWREILNTDSAHYGGSNLGNSGRLATEPVGMHGHAQRLRLTLPPLATIYLQAEK

SEQ ID NO: 4259 - protein, 285 aa, Arabidopsis thaliana
MDRSVVPISLAPFQFLLVFWIFLTSVHTNPNKQQKTVVSLSLWWNSKNRIRGCVWFFFLLRVTRTMGQQNLIYSFVARGTVILVEYTEFKGNFTAVAAQCLQKLPSSNNKFTYNCDGHTFNYLVENGFTYCVVAVESVGRQIPMAFLERVKEDFNKRYGGGKATTAQANSLNREFGSKLKEHMQYCVDHPDEISKLAKVKAQVTEVKGVMMENIEKVLDRGEKIELLVDKTENLRSQAQDFRTQGTKIRRKMWFENMKIKLIVLGIIITLILIIILSVCGGFKCT

SEQ ID NO: 4260 - protein, 1287 aa, Streptococcus pneumoniae
MRKTPSHTEKKMVYSIRSLKNGTGSVLIGASLVLLAMATPTISSDESTPTTNEPNNRNTTTLAQPLTDTAAGSGKNESDISSPGNANASLEKTEEKPATEPTTPAASPADPAPQTGQDRSSEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWRLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDAKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHEHLSDYASSNSNYNWGYDPQNYFSLTGMYSSDPKNPEKRIAEFKNLINEIHKRGMGAILDVVYNHTAKVDIFEDLEPNYYHFMDADGTPRTSFGGGRLGTTHHMTKRLLVDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRNPAYRTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGSVGIANPKGLEWTEKGLKLNALTATVLRVSQNGTSHESTAEEKPDSTPSKPEHQNEASHPAHQDPAPEARPDSTKPDAKVADAENKPSQATADSQAEQPAQEAQASSVKEAVRKESVENSSKENISATPDRQAELPNTGIKNENKLLFAGISLLALLGLGFLLKNKKEN

SEQ ID NO: 4261 - protein, 469 aa, Zymomonas mobilis
MSDTRPILIWFRHDFRLRDNAAITAAIQSRNPVICFYIQESADAKTESAADWWVAESLLALNRQLKEKGGQLHLFEGDAEKIIPEIVQQSHACKLFWNRRYDFKGKETDQILKKSIRAMGLEVQSFPNNLLNEPWTVKNDKGQPFRIFSAYWRAVQRHMNIQAVLPCPENWVFSTREIRHCLGYKDIAILAKETQDSSWKIKLKQSHRFGENEAHKQLKSFIENDLAHYAKERDFPAKDGTSLLSAFLRSGQISSKQIWHEVTKNGSGEGTSKFLEELGWREFAWSVLWEHPDLNQHNLRPEFDKMPWKKASDNLQRWKEGQTGYPFIDAGMRALWQTGFMPNRLRMVTASFLVKHLLIDWREGKKWFAQTLVDYDPACNATNWQWVAGSGIESAPYFRIMNPILQSQKFDPDGQYIREWVKELADVSTAFIHTPWKADKQPANYPLPIIAHEEGRNRALRAWKEIRHA

SEQ ID NO: 4262 - protein, 492 aa, Corynebacterium efficiens
MGAAGVPARFILDSVSMSLSTASPTIVWFRDDLRIRDNAALAWAADRGPVIGLFIDEDQPRALGGAARWWRDRSLTLLVDALATHGVPLLRRSGDPVVLLTEVVRETGAAAVTWNRRYHGPLRERDAEIKTQLREQGLEVHSHAGFLLTEPWEVTSGAGTGYKVYTPFSKAAFPLADESAARLGDPMPAQLTGPDTPVADTGGIDAPDPFWAAEMATHCRPGEQAALDRLGDFLDRMRERGGYADGRDEMARAVTSGLSPHLRFGEISVHRVWEEITAAADAGDIDATDAQVFRKELLWRDFAWHRLYALPDMATTNVREQFNRFGWAWDEHEAARLVDGRHPLSPTSSDEFHVALAAWRAGRTGIPLVDAGMRELWATGSMHNRSRMVVASFLTKNLQIHWRHGEEWFWETLVDADPASNAFNWQWAAGSGDDASPYFRIFNPETQARKFDPDETYIRRWIPEYGTPEYPAPIVDLKESRREALDAYEAVK

SEQ ID NO: 4263 - protein, 486 aa, Crocosphaera watsonii
MSNKRILIWYRNDLRIHDHEPLYQAIKQGALIIPFYCFDIRQFKTTSFGFPKTGNFRGQFLLESVTDLKKSLQDLGSNLIIRQGYPEKIIPELIKQLEIDAVYFHEEVTSEETDIENTVEKALKPLNVTFKGFWGATLYHWDDLPFEVSKLPEVFTSFRKKVEKNSTVNPILISPRKLRSLPDIEVGNVPSLEELELEKPKYDSRGVLEFKGGETEGIQRLNNYFWERNCLKEYKETRNGMLGADYSSKFSPWLANGCLSPRYIYEEVQKYEEKRIKNNSTYWLIFELLWRDYFRFISAKHGNKIFYQSGLQGVDIPWKEDQERFKLWQEGNTGYPLVDGNMRELAATGFMSNRGRQNVASFLTKNLGINWIMGAEWFESLLIDYDVCSNYGNWNYTAGVGNDARGFRYFNIPKQSKDYDPKGEYIKHWLPELKMIPGQKIHEPWKLSQEEQKRYNVRIGVNYPRPVVDFFKSVKANEKMYNAAIK

SEQ ID NO: 4264 - protein, 1364 aa, Xanthomonas campestris
MPKGRWDLRRTYGRRAFFGALLILSAGLVAAIVTGVWLQRQNELERQQRFDYVVRTLARNISERMSTFEHGLRGARGAVIGAGSDIISRERFTLYSRSRDYPREFPGVLGYGYIHRVAPADEAAFLQAARADGAPDIHRRPLAPWDGERYMVLYFEPESSGNRPLGIDIASEPRRRAAALQAARSGEPVMTSPISLSGYRVPSESGFLVLLAVYREGMPLQTPQQRMLATSGWVYAPFSVEQMVRSALGERDDVALDLSDRNEPTHNFYRSGTPASDSALRPPVVRLLPIYGRTWVITAHPTAGFVASLNQSSPWLIGGLVMAAAVLFAALLVLYFSNGLRREEVLRKQMELAALVSHSSEAIVAETPDGRITHWNPAAEAMFGYTADEAIDQDLTMLLSPQPYAMPEVDHADAALAGNASAAQTMRHRDGHQVHVLASKAPIIESEGTLSGHSHFFRDISDRVRSHQRIIDLNASLEHQVAERTSELVKFSVLQRAILAHAGYAIIAIDSSGFVTLFNPAAEKLLGYSAAEVIGRRKASQFVEPEELQERAHMLAEQTGTPVAHTLEAIAALTSLGRSDTSEWTYVSHDGRRLPVLLTLSTLRDDHDQVIGYLGVAVDLTEQKLHEKQLRLAMDAAKSANQSKSDFLANMSHEIRTPMNAILGMLYLLQRSELPGAAQDMVAKIDRSARTLLEIINDILDFSKIEAGRIDLECAPFDLNQLFDNIADLMRSSLSAKPVEMIVEPLPRDSRWLLGDALRINQVLVNLVGNAIKFTEQGEVVLSVRRFPSGDPNKFKLLFSVRDTGIGISKEKQSVIFSPFLQADTSTSRRYGGSGLGLTISRRLVELMGGELEVESVPGRGSEFYFVVTLEKSAPPQAQRELPALPPEAMPRVLIADDHDAALNNLVRIATELGWRVDAVASGQAALQAIEHAAEPYDIFLLDWRMPDIDGVAIAREIRARATPGPHPVIVMVTAYERRLLEQHPEQQDLDAVMTKPVTGAALHRLVEQLLEQRPGTRPATPTFVARRLEGAHLLLVDDSDINCEVAQRILEGEGAMVTVAHDGEQAVSTLKRAPNLFHLVLMDVQMPVVDGYEATRRLRQIPALASLPVIALTAGAFRPQQEKALEAGMNGFIAKPFNVEELVTAIRHFLQPGTRRIPSLPHEAQAHVGPEWEYSDPELLDAARARSLWREREPYARYLIKLLRDSPDPAEVAAEHLRRNELPAIGAMAHKLRGAAGSLALPALAGAAGDLETRIEEGHDITASLIALKDVMQRTADAIRAFLQHGDSDVAADEEGVALDADSVQILTSAFASDDADQIDHALLICAPRLPRALQEALQRAVEDFDFRRAEATLREWQATHPH

SEQ ID NO: 4265 - protein, 269 aa, Oryza sativa
MSSASSMEALHAAVLKEEQQQHEVEEATVVTSSSATSGEEGGHLPQGWAKRKRSRRQRSEEENLALCLLMLARGGHHRVQAPPPLSASAPPPAGAEFKCSVCGKSFSSYQALGGHKTSHRVKLPTPPAAPVLAPAPVAALLPSAEDREPATSSTAASSDGMTNRVHRCSICQKEFPTGQALGGHKRKHYDGGVGAGAGASSTELLATVAAESEVGSSGNGQSATRAFDLNLPAVPEFVWRPCSKGKKMWDEEEEVQSPLAFKKPRLLTA

SEQ ID NO: 4266 - protein, 545 aa, Chlorobium tepidum
MTAKDILFDAEARTKLKVGVDKLANAVKVTLGPAGRNVLIDKKFGAPTSTKDGVTVAKEIELVDPVENMGAQMVREVASKTSDVAGDGTTTATVLAQAIYREGLKNVTAGARPIDLKRGIDRAVKEVVAELRNISRSISGKKEIAQVGTISANNDPEIGELIAEAMDKVGKDGVITVEEAKGMETELKVVEGMQFDRGYLSPYFVTNSETMEAELDEALILIHDKKISNMKELLPILEKAAQSGRPLLIIAEDIEGEALATLVVNKLRGTLKVAAVKAPGFGDRRKAMLEDIAILTGGTVISEEKGYKLENATMAYLGQAARITIDKDNTTIVEGKGKQEEIKARINEIKGQIEKSTSDYDTEKLQERLAKLSGGVAVLKIGASTEVEMKEKKARVEDALHATRAAVQEGIVVGGGVALIRAAKGLAKAVADNEDQKTGIEIIRRALEEPLRQIVANTGTTDGAVVLEKVKNAEGDYGFNARTEQYENLIEAGVVDPTKVTRSALENAASVASILLTTEAAITDVKEDKADMPAMPPGGMGGGMY

SEQ ID NO: 4267 - protein, 929 aa, Pseudomonas syringae
MRWLRIAIASTVGLLTLLFMLSAQAEHGAGWSTLLDEKAHLTLDEIRSARYQNQFSPIELERVTAADRDSALWLHYRLQPTQHEQLLRIFAPDLSSADMYVMDGDRQIDHVRTGNDVPIEDQRLPSNDFLLPVPQSSAPLDIYLRLVSAQKMRPSITLEPAIASAANETQPLLFGLLFGALSMLIVQNLTRYGHTRSRSNLWLAACESLLGLSALLLLNLLRPIDPWNIAQTPSAHLALLLAAVAGLIYTYCFFVHRNARKLDRLLLGNAVLMGIGALLVLFDEKLPINFLTFGLVSLTTLSILAVSMWHWQKGYRSARLFVLGMITFNIGYMVVLPGLLWLSLVPPQWLILALLSVFCISGVLMSLALSERHRSITEDRFSISRDQAASTAEINAKAEFLAKISHEIRTPMNGVLGMTELLLGTPLSVKQRDYVQTIHSAGNELLTLINEILDITKLESGQIELDDVQFDIGALVEDCLNIFRAKAEQQQVELISQIQPQVPRVINGDPTRLRQTLLSLLENALKKTDEGEILLAVSLESSKSGNTRLRISVQDSGESLSDEEREELLHAELHSRNFLASSRLGGHLGLVIARQLIVLMDGEFGIQNTGAQGNTLWLNLPLDAKLLEQPTIDLDSPLKDARVLVVDDNDTCRKVLVQQCSAWGLNVSAVASGKEALALLRTKAHLRDYFDVVLLDQNMPGMTGMQLAAKIKEDPSLNHDILLIMLTGISNAPSKIIARNSGIKRILAKPVAGYTLKTTLADELTQLNKGVVSNKPGPVVTPPVNVPGDFRILVAEDNSISTKVIRGMLGKLNLNPDTASNGEEALRAMKAQRYDLVLMDCEMPILDGFSATEQLRAWEVGNQRVRTPVVALTAHILTEHKDRARQAGMDGHMAKPIELSQLRELVEHWVAHRDKARGLTSDGEHYRQN

SEQ ID NO: 4268 - protein, 213 aa, Prosthecochloris aestuarii
MYLKQFRTGGDRNFGYLAADETSRLAVAVDTSYNPGMIVEDARREGLTIRYLFSTHSHHDHTNGNEEAARLTGCTPLLYGSLCPVSGVRIEDGAELPLGALQVKVLYTPGHTDDSICLCVGDVVFTGDTLFVGKVGGTDLAEQAVTEFGSLHEKLLSLPETTRVFPGHDYGVAPESTIGHERRTNPFLLQPDLESFIGLKRNWAAYKKAHGIA

SEQ ID NO: 4269 - protein, 324 aa, Neisseria meningitidis
MDTLTRFLPEHLQQNQLPEALGGVLLSVVSACTEINAKVRLGALAGVLGMAGTGNIQGEDQKKLDVIANNIMIDTLKANPAVAGLASEEEDSFVSAGENGRYLVLFDPLDGSSNIDVNISVGTIFSILEKPEGALATESFLQTGRQQLAAGYVLYGPQTQLVFTFGHGVYMFTLNAENEFVLTKEKPKVPESTKEFAINMSNRRHWLPPVQQYIDELLAGETGTRGKNYNMRWVASMVAEIHRILMRGGVFMYPQDKRDPSKPGKLRLMYEANPMALILEQAGASASNARQDILGIRPESLHQRVAVIMGSSEEVDYLNRLHSK

SEQ ID NO: 4270 - protein, 228 aa, Unknown
  Petunia x hybrida
MGRGKIEIKRIENNTNRQVTFCKRRNGLLKKAYELSVLCDAEIALIVFSTRGRVYEYANNNIKGTIERYKKATAETSNACTTQELNAQFYQQESKKLRQQIQLLQNTNRHLVGEGLSALNVRELKQLENRLERGITRIRSKKHEMILAETENLQKREIQLEQENTFLRSKIAENERLQELSMMPATGQEYNAFQQYFARNMLQLNMMEGGVPSYDPLPAHDKKSLQLE

SEQ ID NO: 4271 - protein, 532 aa, Vibrio parahaemolyticus
MAAKDVLFANDARQKMLKGVNLLADAVKVTLGPKGRNVVLDKSYGAPTITKDGVSVAKEIELKDKFENMGAQMVKQVASKANDEAGDGTTTATVLAQSFINEGLKAVASGMNPMDLKRGIDKATEAAVEKLREMSKPCSDKESITQVGSISANSDRAIGEIIAEAMEKVGRNGVITVEEGQGLDNELSVVEGMQFDRGYLSPYFITNQENGSVELDNPYILLVDKKVSSIRELLPVLEEVAKSSRSLLIIAEDIEGEALATLVVNNMRGIVRATAVKAPGFGDNRKAMMEDIAVLTAGTVISEEIGLELEKATLEQLGSAKKVTITKDTTTIVGGAAEASAIADRVASIEKQIETTTSQYDKDKLQQRVAKLSGGVAVIKIGAATEVEMKEKKDRVDDALHATRAAVEEGIVAGGGVALTKIAKELADLKGDNDDQNVGIRVALRAMEEPLRQIATNAGDEASVVANAVKAGDADYGYNAATGEYGNMIEMGILDPAKVTRSALQFAASVAGLMITTEAMITNHVEDKELDI

SEQ ID NO: 4272 - protein, 721 aa, Bradyrhizobium japonicum
MPRAKPMPKLPAEAYAIIEGRHADPFHYLGLHPEGGKSVVRAFLPEASNVEAVGEHGEVARLDRVHDAGLFVGALPNGSKHYQLRAKFGDSIVEFEDAYRFPPILTDFDLYLLGEGTHQRLYDKLGAHPMTLDGVDGIGFVVLAPNARRVSVVGDFNFWDSRRHPMRVRGSGYWELFIPHAKRGDHYKFDIVGPHGHQLPLKSDPMAFASEVRPKTASIVFDEAHLPRPRPAPDGINALSAPMSIYEVHLGSWRRKGDNEWLTYRELAEQLPAYARDMGFTHLEFLPVSEHPFDGSWGYQPTGLYAPTSRFGTPEDFAALVDACHREGVGVLLDWVPGHFPDDPHGLGSFDGTSLYEHANPLQGRHLDWGTLIYNYGRTEVTNFLVSNALFWLERYAIDGLRVDAVASMLYLDYSRPPGAWIPNQYGGRENIEAIAFLRRFNTELFARFPQATTAAEESTAWPQVSRPVEFGGLGFGYKWNMGWMHDTLNYISKDPIHRKHHHGEILFGLHYAFSENFILPLSHDEVVHGKRSILGRMPGDEWQRFANLRAYYSFMFGHPGKKLLFMGAEIAQSREWNHDQSLDWHLLEYKYHSGIQALIRDLNRLYRAVPALHQMDCDQAGFEWLITDDANRNVFAWLRKGLDEHARCLVIVNFSPNVYRNYRVRVPFAGKWKEVLNSDSAHYGGSNVGNIGEVHAVDGKTPELRLTIPPLAAIFLVPES

SEQ ID NO: 4273 - protein, 273 aa, Zea mays
FPADREALPHHHHPMLNMMTDLSCGPSSKVKEQVAAAPTGSGDRQGQGRGKIEIKRIENTTNRQVTFCKRRNGLLKKAYELSVLCDAEVALVVFSSRGRLYEYANNSVKSTIERYKKANSDSSNSGTVAEVNAQYYQQESSKLRQMIHSLQNANTRNIVGDSIHTMGLRDLKQMEGKLEKAISKIRARKNELLYAEVDYMQKREMDLQTDNMYLTSKIAESNETGQPAMHMMGVPPPTSEYDHMAPFDSRNFLQVSMPQHYSHQLQPTTLQLG

SEQ ID NO: 4274 - protein, 146 aa, Rhodospirillum rubrum
MRFLHTMVRVADLDASLDFYCAKLGLREISRQDNEKGRFTLVFLAAPADEETARETKAPLVELTYNWDPEVYTGGRNFGHLAYKVDDIYATCQKLMDAGVTINRPPRDGNMAFIRSPDGISIELLQEGAPLAPAEPWASMANTGSW

SEQ ID NO: 4275 - protein, 464 aa, Solanum berthaultii
MVRVTLFLLLLLVSDVVSDHFIVETLPGFHGKLPFTLETGYIGVGEEEKVQLFYFFVPSERDPLNDPLMIWLTGGPGCSGLSSFVYEIGPLTFDYANSNGNFPKLELNSNSWTKVANIIFIDQPAGTGYSYANTSEAYNCNDTLSVTLTYDFLRKWLMDHPEYLNNPLYVGGDSYSGIFVALLTRKIYDGIEVGDKPRLNIKGYIQGNALTDRYIDSNGRIKYANRMGLISDKIYQSAKTNCNGSYFDVDPHNILCLNDLQKVTKCLKNIRRAQILEPYCDLPYLMDILQETPTNGQSVFPIAGPWCREKNYIYSYVWANDKVVQKALNVREGTTLEWVRCNESMHYRGKERTESYVYDVPSAVGDHRHLTSKSCRALIYSGDHDMVVPHLSTEEWIDTLKLPIADDWEPWFVDAQVAGYKVKYLQNDYELTYATVKGAGHTAPEYKPEQCLPMVDRWFSGDPL

SEQ ID NO: 4276 - protein, 285 aa, Kluyveromyces lactis
MELSVPKSYKLSSGYTIPSVGLGTYELPPNKTAYLVHQALEVGYRHFDTAVLYGNEYEVGQGIKKWLNENPAENKRGDVFYTTKLWDSQHGYEKAKKAIDHCLQEVEDLGYIDLLLIHSPLGGKKLRLETYEAMQEAVDAGKVRSIGVSNYGFQHIEELLNWEKLKYKPVVNQIEISPWCMRQELADFCKKKGILVEAYAPLTHGTKLKDPDLVKVANEVGCDVGQALIRWSLQKGYIPLPKTQSVSRLASNLDVFSFEWTTDQMDQLDKPYAYEPTDWECTNAP

SEQ ID NO: 4277 - protein, 456 aa, Solanum berthaultii
  misc_feature (449)..(449): Xaa can be any naturally occurring amino acid
MVLAFIVFVLMLLLTDVVSSHFIVETLPGFDGQLPFKLETGYIGVGEEEKLQLFYFFVESERDPQNDPLMIWLTGGPGCSGLSTFLYEFGPLTFDYANSSGNFPKLELNLHSWTKVANIIFIDQPVGTGYSYAKTSEAYNSNDTLSATLTYDFLRKWLMDHPEYLKNPLYVGSESYAGIYSALVTRKIYDGVEVGDEPQMNIKGYIQGNALTDAYITVNSRVKYVYHMGLISDKIYQSAKANCNGNYVDIDPNNILCLNDLQKVKKCLNNIQSHHILENWCDLSLLRSNVHSGPWCRENNYIYSKIWANDKAVQKALNVREGTILEWVRCNNSMKYSARESMKRSGSYVYEIQSSIDDHRHLTSKSCRALIYSGDHDMIISHVSTEEWIDTLKLPIVDDWEPWFVEDQVAGYKVKYLQNDYELTYATVKGAGHTAPEYKPRQCMSMVDXWFSGDPL

SEQ ID NO: 4278 - protein, 461 aa, Solanum berthaultii
MVRVTLFLLLLLVSDVVSDHFIVETLPGFHGKLPFTLETGYIGVGEEEKVQLFYFFVPSERDPLNDPLMIWLTGGPGCSGLSSFVYEIGPLTFDYANSNGNFPKLELNSNSWTKVANIIFIDQPAGTGYSYANTSEAYNCNDTLSVTLTYDFLRKWLMDHPEYLNNPLYVGGDSYSGIFVAPLTRKIYDGIEVGDKPRLNIKGYIQGNALTDRYIDSNGRIKYANRMGLISDKIYQSAKTNCNGSYFDVDPHNILCLNDLQKVTKNIRRAQILEPYCDLPYLMDILQETPTNGQSVFPIAGPWCREKNYIYSYVWANDKVVQKALNVREGTTLEWVRCNESMHYRGKERTESYVYDVPSAVGDHRHLTSKSCRALIYSGDHDMVVPHLSTEEWIDTLKLPIADDWEPWFVDAQVAGYKVKYLQNDYELTYATVKGAGHTAPQYKPEQCLPMVDRWFSGDPL

SEQ ID NO: 4279 - protein, 344 aa, Vantanea guianensis
DLEPVNPADVPVTAAGALKSYKLAAKAISRLQSLPSGNISMLCDVLVKEVSDLTGYDRVMVYRFHEDEHGEVVAECHRPDLEPYLGLHYPATDIPQASRFLFMKNKVRMICDCLALPVKVIEDKRLAQPLSLCGSTLRSPHGCHAQYMADMGSIASLVMSVTINEDDDEMDSDQQTGRKLWGLVVCHHTSPRFVPFPLRYACEFLIQVFGVLINKEVELAAQMREKHILRTQTVLCDMLLRDAPVAIITQSPNVMDLVKCDGAALYYRNKFWLLGVTPTEAQVRDIAEWLLEYRRGSTGLSTDSLMEAGYPGASVLGNAVCGMAAVSITSKNFLFWFRSITSEF

SEQ ID NO: 4280 - protein, 496 aa, Zea mays
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMEPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKANM

SEQ ID NO: 4281 - protein, 227 aa, Zea mays
MARYFRSSNLASRVFERQLISPRPGATHLQVNTIRQFYENLVPSYTIYDIDCPDYSFRKFTDDGKYFVAFSRNHQDLIVYRPIWLTYSCNEECDPHELPPKAKKFDSFFKQLYSIPLASGNEYICKDFFLYMECHRFGLFATSTAQSNESTATEGAIHGVPLIEKITFHLVRLEDGVILDEKAFCNDFINLAHSIGAYMYEDLLCIVSLRYQTIHILQIRDSGNLVE

SEQ ID NO: 4282 - protein, 514 aa, Oryza sativa
MFRSMGTGTGTKPPAMTTERYEFGPLVGEGNFAKVYLGRHRATGEEVAIKVMDKEKLVRLGATELIKREIAVMQRLRHPNVVRIHEVMANKRRICVVMEYVRGGALYRYFRRGPSGGAAGLREHEARRFFQQLVSAVAYCHSRGVFHRDIKLDNLLVDEQGNLKVADFGLSALADMERREAHLQTVCGTPLFLAPEVFKRRGYDGAKADVWACGVVLYVLLTGRKPFPDEHVSRLYRLIGQNQFQCPPSFSPDLARLVRRLLQPDPDRRITIPEIMEMRWFKRGFKEVTYYIDSNDRLRSLDGLDGEPELYDSDTDTIESSSSSESPTPVAGTPRGMHTSVSAPALSELDRMEDSASLPLPLPLPPRPRMPRPKSLNAFDIIASSPSFDLSGLFEERGERMRFVSGAPVADIIAKLQEIAGMVSFTARTKDCQVSIEATRNGQKGALAISAKVFELTRELVMVQVCKKAGDTAEYRRFCDNELKAGLRGLVVDALPPPVEGGGHGGAAAAAEAE

SEQ ID NO: 4283 - protein, 362 aa, Rhodobacter sphaeroides
MTEKLFTPIAVGDLTLKNRVVMAPLTRNRAEPEGDLPTDLTVEYYRQRAGAGLIVTEGSQISPEGKGYAWTPGIHSEAQVAGWRKVTDAVHARGGHIAIQLWHVGRISHTSLLDGQKPVAPSALAAASRTFDGTGFVATSEPRALETDEIARVVEDYRKAARNAKAAGFDAVEIHAANGYLIDQFLRDTSNKRTDAYGGSQENRVRFLEEVVGAVVAEMGPGRTGIRFSPFSNANDVGIDSDTVGLFSRAIDVLNRHGIAFLHMVEGQTGGAREWPEGALETLRERFGGTYVANNGYDREMAVAAVESGKADMVAFGKLYISNPDLAERLAARAPLAPLPTEGLYGGGAEGYTDYPTLTPAA

SEQ ID NO: 4284 - protein, 917 aa, Pseudomonas syringae
MLTKLGIKGRVLLLTILPASLMAAMLGGYFTWMQLSELQSQLLQRGEMIAQDLAPLAANALGRKDKVLLSRIATQTLEQTDVRAVSFLDTDRTELAHAGPTMISPSPIGSGSQLLSSTGTDATRYLLPVFGSQRHLTSPIIPAEADTLLGWVELEISHNGTLLRGYRSLFASLLLILTGLACTATLAVRMSRTINGPMSQIKQAVSQLKDGNLETRLPPLGSRELDELASGINRMAATLQNAQEELQLSIDQATEDVRQNLETIEIQNIELDLARKEALEASRIKSEFLANMSHEIRTPLNGILGFTHLLQKSELTPRQFDYLGTIEKSADNLLSIINEILDFSKIEAGKLVLDNIPFNLRDLLQDTLTILAPAAHAKQLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNIPLGGLRAAVLEHHDLARQALEHQLEDCGLQTIVFNNLENLLNGVTAAHETPAAIDLAVLGVTALEISPERLRQHIWDLENLNCKVMVLCPTTEHALFQLAVHDVYTQLQAKPACTRKLQKALSELIAPRAVRADIGPPLSSHAPRVLCVDDNPANLLLVQTLLEDMGAEVVAVEGGYAAVNAVQQEAFDLVLMDMQMPGMDGRQATEAIRTWEAERNQSSLPIVALTAHAMANEKRSLLQSGMDDYLTKPISERQLAQVVLKWTGLALRNPAPERQNEAPEVHVGPLVLDHEEGLRLAAGKADLAADMLAMLLASLDADREAIRVARASQDVHALIERIHRLHGATRYCGVPQLRTACQRAETLLKQNAAHTEEALDDLDKAIIRLESEARVTA

SEQ ID NO: 4285 - protein, 482 aa, Lactobacillus sakei
MEYQQLAPFPQDFLWGSASAAYQIEGAYQEAGKGQSVWDQFVRIPGKTFKATNGDVAVDHYHRYQEDVALMARAGLKAYRFSISWPRVLPTGRGTVNEEGLAFYDRLIDELIANQIEPIVTIYHWDLPQALQDEYGGWESRQIIPDFTAYAALLFERFGDRVRHWVTLNEQNIFITHGYLTAEHPPAVMDAKRTYQANHMANLANASVIKLFHEKGYQGGNGPSFAYSPTYALDADPVNQIAADDAEQLNANLWLDIYAWGRYPKLILNYWAREGLLPDITAADQALLQDPLARPDFMGLNYYQTTTVTANPLVGGVGLTKQNTSGKKGTSQASGVPGLFKTSDNPYMQQTDWDWNIDPEGLRMALRRIESRYNLPVLITENGLGAYDRLEGAGEVHDEYRIVFLKAHIQAIQEAITDGVTVIGYTTWSFTDLLSWTNGYQKRYGFVYVDRDETDEKELNRYPKDSFYWYQRVIRSNGQQLN

SEQ ID NO: 4286 - protein, 545 aa, Unknown
  Shewanella sp. MR-7
MAAKEVVFGNDARVKMLAGVNILANAVKVTLGPKGRNVVLDKSFGSPLITKDGVSVAKEIELEDKFENMGAQMVKEVASKANDAAGDGTTTATVLAQAIVTEGLKAVAAGMNPMDLKRGIDKAVAAAVIELKNLSQDCADSKAIAQVGTISANSDESIGEIIATAMEKVGKEGVITVEEGQALENELDVVEGMQFDRGYLSPYFINKPETGSVELDHPFVLLVDKKISNIRELLPILEGLAKTGKPLLIVAEDVEGEALATLVVNNMRGIVKVAAVKAPGFGDRRKAMLQDVAILTGGTVIAEEIGLELEKATLEDLGTAKRVVITKDNTTIIDGNGEQAQIEARVSQIKQQIEESTSDYDKEKLQERMAKLAGGVAVIKVGAATEVEMKEKKARVEDALHATRAAVEEGVVPGGGVALVRVASKIADVEVANEDQKHGVVIALRAMEAPLRQIATNAGEEASVVANTVKNGSGNYGYNAGNDTYGDMLEMGILDPTKVTRSALQFAASIAGLMITTEAMVAELPKADAPDMGGMGGMGGMGGMM

SEQ ID NO: 4287 - protein, 195 aa, Glycine max
MRKSAADRFRHLFNRSLILLRHRHHHHPFPSSSSLSPFSRSRFFSSTPFSMASDSPFPVTAQNINPKVLKCEYAVRGEVVTLAQNLQKDLQANPGSHPFDEILYCSLGQQPITFFREVLALCDHPAILDKSETQGLFSTDAIQRAWQIVDQIPGRATGAYSHSQGVKGLRDTIAAGIEERDGSPANPDDIFMTEG

SEQ ID NO: 4288 - protein, 283 aa, Listeria monocytogenes
MKTVKLNNGVEVPILGFGTYQITDAAEAEQAVKDAIKTGYRHIDTAQSYMNEEAVGRGIAASGVDRKELFITTKIWVENVSYKGVMSSFDRSLKRLGLDYVDLLLIHQPFNDVYGAWIAMEELQASGKIRAIGVSNFSPDRVIDLAAFNEVTPQVNQIEVNPFQQQTANLAILRKEGVAIEAWAPFAEGKNDVFNNPVLTKIGAKYGKSAAQVILRWLVEQDIIVLAKSVKPERMAQNLAIFDFELTEADKEEIAGLNQGESQFFSHADPEMVKWMASRKLNV

SEQ ID NO: 4289 - protein, 583 aa, Bradyrhizobium japonicum
MRPSFGARPTKEGVSFRLWAPGARRVDLLLDRRHAMQRRQDGWYVAEIASLTTGSPYKFRIDDEIDVPDPASAFQPEDVFGPSEVIDHDAFAWRARDWRGRPWEETVLIESHVGTFTAEGTYRAMIDRLDHLTATGITALELMPLADFAGYRGWGYDGVLWYAPDSAYGRPEDLKTLIDEAHLRGLMVFLDVVYNHFGPEGNYLGRYAPSFFTDAHTPWGSAIDYRLSQVRAFAVENALSWLSDYRFDGLRLDAANHIMALPGEQSMLQDLSVAAGELAKATGRHIHLVLENGDNRASLLDAAQEPPNGKYRAQWNDDYHHVWHVMLTGELAGYYADYQTPRMDLARALASGFVYQGEISEFWGKKPRGEPSRELPPATFVNFLQNHDQIGNRPLGERLESLASPRQIEAALAVTLLAPMVPMLFQGEEWGSKVPFPFFCDFQGGLADAVRKGRRQEYAWAYEKYGDEVPDPLDPATLQSAVLDWGGRTPEQDARLALVRDLLALRRKEIMPRLKGARFGDAEATDSGLLRAHWRMGDGTTLRLVANLSDHEIISTDNAGTPIWGGAAGDRLPPWSVVWRLGG

SEQ ID NO: 4290 - protein, 332 aa, Escherichia coli
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYSTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFICEFPDA

SEQ ID NO: 4291 - protein, 1356 aa, Ustilago maydis
MAATLSAQSALPNQPTLMSRQTSSPLPDLASLPTDFLDHLLLVTQTLVNSKPPPAVLRAMSRDPTRKEQSSSNGDLFEAHLADDVASIDLDDPTSHAEGIVSLPLPQFNSAHSDERTKAIEENLAKLAERLWRAEDHLEVVARSQEIVRTPGAEEQPDDPNHARNLFFGKPFPYPLSHAQPQSSTYPLSYPLGMGLNGPVLLGGQHSRTDDPISSFERYNDESGLSAQEELRLLKAQVQDIARVCKAVAFGDLSQHITVPVQGHVMVELKDIINQMVDRLSHFAAEVTRVSLEVGTQGKLGGQAEVHGVEGTWKELKDVVNRLAANLTNQVRGVALVTKAVARGDLSQKIEVEADGEILELKVTINVMVDQLRHFSTEVTRVSREVGSKGQLGGQANVPGVQGVWKELTDNVNRMCSNLTGQVRSIGVVTTAVAKGDLTKTIDIDAEGEMAQLKDTVNSMVGQLRIFASEVIRMSMEVGTYGKLGGQAHVPNVEGTWKDLTENVNKMADNLTSQVREIARVTKCVAEGVLTEFINVDVKGEILDLKLTVNNMVRQLKTLSDEIIRVSVEVGTEGRLGGQAKVNDVKGQWQVLTERVNMMASNLTTQVRSIATVTTAVARGDLSKTINVEVRGEFLDLKLTVNNMVESLRTFSFEVTRVAKEVGTEGKLGGRATVLGVGGTWKDLTDSVNTMAANLTLQVRAIAYATTAVARGDLTQKVTIPVSGEMLDLVNTINNMIDQLSFFASEVTRVAREVGTEGKLGVQAQKKDIEGTWGEITDNVNIMANNLTSQVRAFAQITAAATDGDFTRFVTVEASGEMDSLKTKINQMVYSLRDSIQKNTAAREAAELANRSKSEFLANMSHEIRTPMNGIIGMTALTLETELSRSQRENLVTVSTLAGNLLAIIDDILDISKIEAGRMNVEEIPFSLRGIVFSVLKTLSVRATQKKLNLMYEVAPDCPDPLIGDALRLKQIITNLIGNAVKFTDAGGRVALKCKLSKMVGSNQAMLEFCASDSGIGIKQDKLDVIFDTFCQADGSTTRKYGGTGLGLSISRRLVNLMGGDLWVRSNYGKGSDFFFTMVVKLDQISPDQVKEKIRPYTGRNIFYLDTLHDKTGVQAMIEDLGLKPFTVHSVDEASHRKRGMPRIDAIIADSLAVVEDLRNVEHLRYIPINLVSPAQLTLNLTYCLDHGISSYINTPTSVADLYYALLPSLESSAATPTEGSNEVTYDILLAEDNVVNQKLACKILTNQGHKVDIVDNGHLAVMAVKKRQYDVILMDVSMPVMGGIEATMAIREFEKTLGDEQVPIVALTAHAMLGDKEKCLQAGMSAYVSKPIRRVELISTLHSLLSQKKSVGGKV

SEQ ID NO: 4292 - protein, 422 aa, Galdieria sulphuraria
EFGTRKDVQVYFIQVLLYLYKEECQEITTAKDIFLIRWISIKMIAVQPQPKKTPVAEYLQTSQDTPTSLTRYLLEVAKQNKDMGDMVALINGIQFACKKIASLVGKAGVTDLMGIYQQGIVNVHGEEQKKLDVLSNEVLKNALKYSGKMAVIASEEEDVPIMVEESYSGNYVVVFDPLDGSSNLDAGLPTGTIFGVFQQQFSCLIHDYEESIDNMELACLQNTLQPGRRLIAAGYCIYSSSTMLVLSLGNGLHCFTLDTEVGEFVLTRANIQIPQRGNIYSFNESNFYQWDKGVQDYIERLKKGNNQTNCRYSARYVGSMVADVHRTILYGGIFGYPADKKNVSGKLRLVYECAPMAYLVEQAGGKATTGIENILDLTPKDIHERKPLILGSPADIEEFLQVYGMSRVDREDMHMWDNLSSL

SEQ ID NO: 4293 - protein, 825 aa, Oryza sativa
MAAPASAVPGSAAGLRAGAVRFPVPAGARSWRAAAELPTSRSLLSGRRFPGAVRVGGSGGRVAVRAAGASGEVMIPEGESDGMPVSAGSDDLQLPALDDELSTEVGAEVEIESSGASDVEGVKRVVEELAAEQKPRVVPPTGDGQKIFQMDSMLNGYKYHLEYRYSLYRRLRSAIDQYEGGLETFSRGYEKLGFTRSAEGVTYREWAPGAHSAALVGDFNNWNPNADPMSKNEYGVWEISLPNNADGSPPIPHGSRVKIRMDTPSGIKDSIPAWIKYSVQAAGEIPYNGIYYDPPEEEKYIFKHPQPKRPNSLRIYESHIGMSSPEPKINTYANFRDEVLPRIKKLGYNAVQIMAIQEHSYYASFGYHVTNFFAPSSRFGTPEDLKSLIDKAHELGLLVLMDIVHSHASNNTLDGLNGFDGTDTHYFHSGSRGHHWMWDSRLFNYGNWEVLRFLLSNARWWLEEYKFDGFRFDGVTSMMYTHHGLQVAFTGNYSEYFGFATDADAVVYLMLVNDLIHGLYPEAVAIGEDVSGMPTFGIPVQDGGVGFDYRLHMAVPDKWIELLKQSDESWKMGDIVHTLTNRRWSEKCVTYAESHDQALVGDKTIAFWLMDKDMYDFMALDRPATPSIDRGIALHKMIRLITMGLGGEGYLNFMGNEFGHPEWIDFPRAPQVLPNGKFIPGNNNSYDKCRRRFDLGDADYLRYRGMLEFDRAMQSLEEKYGFMTSDHQYISRKHEEDKMIIFEKGDLVFVFNFHWSNSYFDYRVGCLKPGKYKVVLDSDAGLFGGFGRIHHTAEHFTADCSHDNRPYSFSVYSPSRTCVVYAPAE

SEQ ID NO: 4294 - protein, 222 aa, Pinus resinosa
MGRGKIEIKRIENTTNRQVTFCKRRNGLLKKAYELSVLCDAEVALIVFSSRGRLYEFANHSVKRTIERYKKTCVDNNHGGAISESNSQYWQQEAGKLRQQIEILQNANRHLMGDGLTALNIKELKQLEVRLEKGISRVRSKKNEMLLEEIDIMQRREHILIQENEILRSKIAECQNSHNTNMLSAPEYDALPAFDSRNFLHANLIDAAHHYAHQEQTTLQLG

SEQ ID NO: 4295 - protein, 444 aa, Oryza sativa
MRMGKYEMGRALGEGHFGKVKLARHADTGAAFAIKILDRQRILAMKIDEQIKREIATLKLLKHPNVVRLHEVSASKTKIYMVLEYVNGGELFDKIALKGKLSEKEGRKLFQQLMDAVSYCHEKGVYHRDLKPENVLVDAKGNIKVSDFGLSALPQNQRKDGLLHTTCGSPNYIAPEVLLNRGYDGSLSDIWSCGVILYVMLTGNLPFDDQNTVVLYQKILKGDARIPKWLSPGAQDILRKILDPNPITRLDITGIRAHEWFRQDYTPAMPFDDDDDNNISDGNLHMTENQDIETSPAISQINAFQLIGMSSCLDLSGFFEKEDVSERKIRFVSNYSPTSLFEKIESTVTEKGFQVQKNSGKLKVIQVCKEPANPRGHGNLLISAEVFEINESLYVVELKRSSGDCSLYRQLCASLSEDLGICKRQQLLKKDSMRQDLCRYNSSF

SEQ ID NO: 4296 - protein, 185 aa, Pharus virescens
EMRRIENKINRQVTFAMRRNGLLKKAYELSVLCDAEVALIIFSNRGKLYEFCSGQSMTKTLERYQKCSYGGPETAIQNKENELVQSSRNEYLKLKARVENLQRTQRNLLGEDLGSLGIKELEQLEKQLDSSLRHIRSTRTQQMLDQLTDLQRREQMLCEANKCLRRKLEESNQVHGQQVWEHGAN

SEQ ID NO: 4297 - protein, 753 aa, Escherichia coli
  misc_feature (621)..(621): Xaa can be any naturally occurring amino acid
MSQQNEKNPHQHQSPLHDSSEAKPGMDSLAPEDGSHRPAAEPTPPGAQPTASGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILXALKAKGVHAKLLYSRMGEVTADDGTVLPIAATFAGAPSLTVDAVIVPCGNIADIADNGDANYYLMEAYKHLKPIALAGDARKFKATIKVADQGEEGIVEADSADGSFMDELLTLMAAHRVWSRIPKIDKIPA

SEQ ID NO: 4298 - protein, 334 aa, Zea mays
PRVRGRVGCSVRNCAKLPTSLGPPPSSSIDEIGGWGTVPTLESLGPSVTKAGLASEKGMHFIGGESAALGRVHEYFWKKDQLKDYKVTRNGMLGPDYSTKFSPWLASGSLSPRYICEEVKRYEKQRVANDSTYWVLFELIWRDYFRFLSAKYGNAIFHLGGPRKVVSKWSQDQALFESWRDGRTGYPLIDANMRELSATGYMSNRGRQIVCSFLVRDMGVDWRMGAEWFETCLLDYDPASNYGNWTYGAGVGNDPREDRYFSIPKQAKSYDPEGEYVAYWLPELRSLAKERRNFPGASYIRQVVPLKFDGGNQRKDQQFNRQRRPNNVYIRQVK

SEQ ID NO: 4299 - protein, 727 aa, Physcomitrella patens
MAACTIVWFRRDLRLEDNPALIAAARAGTVVPVFVWSPAEDGQFHPGRVSRWWLKQSLTHLELSLKKLGSPLILRKSPDMLSVLLEIAEATGATQVFYNHLYDPVSLVRDHRVKQGLSQRGIVVHTFNGDLLYEPWEVYDEEGQAFTVYEAFWKKCMSMPFEPEAPLLPPRRLTGPIGKIVGCNAEELGLEDEFEKSSNALLARAWCPGWGFANKSLDSFLRSPLIDYARDRQKADGASGTPTSLLSPHLHFGELSVRKIFHEVRKRQITWAREGNAGGEASVNMFLRALGFREYSRYLSFHFPFTHERSLLANLKSFPWRADEGYFKAWRQGRTGYPLVDAGMRELWATGWAHNRIRVVVASFSVKFLQLPWRWGMKYFWDVLLDADLECDVLGWQYISGSLPDGHELDRIENPEVEGYRFDPDGDYVRRWIPELARLPNEWVHHPWDAPPSALRAAGVELGTNYPRPIVEIGAARERLQASLAEMWERDAAMKAALANGLEEGLGETVEVAGTGGPEHERMDVPRVMVHMQRDADMSCNSSRRDQLVPEIVPNQFHIRAHESIMNRSAAMVEDGEEAGRAAVPMVFASVRRGMGGNYGGHHVEGNGGEVAQASAPIQWPTVTAVDYELDSTAESASVTGRGGSEGGTVPVWSQSVSARTPIQVREGLVPEVRRGPGLSRRQLQASVQRVNLEGMTSNKQAEEEDFYVPKLVKWTQPRKRRVKQDG

SEQ ID NO: 4300 - protein, 445 aa, Legionella pneumophila
MVIKKLFSSTLALVYALTLMLPLTAFSAEETNSNYSNTKRIPLEDVQRFSNAIGEIKKYYVKPVDDKELFDNAIRGMLTGLDPHSSYLNEEEFKELQTSTSGEFGGLGIEVTMEEGVVKVITPLVDTPAFKAGIKSGDYIIKLGKESVQGLSLKDAVNLMRGKPGTTIELTILRKGVNKPLTFDLIREVIQIKSVKSKMLSEGYGYIRLTQFQALTGKDMIKAIEQLKQQAGGKLKGLVLDLRNNPGGLLDSAIQVSDAFLGNDKAGKQEMIVYTEGRLPGSKFTALANPGDVLDNAPIVVLINNGSASASEIVAGALKDNKRAIILGTKSFGKGSVQTVLPLDGKTGIKLTTALYYTPSGVSIQAKGIIPDIIVEEVDVPKNAVKKDTLAGFTEADLNGHLINKDNSENTESKNNQIQTGDLIHEDYQLYAALTVLEGMALANR

SEQ ID NO: 4301 - protein, 437 aa, Mycobacterium leprae
MTLYQQISVDGSGTMSDVTTHQLPMHTPGYHRQRAFAQSSKLQDVLYEIRGPVSQHATRLETEGHRILKLNIGNPALFGFDAPDVIMRDMIQALPYAQGYSDSQGILPARRAVVTRYELVDGFPRFDVDDVYLGNGVSELITMTLQALLDNGDQVLIPSPDYPLWTASTSLAGGTPVHYLCDETQGWQPDIADVESKITERTKALVVINPNNPTGAVYSNEILNQIVDLARKHQLLLLADEIYDKILYDDTKHISVASIAPDLLCLTFNGLSKAYRVAGYRSGWLAITGPKDHASSFIGGINLLANMRLCPNVPAQHAIQVALGGHQSIEDLVLPGGRLLEQRDVAWTKLNEIPGVSCVKPTGALYAFPRLDPEVYGIVDDEQLVLDLLLQEKILVTQGSGFNWPAPDHLRLVTLPWSRDLAAAIDRLGNFLVSYRQ

SEQ ID NO: 4302 - protein, 540 aa, Streptococcus gordonii
MAKDIKFSADARSAMVRGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIEAAVATAVSALKETAIPVSNKEAIAQVAAVSSRSEKVGEYISEAMEKVGNDGVITIEESKGMETELDVVEGMQFDRGYLSQYMVTDSEKMVADLDNPYILITDKKISNIQEILPLLESILKTNRPLLIIADDVDGEALPTLVLNKIRGTFNVVAVKAPGFGDRRKAMLEDIAILTGGTVITEDLGLDLKDATIEALGQASKVTVDKDSTVIVEGSGNPEAIANRVAVIKSQIESATSEFDKEKLQERLAKLSGGVAVIKVGAATETELKEMKLRIEDALNATRAAVEEGIVSGGGTAFVSVLDAVAGLELTGDEATGRNIVLRALEEPVRQIALNAGFEGSIVIDRLKNSEAGTGFNAATGEWVNMIEAGIIDPVKVTRSALQNAASVASLILTTEAVVANQPEPASPAPAMDPSMMGGMM

SEQ ID NO: 4303 - protein, 533 aa, Ustilago maydis
MSIANASSSTASHDLDAADADPCPSACTSVSALCNMSTLPSPRPFGYRPTYVPAMVASGVSAVTVTTNSHRPPSKSHSISSVDSLASVSSNAPSTPTHDADDVRFEMAVIPKLVRASADAYLDRVGKPLPPSPAPQIVATSATTKTNAQAARSVAAAAAAAAAAAAVPPSHSALRNENHKNAISFRVGSKYKVCEIIGEGAYGVVCSAIHRATGQKVAIKKIQPFEHQMFALRTLRELKLLRFFQECDVSENIISILDIIKPSTYEAFTEVYLVQELMETDLHRVIRTQELSDDHCQYFTYQTLRALKPMHCADVIHRDLKPSNVLLNANCDLKVCDFGLARSVLTADQDTGFMTEYVATRWYRAPEIMLTFKQYTKAIDAWAVGCILAEMLTGRPLFPGRDYHQQLSLILDVLGTPTLEEFQNINSRRSRDYIRSMPFRKRREFRTLFPKASPEAIDFLQKTLTFDPRNRLTVEECLQHPYLSAYHDPDDEPGAPRLDPDFFYFDMQKESITKEDLRKELWYQVQEFQPLLR

SEQ ID NO: 4304 - protein, 315 aa, Arabidopsis thaliana
MANAITFFKLNTGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSAYSPLGSPGTTWLKSDVLKNPILNMVAEKLGKSPAQVALRWGLQMGHSVLPKSTNEGRIKENFNVFDWSIPDYMFAKFAEIEQARLVTGSFLVHETLSPYKSIEELWDGEI

SEQ ID NO: 4305 - protein, 474 aa, Streptococcus pyogenes
MGIFPKDFLWGGAVAANQVEGAFEADAKGLSVQDVLPNGGLGEWTDSPTSDNLTLEAIDFYHRYKEDIALFAEMGFKVFRTSIAWSRIFPNGDDDQPNEAGLQFYDDLFDELLNYGIEPLVTLSHYETPLHLAKAYNGWTDRRLIGFFERFAQTVMERYKGKVKYWLTFNEVNSILHMPFTSGGIMTEKEKLSLQDLYQAIHHELVASASVTKLAHEINPDVKVGCMILAMPAYPMTSDPRDILAAHAFENLNLLFSDIHVRGKYPSYIKSYFKENGIEIVFEDGDKELLAEHTVDFLSFSYYMSVTQAHNPEAYTSGQGNILGGLSNPYLESSEWGWQIDPIGLRLVLNQYYDRYQIPLFIVENGLGAKDQLVQTADGSMTVHDDYRIDYMSQHLVQVAKAIEDGVEVMGYTAWGCIDCVSMSTAQLSKRYGFIYVERNDDGTGQLTRYKKKSFDWYRQVIQTNGRYLEDNFS

SEQ ID NO: 4306 - protein, 579 aa, Yarrowia lipolytica
MATEHVEHAENAKQSPQPSFSGSESGRIGRYQIIKTLGEGSFGKVKLAYHLATHEKVALKIINRKTLAKSDMQGRVEREISYLRLLRHPHIIKLYDVIKSKDEIIMVIEFAGKELFDYIVQRGKMPEDEARRFFQQIISAVEYCHRHKIVHRDLKPENLLLDENLNVKIADFGLSNIMTDGNFLKTSCGSPNYAAPEVISGKLYAGPEVDVWSCGVILYVMLCGRLPFDDEFIPNLFKKISNGVYTIPPYLSAGAKHLLQQMLVVNPLNRITVQGIMEDPWFKQGIAEYLVPRDLKPDQVEIDDKVVGALSDTMGYDRDQVYEALKAPKSDGTEIRDAYDLMKENRQQLEKDSTVFDKVDESGKPKHQFSRKNPPALTFDSHHMPTIVDHSDLRTPNTTIAVLPSSLPAYHRANMMAHGPATLRKLNPISSRKSKTRWHFGIRSKSYPLDVMGELYRALKNLGAEWAKPSENDLWTIRVRWRYTPEKDESDSTTKPDSGLLKMQIQLYLLEQNSYLVDFKFDGWECETESGEIKTRDVAQVSNSKSANETFTFSAYPFLHLATRLIMELAVSSQKESEK

SEQ ID NO: 4307 - protein, 917 aa, Pseudomonas fluorescens
MLKKLGIKGRVLLLTLLPTSLMALVLGGYFTWMQLSDLQTQLLQRGEMIAEQLASLVAPAMGNHNTQMLERIATQALEQQDVRAVSLLAPDRSLLAHAGPSMLNPPPAGNSSHMMQRSGSDATRYQLPVFGRHRNLAGDLIPDESDRLLGWVELELSHSGMLLRGYRSLFASLLLIAAGLAGTALLAVRMGRTINNPLTQIKQAVAQLKDGNLETRLPPLGSQELDELASGINRMASTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLNLPKTRDDAEDLPGPPLLGRRVAVLENHELARQALQHQLEDCGLEVTPFNTLEALTNGITGVHQSEQAIDLAVLGITTNDMSPERLSQHIWDLEHLGCKVLVLCPTTEQTLFHLSVPNPHSQLQAKPACTRKLRRALSDLVTPRRARSEPEETLSSRAPRVLCVDDNPANLLLIQTLLEDMGAKVLAVDNGYAALNAIQTEPFDLVMMDVQMPGMDGRQSTEAIRQWESERHGTPLPIVALTAHAMANEKRALLQSGMDDYLTKPISERQLAQVVLKWTGLALRNQGPERASERPELGLELQVLDQDEGLRLAAGKADLAADMLAMLLASLDADREAIKAARAANDQNALIERVHRLHGATRYCGVPQLRAACQRSETLLKQEDAKAFAALDELDHAIGRLAAEARTNA

SEQ ID NO: 4308 - protein, 472 aa, Oryza sativa
KVAFVSQRPKTSLRLRVTPGWPHPPNSGDSGDGGRRGGKRWRFATPNLAVAAAGERSIQRYLLQLHACLDEHGPRPVIPLSHGDPSSSACFRTAPEAEEAVAAAVRSGDYNGYSSPATSLPARRAIAEYLSCDLPYKLCTDDIFLTSGGTQAIEIVMSVFGQPGANILLPKPGYPKHEAHAVFHRMEVRLYDLVPERGWEINVEAVEALADENTVAIVITNPNNPCGNVYTYEHLSKIADTASKFGLLVIADEVYGHLVYGSTPFVPMGVFGETVPVLTLGAISKRWVVPGWRFGWIAICDPKGILKETKVVDSLRSFRNLTTGPATFIQGAIPHIMKNTNDEFFRKTLELLKETAEICFGEIKEIKCITCPHKPEGSFFMMVKLDISQLSDICDDIDFCSKLVKEESVVLLPGRALGMENWLRITFALDPPRLKQGLERVKSFCRRHQSHANMLNISASAKVEPHFGMSKS

SEQ ID NO: 4309 - protein, 630 aa, Mesorhizobium loti
MCGIFGIVLKNEGTPVCAAAVERCADALAHRGPDASGLYINQSVAFAHRRLSIVDAHSRANQPYRDANTGVVVTYNGEIFNYREIRTELRDMGFFFSTVSDTEVLILSYIAWGKSFLNRLDGIFAFALFDPRNSLVLIARDRLGVKPLYYTICDVGLLFASQPNALIRWPGVMRGPDMIGALSFLSYRAVVGARTLFAGISKLEPGHLLEIRNGRHTSERWWNLSERISRCKPDYSDIRRLLGSAVERQLVADVPVAALLSGGLDSSILAYEASARSQIRPICYTGKVETADYDETAYAMEVAAEFGLTHRVVPIGEPSDIYAVSELVRLRGHPLGMHNEIAMFTLAKAISKEHKVVLTGEGADEIFAGYSRLFRTPYDYNRSKIIAALPRALAQVARRRLGLDVHGSQLQFFLARYSYFPTDEIRSLVIDGRVRREHEMALFDHFSTQFAEAGGDFFSKISYVLVSTHLPALLEMVDNTTMAAGLEARVPYTDHQLVTAAMAMPGSQRLRWRSPIASVQALWHPVASFSERLDVSKFPLRREYRSVLPRSVLSRKKMGFPLPLGQWAVGEGATEYRRLLFDKDSPLGDLFDPAALRRWFEAGRRNPSDSFGRKFWLLANLGIFFKEVFS

SEQ ID NO: 4310 - protein, 400 aa, Hordeum vulgare
MDCCFPCPGARRKRKPPAPAEKPQIPPAPDKAKPGCSSSSAAARQDSLLEAKKEFVLSNGSEHRHIAAQTFTFRELAAATNGFRADCLLGEGGFGRVYKGYLESINQVVAIKQLDRNGLQGNREFLVEVLMLSLLHHPHLVNLIGYCADGDQRLLVYEYMPLGSLEDHLHDPSPDKPRLDWNTRMKIAAGAAKGLEHLHDKTNPPVIYRDLKCSNILLGEGYHPKLSDFGLAKLGPVGDKTHVSTRVMGTYGYCAPEYAMTGQLTLKSDVYSYGVVLLEIITGRRAIDNTRATGEQNLVAWARPLFKDRRKFPQMADPALEGRYPARGLYQALAVAAMCVQEQPTLRPLIGDVVTALSYLASQPYDPEVHGVHRPSRLTASGTPPRSRNHGADRQRGGSE

SEQ ID NO: 4311 - protein, 206 aa, Triticum aestivum
  misc_feature (168)..(168): Xaa can be any naturally occurring amino acid
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGINVEEXFQCIVKNALKNEPEEELYMPDTVDVVGGNRGQGSSGCC

SEQ ID NO: 4312 - protein, 235 aa, Streptochaeta angustifolia
EMRRIENKISRQVTFAERRNGLPKKAYELSLLCDAEVALIIFSSGRLFEFSSASCMYRTLERYRTCNYRSHEAAAPIETESNYQEYLKLKTRVEFLQTTQRNLPGEDLGPLNMKELEQLENQIESSLKNIRSTKNQTLLDQLFDLRHKQQQLQDLNKDLRRKLQEVGGHDNALQVWEDGGPSGSAGHEHLQGLLQPSEIDPSLQIGYHQAYLDQLNNGQIAQYPNGHLPSSAPWI

SEQ ID NO: 4313 - protein, 219 aa, Sorghum bicolor
EMRRIENKISRQVTFAKRRNGLLKKAYELSVLCDAEVALIIFSSRGRLFEFSTSSCTYKTLERYRSCNFASEASAPLEAELNNYQEYLKLKTKVEFLQTTQRNLLGEDLGPLNVKELEQLENQIEISLKHIRSSKNRQMLDQLFDLKRKEQQLQDANKDLRRKGPETSEENVLRLSCQDIGCSGSSGHPGEANQERLHLALDPSLHIGYQAYRDHMNNN

SEQ ID NO: 4314 - protein, 213 aa, Zea mays
  misc_feature (165)..(165): Xaa can be any naturally occurring amino acid
MVLSHAASAGSSDDSVRSTFASRYVRASLPRFRMPENSIPKEAAYQIINDELMLDGNPRLNLASFVTTWMEPECNKLMMDSINKNYVDMDEYPVTTELQNRCVNMIAHLFNAPLGETETAVGVGTVGSSEAIMLAGLAFKRRWQNKMKAAGKPCDKPNIVTGANXVRFAWEKFARYFEVELKEMKLSEGYYVMDPEEGVEMVDENTICVAAIL

SEQ ID NO: 4315 - protein, 513 aa, Vibrio parahaemolyticus
MVSTHWRATMQMSKSFLLITVGLASTSLQAQTLTRDNGAPVGDNQNSITAGENGSVLLQDVHLIQKLQRFARERIPERVVHARGTGAHGEFVASGDFSDLTVSAPFTEKGKVTPVFVRFSTVIHSKGSPETLRDPRGFATKFYTEQGNWDLVGNNLPVFFIRDSIKFPDMVHSLKPSPVTNVQDPNRFFDFFSHEPSATHMLTWVYSNLGTPASYRTMDGFGVHAYKWINQQGDVNYVKFQWKSQQGIKSLRPNKVTEMQGKDFNHLTNDLYAAIGRGNYPKWDLYVKVLSPEALSKLDYNGLDATKVWLNVPDRKVGTMTLNRLPENFFLETEQSAFAPSNLIPGIEPSEDRLLQGRLFAYADTQLYRLGANLFQLPVNRPLTSVNNHNQNGLSNNAQLSNGDVNYEPSRKLNLAEDNQFKAVETKLVGTVQQKAISKPRDFYQAGVLYRSMNEQDRSDLIANLAGDLNKVIDKDIKATMVSYFYRADKEYGSRLAEATDTNLSQVKNKAMM

SEQ ID NO: 4316 - protein, 600 aa, Deinococcus radiodurans
MTQTQPVTPTPPASFQTQHDPRTRLGATPLPGGAGTRFRLWTSTARTVAVRVNGTEHVMTSLGGGIYELELPVGPGARYLFVLDGVPTPDPYARFLPDGVHGEAEVVDFGTFDWTDADWHGIKLADCVFYEVHVGTFTPEGTYRAAAEKLPYLKELGVTAIQVMPLAAFDGQRGWGYDGAAFYAPYAPYGRPEDLMALVDAAHRLGLGVFLDVVYNHFGPSGNYLSSYAPSYFTDRFSSAWGMGLDYAEPHMRRYVTGNARMWLRDYHFDGLRLDATPYMTDDSETHILTELAQEIHELGGTHLLLAEDHRNLPDLVTVNHLDGIWTDDFHHETRVTLTGEQEGYYAGYRGGAEALAYTIRRGWRYEGQFWAVKGEEHERGHPSDALEAPNFVYCIQNHDQIGNRPLGERLHQSDGVTLHEYRGAAALLLPMTPLLFQGQEWAASTPFQFFSDHAGELGQAVSEGRKKEFGGFSGFSGEDVPDPQAEQTFLNSKLNWAEREGGEHARTLRLYRDLLRLRREDPVLHNRQRENLTTGHDGDVLWVRTVTGAGERVLLWNLGQDTRAVAEVKLPFTVPRRLLLHTEGREDLTLGAGEAVLVG

SEQ ID NO: 4317 - protein, 222 aa, Chasmanthium latifolium
ELRRIENKISRQETFAKRRNGLLKKAYELSVLCDAEVAHIIFSSRGRLYEFSTSSCIYKTLERYRSCSYASEASAPMEAELSNYQGYLKLKTRVEFLLTTQRNLLGEDLGPLSAKELEQFENQVEISLKHIRSTKSRQLLDQLFELKRKEQQLQDANKDLRRKIQDTSGENMLRMTCKDIGSSGSSSGHARDAKHQELPHSGVCDPSLRIGYQAYMDQLNNE

SEQ ID NO: 4318 - protein, 704 aa, Pseudomonas putida
MRDQLPPRRISMKHFLPSTALAVMIGLGSLTLGGNAAAANKWDSLQPDRDEIVASLNVVELLKRHHYSKPPLDDARSVIIYDSYIKLLDPARSYFTAADIAEFDKWKTQFDDFLKSGNLDPGFTIYKRYLDRVKQRLDFALAELNKGVDKIDFTTKETLLIDRKDAPWMKNQAELDDLWRKRVKDEVLRQKIAGKEPKQIQETLIKRYKNQLTRLDQTRAEDIFQAYINTFAQSYDPHTNYLSPDNAENFDINMSLSLEGIGAVLQSDNDQVKIVRLVPAGPAAKTKQVAPADKIIGVAQGNKEMVDVVGWRLDEVVKLIRGPKGSVVRLEIIPASNAPSDQTSKIVSITREAVKLEEQAAKKSVLKLKQDGRDYKLGIIEIPAFYLDFKAYRAGDPEYKSTTRDVKKLLTELQKEKVDGVVIDLRNNGGGSLQEATELTSLFIEKGPTVLVRNSDGRVDVLEDENPGAFYKGPLALLVNRLSASASEIFAGAMQDYHRALIIGGQTFGKGTVQTIQPLNHGELKLTLAKFYRVSGQSTQHQGVLPDIDYPSIIDTKEIGESALPEAMPWDTIRPVVKPAADPFRPFLAQLKAQHEARSDKDAEFTYIRDRLALTQKLMNEKTVSLNEQERRARHDSIESKQLALENTRRKAKGEEPLKELKKEDEDALPVEDENTKPEDDAYLAETGRILIDYLSASTKVAKK

SEQ ID NO: 4319 - protein, 221 aa, Pennisetum glaucum
  misc_feature (12)..(12): Xaa can be any naturally occurring amino acid
  misc_feature (202)..(202): Xaa can be any naturally occurring amino acid
EMRRLENKISRXVTSAKRRNGLLKKAYEVAVLCDAEVALIIFSSRGRLFEFSTSSCMYETLEQYRSCNFTSEASSAPIEAELSNYEEYLKLKTRIEFLQTTQRNLLGEDLGPLSTKELEQLENQIEISLKHIRSSKNQQMLDQLFELKRKEQQLQDSNKDLRKKIQETSEENVLRPTFQDLGACGSSGHPRDANQEYLRQLXCDPTLRIGYQSYIDHLSNE

SEQ ID NO: 4320 - protein, 484 aa, Rhodospirillum rubrum
MTTRLTTTAGAPVADNQNSLTAGPRGPVLLQDYQLIEKLAHQNRERIPERVVHAKGWGAHGTLTITHDISRYTRAKLFSAVGKTTPVLARFSTVAGELGAADAERDVRGFSLKFYTEEGNWDLAGNNTPVFFVRDPLKFPDFIHTQKRHPRTHLRSPTAMWDFWSLSPESLHQVTILMSDRGLPLDPMHMNGYGSHTYSFWNDAGERFWVKFHFKTQQGHAHLTNAAAKVVVGESRESYQEALFGTIESGHFPRWTLFVQIMAEREAETTPYNPFDLTKVWPHGDFPLIEVGVLELNRNAENYFAEIEQAAFSPSNVVPGIGHSPDKMLQARVFAYADAHRYRLGTHYEALPVNAPLSPVNHYHKDGPMRFFPNNPNADAYYEPNSFGGPKEDPSVKEPPLRINGDADHYNHREGNDDYVQVGALFALFDEGERQRLFSNIAEAMAGVPEEIIRRQLVHFHRADPAYGEGVAKALGLAPVSQPA

SEQ ID NO: 4321 - protein, 504 aa, Neisseria meningitidis
MTTSKCPVTHLTMNNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDVVGNNTPVFFLRDPRKFPDLNKAVKRDPRTNMRSATNNWDFWTLLPEALHQVTIVMSDRGIPAGYRHMHGFGSHTYSFWNEAGERFWVKFHFRTQQGIKNLTNEEAAKIIADDRESHQRDLYEAIERGEFPKWTMYIQVMPEADAEKVPYHPFDLTKVWPKKDYPLIEVGEFELNRNPENFFADVEQSAFAPSNLVPGVGASPDKMLQARLFNYADAQRYRLGVNFRQIPVNRPRCPVHSNQRDGQGRADGNYGSLPHYEPNSFGQWQQQPDFAEPPLKINGDAAHWDYRQDDDDYFSQPRALFNLMNDAQKQALFGNTAAAMGDAPDFIKYRHIRNCYRCDPAYGEGVAKALGLTVEDAQAARATDPALGQAGLL

SEQ ID NO: 4322 - protein, 303 aa, Unknown
  Rosa hybrid cultivar
TKLVCKMPSRLINWQVQFFGREWDFMDLYHLTLFLGVPFVCLLAPFQFTWGALWVAISLYLVSGMGVTISYHRNLAHQSFKVPKWLEYSLAYCAVLSLQGSPLEWVSTHRYHHQFTEKLRDPHSPNKGFWFSHLNWLFDYHSRFGSYDGQLMKNVGDLECQLYYRFLHYTYFLHSVLLGVALYVAGGLPFVIWGMGVRVVVISQVTFSINSICHTWGKQIWDTGDASKNNWLFGLLAFGEGWHNNHHAFEYSARQGLERWQIDTSWYVIKFFQVVGLATHVKLPTEIQKKRKALAKNSIMKDK

SEQ ID NO: 4323 - protein, 329 aa, Beta vulgaris
MTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 4324 - protein, 485 aa, Candida tropicalis
MAPTFTNSNGQPIPEPFATQRVGQHGPLLLQDFNLIDSLAHFDRERIPERVVHAKGSGAYGVFEVTDDITDVCAAKFLDTVGKKTRIFTRFSTVGGELGSADTARDPRGFATKFYTEEGNLDLVYNNTPVFFIRDPSKFPHFIHTQKRNPETHLKDANMFWDYLTSNEESVHQVMVLFSDRGTPASYREMNGYSGHTYKWSNNKGEWFYVQVHFISDQGIKTLTNEEAGSLAGSNPDYAQEDLFKNIAAGNYPSWTCYIQTMTEAQAKEAEFSVFDLTKVWPHGKYPMRRFGKFTLNENPKNYFAEVEQAAFSPAHTVPHMEPSADPVLQSRLFSYADTHRHRLGTNYTQIPVNCPVTGAVFNPHMRDGAMNVNGNLGNHPNYLASDKPVEFKQFSLQEDQEVWHGAATPFHWKATPADFKQATELWKVLKKYPNQQEHLAHNVAVHASAADAPIQDRVIAYFTKVHPDLGDLIKKEILELSPRK

SEQ ID NO: 4325 - protein, 275 aa, Xylella fastidiosa
MRDPFDMEAERQAWSHSMRLTPLPAFDNNYIWTLIAPDGRAIIVDPGQALPILEAHSKGLIPTAILLTHHHADHIGGVPELLERWPTLPVYAPHDTRIALNYHRIGEGDSLNILGMRFQVIHTPGHTHSHLTFIGNDLLFCGDTLFSLGCGQIFEGTPTQMLASLQRLAALPIQTRVCCGHEYTLSNAAFALHVDPTNTALQKRRQQANAMRLAGLPTLPISLESELNTNPFLRTAAPTIHAATSTHLQRTPIDEVEVFATLRHWKNNFPIKNIP

SEQ ID NO: 4326 - protein, 459 aa, Arabidopsis thaliana
  misc_feature (69)..(69): Xaa can be any naturally occurring amino acid
  misc_feature (433)..(433): Xaa can be any naturally occurring amino acid
MVRRQEEEKKAEKGMRLGKYELGRTLGEGNFGKVKFAKDTVSGHSFAVKIIDKSRIADLNFSLQIQFLXSVQIKREIRTLKMLKHPHIVRLHEVLASKTKINMVMELVTGGELFDRIVSNGKLTETDGRKMFQQLIDGISYCHSKGVFHRDLKLENVLLDAKGHIKITDFGLSALPQHFRDDGLLHTTCGSPNYVAPEVLANRGYDGAASDIWSCGVILYVILTGCLPFDDRNLAVLYQKICKGDPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVKQEERNQKGQVGLSVTAEVFEIKPSLNVVELRKSYGDSCLYRQXVRETIKRRGHILAGARDSNLGVGVFG

SEQ ID NO: 4327 - protein, 246 aa, Brassica napus
MNIAHTIFGVFGNATALFLFLAPSITFKRIIKNKSTEQFSGIPYPMTLLNCLLSAWYGLPFVSKDNTLVSTINGTGALIERVYVLIFLFYAPKKEKAKIFGVFTAVLAVFATVALVSLFALHGNARKLFCGIAATVFSIIMYASPLSIMRLVIKTKSVEYMPFFLSLFVFLCGTSWFIYGLIGRDPFVAIPNGFGCALGTLQLILSIIYCGNKGEKSAEKDAKSLEMKGEEKKQNVVNGKQQEQQV

SEQ ID NO: 4328 - protein, 466 aa, Streptococcus pyogenes
MKQRKHRYQFPDGFLWGSSTSGPQSEGTVPGDGKGPSNWDYWFSIESAKFHHQIGPEKTSTFYENYKGDIALLKETGHTIFRTSIQWSRLIPEGVGEVNPKAVTFYREVFQDIIAQGIKLIVNFYHFDLPYALQEKGGWENKATVWAYETYAKTCFELFGDLVNTWITFNEPIVPVECGYLGYYHYPCKVDAKAAVQVAYNTQLASSLAVKACHELHSDHKISIVLNMTPAYPRSDAPEDVKAARIAELFQTKSFLDPSVLGVYPAELVSILEEADLLPQYSADELEIIKNNTVDFLGVNYYQPLRVQAPSKSQQEGDPLILDIYFEPYDMPGKKVNPHRGWEIYEPGLYDIALNLKEHYGNIEWLVTENGMGVEGEEAFLADGQIQDDYRITFIEDHLIQLHKALGEGANCKGYLLWTFIDCWSWLNAYKNRYGLVALDLESQKRTIKKSGYWFKALSESNGFDK

SEQ ID NO: 4329 - protein, 192 aa, Welwitschia mirabilis
DDHGEVISEIRRSDLEPYLGLHYPATDIPQASRFLFMKNRVRMICDCYATPVRVIQDKKLPKDLSFCGSTLRAPHGCHAQYMANMGSVACVVMAVMINEREEEEGDSGGQGHQKGRRLWGLIVCHHTSPRFVPFPLRYACEFTMQVFSIQLNKEVELALQLREKNILRTQMLLCDMLLRESPLAIVTQKPNI

SEQ ID NO: 4330 - protein, 364 aa, Vibrio vulnificus
MSKLFEPTQLKHLDLQNRVAMAPMTRARTSQPGNIPNAMMATYYKQRASAGLIISEATQISDDSQGYSFTPGVYTDEQVAGWKRVTQAVKSQGAAMFCQLWHVGRVSHPVFQKGEQPIAPSALAPVETKVWIADEQGNGNMVDCVEPRAMTQDDIDRVVSDFAYAAKRAIEAGFDGVEIHGGNGYLIDQFLRTNSNHRTDQYGGSRENRIRFLLQVVDAVSQAIGADKVGVRLAPFITFKDMNCPDIVPTILEASKQLQARDIAYLHLSEADWEDAPEIPESFRIELREYFTNTIIVAGSYTQARADEVLEKGYADLVAFGRPFVSNPDLVARLKHQQPLAELDGATLFGGDERGYTDYTALHV

SEQ ID NO: 4331 - protein, 428 aa, Anabaena variabilis
MVITKSRLVLGATAVTLSTIAVTSLGIHSRGQALFKASPKELVDEVWQIVQRQYVDGTFNQVDWQAVRKEYLNKSYSNQQEAYKSIREMLKRLNDPYTRFMDPQEFKNMQVDTSGELTGIGITISQDEKTKQLVVIAPIEDTPAFKAGILAKDVILKIDGKSTKGMDTNQAVNLIRGTAGSQVTLTIQRSNQEKQFKITRARIEIHPVRYSQKPTSVGKVGYIRLNQFSANAGKEMQEAIKNLEKQQVAGYILDLRGNPGGLLFSSVEIARMWMDKGTIVSTVDRQGEREREVANGRALTNKPLVILVDKGSASASEILSGALQDNKRAVIVGTQTFGKGLVQSVRPLDDGSGLAVTIAKYLTPNDRDINKHGIDPDVKVELTDAQRQDLWLREREKLGTLDDLQFAKAVEILGKQIAAKGTPTAEKK

SEQ ID NO: 4332 - protein, 221 aa, Petalodiscus platyrachis
DIPQASRFLFMKNKVRMICDCQAPPVQVIQEKRLAQPLSLSGSTLRSPHGCHAQYMANMGSIASLVMSVTINEDDDEMDNDQQRGRKLWGLVVCHHTSPRFVPFPLRYACEFLIQVFGVQVNKEVELAAQMREKHILQTQTVLCDMLLRDAPVAIITQSPNVMDLVKCDGAALYYRSKFWLLGVTPTEAQIRDTAEWLLEYHGGSTGLSTDSLMEAGYPGG

SEQ ID NO: 4333 - protein, 679 aa, Orobanche minor
MGTSGGGCSIVWFRRDLRVEDNPALAAGVRAGAVLPLFIWAPEEEGHYYPGRVSRWWLKQSLSHLDISLRSLGTSLVTRRSTDSVSSLLEVIKLTGAKQIFFNHLYDPISLVRDHRAKEVLTAEGVAVRSFNADLLYEPWEVHDQEGQPFTTFAGFWERCLSMPYDPEAPLLPPKRIISGDLSRCTSDTLVFEDESEKGSNALLARAWSPGWSNADKALTVFTNGPLLEYSKNRRKADSATTSFLSPHLHFGEVSVRKIFHLARIKQVLWANEGNKAGEESINLFLKSIGLREYSRYMSFNHPYSHERPLLGHLKYFPWVIDEGYFKAWRQGRTGYPLVDAGMRELWATGWLHDRIRVVVSSFFVKVLQLPWRWGMKYFWDTLLDADLESDALGWQYISGSLPDGCELDRIDNPQFDGYKCDPNGEYVRRWLPELARLPTEWIHHPWNTPESVLQAAGIELGSNYPLPIVGIDTAKARLQEALSQMWQHETASRAAIENGVEEGLGESSEFTPIAFPPNTQIDMDNEPVRNNPINAITRRYEDQMVPTMTSSLIRVVDEETSIGLDISDNDGRAEVPSNIVNFMEEPRGGPHDDNGVIVDGNDNNGFLQYEFLRGRRHSEDSTAESSSSGRRERDGGVVPVWSPSNSTYPNQFPGEDSGIGTSSSFLPRHPQSASLTSW

SEQ ID NO: 4334 - protein, 224 aa, Petalodiscus leandrianus
DIPQASRFLFMKNKVRMICDCQAPPVKVIQEKGLAQPLSLSGSTLRSPHGCHAQYMANMGSIASLVMSVTINEDDDEMDNDQQRGRKLWGLVVCHHTSPRFVPFPLRYACEFLIQVFGVQINKEVELAAQMREKHILQTQTVLCDMLLRDAPVAIIIQSPNVMDLVKCDGAALYYRSKFWLLGVTPTEAQIRDIAEWLLEYHGGSTGLSTDSLMETGYPGAAIL

SEQ ID NO: 4335 - protein, 243 aa, Zea mays
MGRGRVELKRIENKINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELEQLEKQLDSSLRHIRSTRTQHMLDQLTDLQRREQMLCEANKCLRRKLEETSNQVHGQVWEHGANLLGYERHSPQQQAPSHVGNGLFFHPLEAAAEPTLQIGFAPEHMNNFMPTWLP

SEQ ID NO: 4336 - protein, 218 aa, Phyllanthus cf.
DIPQASRFLFMKNKVRMICDCQAPPVKVVQDKQLAQPLSLCGSTLRSPHGCHAQYMANMGTMASLVMSVTINEDDEETDNDQQIGRKLWGLLVCHHTNPRFVPFPLRYACEFLMQVFGVQVNREVELAAQMREKHILRTQTVLCDMLLRDAPVAIVTQSPNVMDLVKCDGAALYYRKKFWLLGVTPTEAQIKEITEWLLEYHGESTGLSTDSLRKLES

SEQ ID NO: 4337 - protein, 438 aa, Arabidopsis thaliana
MANYISSVLKSLLLLLHLVFLIQQHVDSASIVKFLPGFEGSLPFELETGYIGIGEEEEVQLFYYFIKSERNPKEDPLLLWLSGGPGCSSISGLLFENGPLAMKLDVYNGTLPSLVPTTYSWTKTSSMIFLDQPVGTGFSYSRTQQYNKPSDSGEAKRIHEFLQKWLSKHQEFSSNPFYVAGDSYSGMVVPATVQEISKGNYQCCSPPINLQGYVLGNPITEHAIDYNYRIPFAHGMALISDELYESLKRVCKGEYVDPRDTECLKLVEEFSKCTKGVCQEVVIKPLCVTETPNCYIYRYLLTTYWVNDVNVRKALQINKESIGEWVRCYFGIPYTHDIKSSVPYHMNNSINGYRSLIYSGDHDLNVPFLATQAWVRSLNYSIIDNWRPWMIKDQIGGYTKTYANKMTFATVRASGHTAEYKPYETYIMFHRWINGQPL

SEQ ID NO: 4338 - protein, 234 aa, Hordeum vulgare
MGRGRIEIKRIENTTNRQVTFCKRRNGLLKKAYELSVLCDAEVALVVFSSRGRLYEYSNNSVKATIERYKKANSDTSNSGTVAEVNAQYYQQESSKLRQQISSLQNSNSRSLVRDSVSTMTLRDLKQLEGRLEKGIAKIRARKNELMYAEVEYMQKREMELHNDNIYLRSKVSENERGQQPMNMMASGSTSSEYDHMVAPYDSRNFLQVNMQQQQHYSQQLQPTALQLGQQYFN

SEQ ID NO: 4339 - protein, 455 aa, Arabidopsis thaliana
MMMNRDILFHQQQQQQMEENMSNLTSASGDQASVSSGNRTETSGSNINQHHQEQCFVPQSSLKRKRNQPGNPDPEAEVMALSPKTLMATNRFICEVCNKGFQRDQNLQLHKRGHNLPWKLKQRSNKDVVRKKVYVCPEPGCVHHHPSRALGDLTGIKKHFFRKHGEKKWKCEKCSKKYAVQSDWKAHAKTCGTKEYKCDCGTLFSRRDSFITHRAFCDALAEESARAMPNPIMIQASNSPHHHHHQTQQNIGFSSSSQNIISNSNLHGPMKQEESQHHYQNIPPWLISSNPNPNGNNGNLFPPVASSVNTGRSSFPHPSPAMSATALLQKAAQMGSTKSTTPEEEERSSRSSYNNLITTTMAAMMTSPPEPGFGFQDYYMMNHQHHGGGEAFNGGFVPGEEKNDVVDDGGGETRDFLGLRSLMSHNEILSFANNLGNCLNTSATAQQQQQHSHQD

SEQ ID NO: 4340 - protein, 611 aa, Fusobacterium nucleatum [sequence omitted]

SEQ ID NO: 4341 - protein, 441 aa, Arabidopsis thaliana
MANKYFSSVLKSLLLLLHLVFLSKQHVDSASIVKFLPGFEGPLPFELETGYIGIGEEEEVQLFYYFIKSERNPKEDPLILWLTGGPGCSSISGLLFENGPLTMKLDVYNGTLPSLVSTTYSWTKTSSMIFLDQPVGTGFSYSRTQQFNKPSDSGEAKRIHEFLQKWLGKHQEFSSNPFYVAGDSYSGLVVPATVQEISKGNYECCNPPINLQGYVLGNPLTDYAIDSNSRIPFAHGMALISDELYESLKKTCKGEYTNVHPRNTQCLKFIEEFNKCTNRILQQLILDPLCETETPDCYIYRYLLTTYWANDATVREALQINKESIGEWVRCYRTIPYDNDIKSSMPYHVNNSISGYRSLIYSGDHDLEVPYLGTQAWIRSLNYSIIDDWRPWMIKNQIAGYTRTYANKMTFATIKGGGHTIEFKPEEASIMFQRWINGQPL

SEQ ID NO: 4342 - protein, 232 aa, Hordeum vulgare
MGRGRIEIKRIENTTNRQLTFCKRRNGLLKKAYELSVLCDAEVALVVFSSRGRLYEYSNNSVKATIERYKKATSDTSSAGTVAEINAQHYQQESAKLRQQITTLQNSNRTLIGDTMATMSHRDLKQLEGRLDKGLGKIRARKNELLSAEIEYMQRREMELQNNNFYLREKVAETERGQQQTLNMMGAASTSNEYDQNMIQCDPRTFLQFNIMQQPQYYTQQEDRKTLNSVER

SEQ ID NO: 4343 - protein, 210 aa, Phyllanthus nummulariifolius
DLPQASRFLFMKNKVRMICDCQAPPVKVVQDKRLAQPLSLCGSTLRSPHGCHAQYMANMGTIASLVMSVTINDGDEETDNDQQIGRKLWGLVVCHHTKPMFVPFPLRYACEFLMQVFGVQVHREVELAAQTTEKHILQTQTVLCDMLLRDAPVAIVTQSPNVMDLVKCDGAALYYRKKFWMLGVTPTEAQIKDITEWLLEYHGESTGLST

SEQ ID NO: 4344 - protein, 441 aa, Arabidopsis thaliana
MANNNVYSVLKSLLLLLHLVFLSKQHVDSASIVKFLPGFEGPLPFELETGYIGVGEEEEVQLFYYFIKSERNPKEDPLLLWLTGGPGCSAISGLLYQNGPLAMKLDVYNGTLPSLVSTTYSWTKTSSMIFLDQPVGTGFSYSRTQLFNKPSDTGEAKRIHEFLQKWLGKHQEFSSNPFYVGGDSYSGLVVPATVQEISKGNCQCCNRPINLQGYVLGNPLTDCVYDCNYRVPFAHKMALISDELYESLKRTCRGEYVNVHPHDTECLKFVEEFNKLTNRVCERHILHSCCETETPSCYSYRFMLTTYWANDETVRKALQINKESIGEWTRCYRGIPYNHDIKSSVPYHMNNSIDGYRSLIYSGDHDIQVPFLGTQAWIRSLNYSIIDDWRPWMIKDQIAGYTTSYVNKMTFATVTGGGHTAEFTPKETFMMFQRWINGQPL

SEQ ID NO: 4345 - protein, 502 aa, Arabidopsis thaliana; identical to SEQ ID NO: 142

SEQ ID NO: 4346 - protein, 275 aa, Bacillus anthracis
MHIPTTTLHNGVKMPMIGLGVYKAKEGDEVKQAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKIKPMVNQVELHPMLTQFELRNFCQGEQIQMEAWSPLMRGGEVFQHPIIQAIATKYEKTPAQVILRWDIQSGIVTIPKSVTPSRIQENFSIFDFSLTEEEMTEINTLNRNLHVGTNPDKYDTL

SEQ ID NO: 4347 - protein, 67 aa, Arabidopsis thaliana
KNVVCNFTEGAMYSFPQIRLPTGALQAAKQAGKVPDVFYCLKLLEATGISTVPGSGFWTEKKVLFPF

SEQ ID NO: 4348 - protein, 248 aa, Glycine max
MGRGRVELKRIENKINRQVTFAKRRNGLLKKAYELSVLCDAEVALIIFSTRGKLYEFCSTNSMLKTLERYQKCSYGAVEVSKPGKELESSYREYLKLKARFESLQRTQRNLLGEDLGPLNTKDLEQLERQLDSSLKQVRSTKTQFMLDQLADLQNKEHMLVEANRSLTMKLEEINSRNQYRQTWEAGEQSMPYGTQNAHSQGFFQPLECNPTLQIGSDYRYNPEASEQQLAATTQAQQVNGFIPGWML

SEQ ID NO: 4349 - protein, 365 aa, Yersinia pestis
MKTAKLFSPLKVGALTLPNRVFMAPLTRLRSIEPGDIPTPLMAEYYRQRASAGLIITEATQISFQAKGYAGAPGLHTQEQLNAWKKVTQGVHNEGGHIAVQLWHVGRISHNSLQPGQQAPVAPSAIAADTRTTVRDETGAWVRVPCSTPRALETEEIPGIINDFRQATANAREAGFDYIELHAAHGYLLHQFMSPASNQRTDQYGGSIENRTRLTLEVVDATAAEWGADRIGIRISPLGPFNGLDNGEDQEEAALYLIDQLNKRNIAYLHISEPDWAGGKPYSDTFRAAVRAHFNGVIVGAGAYSAEKAECLIQKGFIDAVAFGRSYISNPDLVTRLQQHAPLNEPDSNTFYGGGAKGYTDYPTL

SEQ ID NO: 4350 - protein, 612 aa, Arabidopsis thaliana
  misc_feature (386)..(386): Xaa can be any naturally occurring amino acid
MKMDKKTIVWFRRDLRIEDNPALAAAAHEGSVFPVFIWCPEEEGQFYPGRASRWWMKQSLAHLSQSLKALGSDLTLIQTHNTISAILDCIRVTGPTKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFGVKFLLLPWKWGMKYFWDTLXDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSVVRYNGSKRVKPEEEEERDMKKSRGFDERELFSTAESSSSSSVFFVSQSCSLASEGKNLEGIQDSSDQITTSLGKNGCK

SEQ ID NO: 4351 - protein, 440 aa, Rhodobacter sphaeroides
MTFSRADFPADFLFGVATSAYQIEGHGAGGAGRTHWDDFAAAPGNVAHAEDGRRACDHYHRWEEDLDFVRDAGFDSYRFSASWARVMPEGRGTVNAEGLDFYDRLVDGMLARGLKPALTLYHWELPSALQDLGGWRNRDIAGWFADYAEVLLGRIGDRVWSTAPVNEPWCVAWLSHFLGHHAPGLRDIRAAARAMHHVLLAHGAAVESARGLGVGNLGAVCNFEHAIPADGSEASAAATRRHDALINRWFVSALFNRQYPEEALDGIAPHLPSGWEKDLDRIAQPLDWFGINYYTRKLVAAAPGPWPGLSEVEGPLPRTRMGWEIHPEGLSDILLRIHEGYTRGLPLIVTENGMAAADRVQAGEVQDPDRIAYLEGHLAAVQRAIAQGVPVRGYHVWSLLDNFEWAFGYDQRFGLVHVDFQNLQRTPKASYHALARALAR

SEQ ID NO: 4352 - protein, 724 aa, Xanthomonas campestris
MTNRWDPGVTRALAEARHGDAFAVLGAHPSTNGRLLRTYHPGAEHVTAVLADGREVPLEAGPEPGLFAGELPAEGRYRLRIGWPGGTQDTADPYAFGPLLSDFDLHLISEGHHLQLADALGANAVEVDGVRGTRFAVWAPNASRVAVVGDFNSWDARRHPMRLRHQAGVWELFVPDVGPGAHYKYQLRGPHGHELPAKADPVARRAELAPGTASIVADPTPHQWSDDGWMATRARRQAHDAPMSIYEIHAGSWLREEGLDLDWDGLADRLIPYVADMGFTHVELMPVTEHPFGGSWGYQPLGLFAPTARFGSPDGFARFVDRCHREGIGVIVDWVPAHFPTDAHGLAHFDGTALYEHADPREGFHRDWNTLIYNHGRREVSGFLIASALEFLQRYHVDGLRVDAVASMLYRDYSRNAGEWVPNIHGGRENYETIAFLRRLNEVVREHAPGAVTIAEESTAWPGVTADVSHGGLGFHYKWNMGWMHDTLHYIGLDPIYRRYHHGELTFSMVYAYSERFVLPISHDEVVHGKGSLLGRMPGDDWQRFANLRAYLGFMFTHPGRKLLFMGCEFGQPTEWNHDAGLPWHLLDDARHRGVQTLVRDLNHLYAQYPALHAHDDDPSGFAWLVGDDAANSVVAFLRKGKRGDAPVLVVINYTPVVQQGYRLGVPQGGLWREVFNSDAGIYGGANLGNGGAVTAEPQSMHGHAQSLPLLLPPLGVIVLAPQG

SEQ ID NO: 4353 - protein, 612 aa, Arabidopsis thaliana
  misc_feature (386)..(386): Xaa can be any naturally occurring amino acid
MKMDKKTIVWFRRDLRIEDNPALAAAAHEGSVFPVFIWCPEEEGQFYPGRASRWWMKQSLAHLSQSLKALGSDLTLIQTHNTISAILDCIRVTGPTKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLXDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSVVRYNGSKRVKPEEEEERDMKKSRGFDERELFSTAESSSSSSVFFVSQSCSLASEGKNLEGIQDSSDQITTSLGKNGCK

SEQ ID NO: 4354 - protein, 477 aa, Oryza sativa
MGISKGGSGKEAKKPPLLLGRFEVGKLLGQGNFAKVYHARNVATGEEVAIKVMEKEKIFKSGLTAHIKREIAVLRRVRHPHIVQLYEVMATKLRIYFVMEYVRGGELFARVARGRLPEADARRYFQQLVSAVAFCHARGVFHRDIKPENLLVDDAGDLKVSDFGLSAVADGMRRDGLFHTFCGTPAYVAPEVLSRRGYDAAGADLWSCGVVLFVLMAGYLPFQDRNLAGMYRKIHKGDFRCPKWFSPELIRLLRGVLVTNPQRRATAEGIMENEWFKIGFRRFSFRVEDDRTFTCFELDDDAAVDAPTSPPDTPRTVDSGDVGAAPTRPRKAGSLTSCDSAPLNAFDIISFSPGFDLSGLIPEQQKHTARFVSAAPVEVIVATLEAAAAAAGMAVREREDGSISMEGTREGEHGALAVAAEIYELTPELVVVEVRRKAGGAAEYEEFFRARLKPSLRELVCDDRPCPEDSGELSRSL

SEQ ID NO: 4355 - protein, 768 aa, Triticum aestivum
MATFAVSGATLGVARPPAAAQPEELQIPEDIEEQTAEVNMTGGTAEKLESSEPTQGIVETITDGVTKGVKELVVGEKPRVVPKPGDGQKIYEIDPTLKDFRSHLDYRYSEYRRIRAAIDQHEGGLEAFSRGYEKLGFTRSAEGITYREWAPGAHSAALVGDFNNWNPNADTMTRDDYGVWEIFLPNNADGSPAIPHGSRVKIRMDTPSGVKDSISAWIKFSVQAPGEIPFNGIYYDPPEEEKYVFQHPQPKRPESLRIYESHIGMSSPEPKINSYANFRDEVLPRIKRLGYNAVQIMAIQEHSYYASFGYHVTNFFAPSSRFGTPEDLKSLIDRAHELGLLVLMDIVHSHSSNNTLDGLNGFDGTDTHYFHGGPRGHHWMWDSRLFNYGSWEVLRFLLSNARWWLEEYKFDGFRFDGVTSMMYTHHGLQMTFTGNYGEYFGFATDVDAVVYLMLVNDLIHGLHPDAVSIGEDVSGMPTFCIPVPDGGVGFDYRLHMAVADKWIELLKQSDESWKMGDIVHTLTNRRWLEKCVTYAESHDQALVGDKTIAFWLMDKDMYDFMALDRPSTPRIDRGIALHKMIRLVTMGLGGEGYLNFMGNEFGHPEWIDFPRGPQTLPTGKVLPGNNNSYDKCRRRFDLGDADFLRYHGMQEFDQAMQHLEEKYGFMTSEHQYVSRKHEEDKVIIFERGDLVFVFNFHWSNSFFDYRVGCSRPGKYKVALDSDDALFGGFSRLDHDVDYFTTEHPHDNRPRSFSVYTPSRTAVVYALTE

SEQ ID NO: 4356 - protein, 372 aa, Yersinia pestis
MELPMNQSYLWATLLTLAVLCINKSIFNRRFRDCVMKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVTAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 4357 - protein, 282 aa, Helianthus annuus
MSLVGGFTEVKDFANSIVIDDLARFAVDEYNKKQNTLLEFRKVLNAKEQIVSGTLYYITLDAANGGIIKTYEAKVWVKKWENLKELQEFKPVDAATSVIGGITEVKDFANSLEIEDLARFAVDEHNKKQNTLLEFGKVLNAKEQIVAGKLCYITLEATDGGVKKTYEAKVWVKPWENFKELQEFKPVDAATPVIGGITEVKDFANSLVIDDLARFAVDEYSKKQNTLLEFERVLDAKQQIVAGTMYYFILEATVGGVKNTYVAKVLLKPDNSKELKEFKHLY

SEQ ID NO: 4358 - protein, 219 aa, Arabidopsis thaliana
MAQQSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIIALILIIVLSVCHGFKC

SEQ ID NO: 4359 - protein, 520 aa, Candida albicans
MLRVNSRLLTTRKSQFMFTSNSLRFLATFKPADPLTTHDINPQTVEAKYAVRGKIPIIADELNELIQKQPQSHGLPFSKIINANIGNPQQLEQRPLTWYRQVLSLLQYPDLLKNGDPETVKSLYPEDVIERAQSILKHIGSIGAYSHSQGASYFRQSIAEFITNRDGGYVSHANNIFLTSGASTAVSYLLQILSVNENSGFLIPIPQYPLYTATIALNNAKPIGYYLDESNHWSTNPQEIRELIETNQSQGINIKALVVINPGNPTGAILSSQDIIELIDIAAEYGIVLIADEVYQENIFKGKFVSFKKILSELIEQDPQTYKHVQLASLHSTSKGVSGECGQRGGYMELVGFKPEVKDVVFKLASINLCSVVSGQALMELMINPPQEGDPSYPLYKSETESIHNDLESRAESLYQAFLQMEDIKCNKPMGAMYIFPTLDFDPARYHKLYSRAKNSNLQIDDIYCIELLEGTGICCVPGNGFGQKPDTYHLRTTFLPPGKEWIDKWINFHKSFIKKYKDE

SEQ ID NO: 4360 - protein, 376 aa, Unknown
  uncultured archaeon
MEERGISKHELKLFLKEQKQRDLTYRKVLSSMCTYPHEIAVYAHNLFLDSNLGDSGLFPGTKEIEDELIRMIGALLGNENAHGYISAGGTESNIQAIRAIRNRKRKEGLQQMNIIVPKTAHFSFDKIEDLLSLEVKKAGLDDELRVDVNLVEDLIDDNTISIVGIAGTTEFGQIDPIKELADLAHNSDIFLHVDAAFGGFVIPFLDAEYLFDFSLDAVSSISIDPHKMGLSTIPAGCILFRDVSYLADLAVNTPYLTTNEQCSLIGTRSGAPVAATYAVLKYLGRNGLRAIVDECMQLTRMLVHGAKEMGIYPVIEPVMNVVTLRFPDVERVAKALEARGWQVSTTRAPKALRLVIMPHVTEDTIEMFLNDLENAK

SEQ ID NO: 4361 - protein, 312 aa, Triticum aestivum
  misc_feature (113)..(113): Xaa can be any naturally occurring amino acid
  misc_feature (305)..(305): Xaa can be any naturally occurring amino acid
MARHFLLNTGAKIPSVGLGTWQADPGVVGDAVYAAVKAGYRHIDCARVYGNEKEIGLALKKLFEEGVVKREDLFITSKLWNDHHAPEDVPEALNESLNDLQLDYLDLYLIHWXPFRVKKGTNNNPENFVTPDIPATWGAMEKLHDAGKARAIGVSNFSSKKLGDLLAVARVPPAVDQVECHPCWQQTKLHNFCQSAGVHLSAYSPLGSPGTSWMNGNILKEPIIISISEKLGKTPAQVALRWNIQMGHSVLPKSTNQERIKQNLDVHDWSIPDDVLAKFSEIKEARLLRGNFAVNPQSVYKTHEXELWDGEI

SEQ ID NO: 4362 - protein, 275 aa, Triticum monococcum
MEADASHAPTTSSSSVSSSTLSTSSSSSSLATSALELPKSPKPKHPKKRKRAASDREQDAAANTNGVRGDESSCCSTDEDNAAASVKAAVPKSGFKHPSYRGVRRRSWGKWVSEIREPRKKSRIWLGTFPTAEMAARAHDVAALAIKGRSAHLNFPELAHELPRPDSTSPADIQAAAAKAAATAAVQCEAEPEHEPETPSSSSGAASETPEPAPCAEAAPADSGEVDNALFDLPDLLLDLRDGLFWSPVWPAALAAEEYDGGCCVGLSEPLLWAE

SEQ ID NO: 4363 - protein, 210 aa, Phyllanthus nummulariifolius
DIPQASRFLFMKNKVRMICDCQAPPVKVVQDKRLAQPLSLCGSTLRSPHGCHAQYMANMGTMASLVMSVTINDGDEETDNDQQIGRKLWGLVVCHHTKPMFVPFPLRYACEFLMQVFGVQVHREVELAAQTTEKHILQTQTVLCDMLLRDAPVAIVTQSPNVMDLVKCDGAALYYRKKFWMLGVTPTEAQIKDITEWLLEYHGESTGLST

SEQ ID NO: 4364 - protein, 814 aa, Zea mays
DLPSVLFRRKDAFSRTVLSCAGAPGKVLVPGGGSDDLLSSAEPVVDTQPEELQIPEAELTVEKTSSSPTQTTSAVAEASSGVEAEERPELSEVIGVGGTGGTKIDGAGIKAKAPLVEEKPRVIPPPGDGQRIYEIDPMLEGFRGHLDYRYSEYKRLRAAIDQHEGGLDAFSRGYEKLGFTRSAEGITYREWAPGAYSAALVGDFNNWNPNADAMARNEYGVWEIFLPNNADGSPAIPHGSRVKIRMDTPSGVKDSIPAWIKFSVQAPGEIPYNGIYYDPPEEEKYVFKHPQPKRPKSLRIYESHVGMSSPEPKINTYANFRDEVLPRIKKLGYNAVQIMAIQEHSYYASFGYHVTNFFAPSSRFGTPEDLKSLIDKAHELGLLVLMDIVHSHSSNNTLDGLNGFDGTDTHYFHGGPRGHHWMWDSRLFNYGSWEVLRFLLSNARWWLEEYKFDGFRFDGVTSMMYTHHGLQVTFTGNYGEYFGFATDVDAVVYLMLVNDLIRGLYPEAVSIGEDVSGMPTFCIPVQDGGVGFDYRLHMAVPDKWIELLKQSDEYWEMGDIVHTLTNRRWLEKCVTYCESHDQALVGDKTIAFWLMDKDMYDFMALDRPSTPRIDRGIALHKMIRLVTMGLGGEGYLNFMGNEFGHPEWIDFPRGPQSLPNGSVIPGNNNSFDKCRRRFDLGDADYLRYRGMQEFDQAMQHLEGKYEFMTSDHSYVSRKHEEDKVIIFERGDLVFVFNFHWSNSYFDYRVGCFKPGKYKIVLDSDDGLFGGFSRLDHDAEYFTADWPHDNRPCSFSVYAPSRTAVVYAPAGAEDE

SEQ ID NO: 4365 - protein, 492 aa, Streptococcus mitis
MVRGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIETAVAAAVEALKNNAIPVANKEAIAQVAAVSSRSEKVGEYISEAMEKVGKDGVITIEESRGMETELEVVEGMQFDRGYLSQYMVTDSEKMVADLENPYILITDKKISNIQEILPLLESILQSNRPLLIIADDVDGEALPTLVLNKIRGTFNVVAVKAPGFGDRRKAMLEDIAILTGGTVITEDLGLELKDATIEALGQAARVTVDKDSTVIVEGAGNPEAISHRVAVIKSQIETTTSEFDREKLQERLAKLSGGVAVIKVGAATETELKEMKLRIEDALNATRAAVEEGIVAGGGTALVNVIPAVADLELTGDEATGRNIVLRALEEPVRQIAHNAGFEGSIVIDRLKNAEVGTGFNAATGEWVNMIDQGIIDPVKVSRSALQNAAS

SEQ ID NO: 4366 - protein, 223 aa, Phyllanthus cf.
DIPQASRFLFMKNKVRMICDCQAPPVKVVQDKQLAQPLSLCGSTLRSPHGCHAQYMANMGTMASLVMSVTINEDDEETDNDQQIGRKLWGLVVCHHTNPRFVPFPLRYACEFLMQVFGVQVNREVELAAQTREKHILRTQTVLCDMLLRDAPVAIVTQSPNVMDLVKCDGAALYYRKKFWLRGVTPTEAQIKDITEWLLEYHGESTGLSTDSLMEAGYPGAAS

SEQ ID NO: 4367 - protein, 208 aa, Oryza sativa
MAGHVLGGAHDAPSAANSVETDALARFAVDEHNKRENALLEFVRVVEAKEQVVAGTLHHLTLEALEAGRKKVYEAKVWVKPWLDFKELQEFRNTGDATTFTNADLGAKKGGHEPGWRDVPVHDPVVKDAADHAVKSIQQRSNSLFPYELLEIVRAKAEVVEDFAKFDILMKLKRGNKEEKFKAEVHKNLEGAFVLNQMQQEHDESSSQ

SEQ ID NO: 4368 - protein, 223 aa, Phyllanthus calycinus
DIPQASRSLFMKNKVRMICDCQAPPVKVVQDKKLAEPLSLCGSTLRSPHGCHSQYMANMGTMASLVISVKINEDDEEIDNDQQIGRKLWGLVVCHHTNPRFVPFPLRYACEFLMQVFGVQVNREVELATQTREKHILQTQSVLCDMLLRDAPIAIVTQSPNVMDLVKCDGAALYYRKKFWLLGLTPTEAQIKDITEWLLEYHGDSTGLTTDSLMEAGYPGAAF

SEQ ID NO: 4369 - protein, 591 aa, Sinorhizobium meliloti
MCGICGEVRFDGGSPSVTAVSIMADVLAPRGPDASGVVVRGNVGLGHRRLRILDLSDKSQQPMVDSDLGLSLVFNGCIYNFRELRLELEEKGYRFFSSGDTEVILKAWHAWGEECVSRFHGMFAFVIHERDSGRVVMARDRFGIKPLYIAEVQGALRFASALPALVKAGGVDTSIDVAALHNYMTFHAVVPPPRTILNGVRKLPPATLRVYERDGSFEDRRYWDPPYRRQAGDAAISREEWQEQLLDALRIAVKRRMVADVPVGVLLSGGVDSSLIVGLLAEAGQRGLMSFSVGFEEANGEKGDEFVYSDLIAGHFGTDHRKIFVPSADLMGALPGTIAAMSEPMVSYDNVGFYLLSKEVSKHVKVVQSGQGADEVFGGYHWYPPLMNSNDVVADYGKAFRDRSHAVLTTQLSDAWIADHDVSGDLLNEHLLREGAATPVDQALRLDSNVMLVDDPVKRVDNMTMAWGLEARVPFLDHELVELAARMPPEEKLRDGGKGILKDVARRVIPSEVIDRKKGYFPVPQLKYIAGPYLDLIRDTLRSQKARERGLFQDAYLDRLFQEPSDHITPLRGSELWQVGLLEMWLEAQGV

SEQ ID NO: 4370 - protein, 675 aa, Haemophilus somnus
MKLPQQLRYLLCLLFGFVLSLNYAVAVEPKLKLTDLVIPQITQENQLATKRTAARLVHSHYQAVELNDEFSQRIFDRYLKALDFNRNTFLQSDIDNMRATYADKIDDVLNEGKLDIAFNMYELLMKRRYERYRYALSLLDEEPDLNGNDQIEIDREKADWPKNETEANKLWEHRVKNDVINLKLKGKKWPEIQTRLVKRYNLAIQHLSKVKSDDIVQLYLNAFAREIDPHTSYLAPRTAKNFNENMNLSLEGIGATLQSEDGETTIKSLVPGAPADRSKKLKAGDKIIGVGQATGEIEDVVGWRIDDVVDKIKGKKGTKVRLEIEPAKGGKSQIITLVRDRVRLEDQAAKLTVETVAGNKIAMIKIPGFYNGLTEDVRKLLAEVEAKKAEALIIDLRGNGGGSLPEAIELTGLFITDGPVVQVRDAHQRIRIYDDPDTEQVYSGPLLVMIDRFSASASEIFSAAMQDYNRAIILGQNTFGKGTVQQSRSLNFVYDSNSMAPLGLLQYTIQKFYRINGGSTQLKGVAPDIIFPSSIDDEEYGEEKEDNALPWDKIPSASYSEVGNARLPVDILNQKHLERIAKDPEFIALDEDLKIRDERKKRKFLSLNFAQRKAENDKDDEKRLKDLNARFKREGKKPLKDLEALPKDYEDPDFYLKEAQKIAVDLIEFNKKMAE

SEQ ID NO: 4371 - protein, 281 aa, Unknown
  Frankia sp. CcI3
MVLSPVPTVPLAHGARMPRLGLGTWPLNDREVQGVVEQALGLGYRLIDTAHNYGNEKGVGAGLRAAGVPREELFVTTKFNKRSHSVRGVRRAAVESTRRMGLDYLDLLLIHWPNPWRDRYVEAWKGLVELLKDGQVRAIGVSNFKTTHLDRLLAQTGVAPDVNQIQLDPRLGRSAIRAYHAEQGIVTEAWSPLGAGTGLLDEPVITRIAAAHERTPAQVALRWHIELGIVVVPKSASPRRMAENIDVFDFTLSAEEIAAISGLDRGAAGEADALDSDVFGH

SEQ ID NO: 4372 - protein, 198 aa, Poranthera corymbosa
VRFLFMKNKARMICDCLATPVEVIQDKRLAQPLSLGGSTLRSPHGCHAQYMANMGSIGSLVMAVTINEDDDEIDNDQLRGRKLWGLVVCHHTSARFVPFLLRYACEFLIQVFGVQINKEVELAAQMKEKHILQTQTVLCDMLLRDAPVGIITQSPNVMDLVKSDGAALYYRKKFWLIGVTPTEAQIRDVADWLLQYHS

SEQ ID NO: 4373 - protein, 416 aa, Streptococcus pyogenes
MVYNMEYEVYETMKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISMSLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 4374 - protein, 221 aa, Pseudolachnostylis maprouneifolia
LNLKIPLMKNKVRMICDCLAPPVKVIQDKRLPQPLSLCGSTLRSPHGCHSQYMANMGSIASLVMSVTINEDDNEMDSDQERGIKLWGLVVCHHTSPRFVPFPLRYACEFLIQVFGVQISKEVQLAAESREKHILQTQTVLCDMLLRDAPVAIITQSPNVMDLVKCDGAALYYRKKFWLLGITPTEAQIKYIADWLLEYHGESTGLSTDSLMEAGYPGATIL

SEQ ID NO: 4375 - protein, 210 aa, Haemophilus somnus
MNIEIVPVTAFQQNCSIIWDNNKSAAIIDPGGEATKLIKRIEELGLNLELILLTHGHIDHVGAALKLKQYFNVEIWGSNEKDDFLFNSLPQQSEQFGLLFETEVFKPDRWLNQEYEIVRIGEMNFEVLHLPGHTPGHVGFIEYSKKIAFTGDVLFQNSIGRTDFPRGNHTELIQSIRDKLWKLDDDMIIISGHGNYTTIGKEKKYNPYIR

SEQ ID NO: 4376 - protein, 92 aa, Kluyveromyces lactis
ARPAFVNKLWSMVNDKSNEKFIHWSTSGESIVVPNRERFVQEVLPKYFKHSNFASFVRQLNMYGWHKVQDVKSGSMLSNNDSRWEFENERHA

SEQ ID NO: 4377 - protein, 704 aa, Rhodobacter sphaeroides
MTAAAQPSGLPGLATAPGRPWPLGASFDGEGVNFALFSAHAEKVELCLFAPDGRREALRLPLTERDGDIWHLKVNGLLPGQLYGYRVHGPYQPEQGHRFNPNKLLIDPYARKLEGRLRWSDAVMGYRVGSARADLSFDGRDSAFAVPKSVVVGHNFNWGPDAPPERALTETLIYEAHVKGLTALHPGVEDGLRGTFLGLASDPILEHLTRLGVTAVELLPVQAFLDDRFLVNRGLSNYWGYQTVGFFAPDPRYLAKGALWEFAAMVRRFHAAGIEVILDVVYNHTGESDELGPTLSFRGIDNRSYYRLTEGGRRYANMTGTGNTLDLSHPMVLRMVMDSLRYWVEVMHVDGFRFDLASTLGREEDAFDEQGAFFDAIRQDPVLTRVKLIAEPWDLGPGGYRLGGFPHPFLEWNDKFRDDVRRFWRGEGGMTGDLARRLLGSAERFDHHSRAATSSVNFVTAHDGFTLLDLVSHARKHNEANGEDNRDGHDDNHSDNMGLEGPTTDAGILAARALRRRNLLATLFLSQGTPMLLGGDEIGNGQGGNNNAYAQDNPIGWIDWDRPDETMLAFVARISELRRSLPVLRQKGFLHGRIREADGLRDVVWRLPDGREPGPQDWHSPAMSCLCVEIRMDADRPDAGESPVFAVFNAGEAVPLALPPVPESWSLVLDTTRPEAGPEPAAPGLEAPARSVLVFVPAPPGETG

SEQ ID NO: 4378 - protein, 154 aa, Lycopersicon esculentum
MSLIPRIFGDRRSSSMFDPFSIDVFDPFRELGFPSTNSGESSAFANTRIDWKETPEAHVFKVDLPGLKKEEVKVEVEEDRVLQISGERNVEKEDKNDKWHRMERSSGKFMRRFRLPENAKMDQVKASMENGVLTVTVPKEEVKKPEVKSIEISG

SEQ ID NO: 4379 - protein, 543 aa, Lactobacillus gasseri
MAKDIKFSENARRSLLKGVDKLADTVKTTLGPKGRNVVLEKSYGAPDITNDGVTIAKSIDLKDHFENMGAKLVSEAAQKTNDIAGDGTTTATVLTQAIVREGMKNVTAGANPVGIRRGIETATKAAVDELHKISHKVSTKDEIAQVASVSSASTEVGNLIADAMEKVGHDGVITIEESKGIDTELSVVEGMQFDRGYLSQYMVTDNDKMEADLDNPYILITDKKISNIQDILPLLQEIVQQGKSLLIIADDVDGEALPTLVLNKIRGTFNVVAVKAPGFGDRRKAMLEDIAILTGGTVISSDLGLELKDTKIDQLGKAGKVTVTKDSTTIVEGAGSKDAISERVDQIKKQIADTTSDFDREKLQERLAKLAGGVAVIKVGAATETELKERKYRIEDALNATRAAVEEGYVAGGGTALVDVMKSIQGNVKGDSQDAQTGVNIVMKALGAPVRQIAENAGKDGAVILDHLEHEDPEIGYNAATDKWENMVKAGIIDPTKVTRSALQNAASIAALLLTTEAVVADAPEDDKNQAPAAPNPGMGMGM

SEQ ID NO: 4380 - protein, 485 aa, Oenococcus oeni
MTETTKSGLRKDFLWGGAVAANQLEGAWDVDGKGVSVSDIMTAGAYQKPREITDGIIAGKNYPNHEAIDFYHHYKDDIKMFAEMGFKCFRTSIAWTRIFPNGDETEPNEAGLKFYDDMFDECLKYGIEPVITLSHFEMPYHLVTEYGGWRNRKVIDFFVKFATVCFKRYKDKVKYWMTFNEINNQTTFTNDFSIATDSGLIFRNKESEAEREALMYQASHYEVVASALAVKIGHKINPDFEIGNMVNFTPVYPASSDPKDILLAEKAMQRRYWWADVQALGEYPVGMEAYFKNHDLRPDITAEDRVVLREGTVDYVGFSYYNSMTVKYSDDNPEFKFVGDREAVKNPNLKYNDWGWPVDPVGLRYSMNWLTEHYHKPVMIVENGFGAYDKVESDGSIHDDYRVDYLRAHVKQMITAVNEDGVDLMGYTPWGCIDLVSAGTGQMSKRYGFIYVDKDDEGNGTLERSKKDSFYWYQKVIRSNGLDLD

SEQ ID NO: 4381 - protein, 687 aa, Candida glabrata
MGNTSSKTKTSIKKKGKKLSNVAVPPALSKSDTTQSTKSVRSQSSRHSDVSRPTHSRKSSIHNFGASSEALNTEEPPLASTNDTRKGTENMSANNSISNNIGGLSNSGGNNTEGNNYLTAGTSMNNARRASSSRRSSYNHGELPPSMIQIEPKPPILRNSKTLSSANSFAYDENALTDDDENNNSISNNNDNSIVHTFGRDRNLSATEFQRTSSMSSSSRMRRKSDNSGIDRGDTPIGKSSLHRTNSMASSLLSRKSSFGSNGNTEYSTPLHSPAAVLDGNRGDYFGAQPGENNNLDTIGGNRDKLAELNNDKYRKSSMSSNQSGHSKLQIDAYPSISSDVAIAEAQTEIGIDTKKKKPVKPIDIDETIQKLLDAGYAAKRTKNVCLKNSEIAQICQKAREIFLAQPALLELSPSVKIVGDVHGQYGDLLRLFTKCGFPPMANYLFLGDYVDRGKQSLETILLLLCYKIKYPENFFLLRGNHECANVTRVYGFYDECKRRCNIKTWKTFIDTFNTLPLAAIVTGKIFCVHGGLSPVLNSMDEIRHVSRPTDVPDFGLINDLLWSDPTDSPNEWEDNERGVSYCYNKVAINKFLNKFGFDLVCRAHMVVEDGYEFFNDRSLVTVFSAPNYCGEFDNWGAVMSVSEGLMCSFELLDPLDSAALKQVMKKGRQERKLAAQQQHQQQLQQD

SEQ ID NO: 4382 - protein, 220 aa, Sauropus androgynus
INLKIPVLKNKVRMICDCQAPPVKVVQDKRLAQPLSLCGSTMRSPHGCHAQYMANMGTIASLVMSVTINEEDEETVNDQQIGRKLWGLVVCHHTNPRFVPFPLRYACEFLMQVFGVQVNREVELAAQTTEKHILQTQTVLCDMLLRDAPVAIVTQSPNVMDLVKCDGAALYYRKKFWMLGVTPTETQIKDITEWLLEYHGESTGLSTDSLMEAGYPGAAI

SEQ ID NO: 4383 - protein, 1239 aa, Ustilago maydis
MSSSQRPVVQPIPPFKGAPLQATDVQNRRPTAAEAYVALANRKAGANVVSTRATGCENHRPSQHQPTSHHASQRQQPAPAADRRVQQSQPSERPKPASRLEREKKRHHNDPKNIGHWRLDKLIGQGASGRVRLAIHDQTGQKAAVKIIPRTLINASRMSLRDADVKANKMILGIEREIVIMKLIEHPNLLGLWDVYETSKDLFLIMEYVAGGELFDHLVAQGKLSPRDARGYFRQIIFGMDYCHRFNICHRDLKPENLLLDETKKIVKVADFGMAALQPTEKMLETSCGSPHYASPEIVSGKRYKGTASDIWSCGIILFALLCGRLPFDDPNIQQLLGKVRAGKFIMPEWLEPASKDLIWRMLEVDPEKRIKMADIMRHPWFTNNGTESSVNPVSTSLDSLQMEELTLDTIDIDILGNLKTLWFELSEQDIIKELLAPGPSWQKTFYTLLVAHRENHSADDEDDMNDDILDEQIVTASAVPAHALLSTTSAAKTLEKPRPRRTSDAAGATSAPASPRLESVEMDRRHSTPEKGSVYHTTSRRPDNVTPPKVASPHVRPANPSPRLRPSPLDSPASTLDSAFVSASKLKVASPTKPRALGSSHGADKSGYVLPQISLQTASPQRNERPAVDLQRRNTSPTKPNTVGVTAPLSARIALANMYDAPTLSHTATASCGSTSSTASSTVSVSAARNRANRGSGSEMMPPLALPGRASSRPVSPTKSTFGAQATLPPQTAPQPAPPRPSTSRAYTTQPTPCIQVPQVGDATMQRFFQEIADELASIRATGEKPDALQSKLDQLKNSMAWQQQQQQQQLQSQPMAVTASAPSARTRNSEMNQFEDAEDDVSEGESMRSVSQASSHQQTYTPSTPMTPLSPVELIAPLALTDKSGAGARSSVASSSASASARNSVRSARSGTEASSSGTTSRPTSVFSNISTGSTGLGRKRSLLGLRRADKHAQQQHATATEANTIRSIAYESTPTPTALASVFAAPASGRFVPNGGATTASSVRMQRLNPGLGLDIGASSAAGIISPPSTPQSPNTATLSPAPAASASAIASASAPGKKDSWFAGLFNWKPATFTLMSSENFSETLTECIRRLQSYGVRVAMDDSSDVHHTTLKCSINEYRESNGVVTAAKPLRFRVDVHILAVGSPATNSAYMGGGLGLSLHGGAVGTNVNATSIMTHGLPSPALSTYSRASTPGGVTFATSVLVVQEKGALSTFKLIHARLRREWMLDLGSAII

SEQ ID NO: 4384 - protein, 595 aa, Pseudomonas putida
MCGLAGELRFTPIDQAPRPADLAAVERITHHLAPRGPDAWGFHSQGPIALGHRRLKIMDLSDGSAQPMVDNTLGLSLAFNGAIYNFPELREELQALGYSFWSDGDTEVLLKGYHAWGAALLPKLNGMFALAIWERDNQRLFLARDRLGVKPLYLSRNGERLRFASTLPALLKGGDIDPMLDPVALNHYLNFHAVVPAPRTLLANVQKLEPGTWMRIDRHGEVERQVWWQLHYGPHPDERELDLEGWTTRVLDATRDAVAIRQRAAVDVGVLLSGGVDSSLLVGLLREVGVDDLSTFSIGFEDAGGERGDEFQYSDLIAKHYGTRHHQLRIAEHEIIDQLPAAFRAMSEPMVSHDCIAFYLLSREVAKHCKGVQSGQGADELFAGYHWYPQVDGADDAYAAYREAFFDRSHAEYRDTVQAPWLLETDAAGDFVREHFARPGAPAAVDKALRLDSTVMLVDDPVKRVDNMTMAWGLEARTPFLDYRLVELSARIPARFKLPDGGKQVLKQAARRVIPHEVIDRKKGYFPVPGLKHLEGATLGWVRELLTDPSQDRGLFNPTMLDRLLSNPHGQLTPLRGSKLWQLAALNLWLSEQGI

SEQ ID NO: 4385 - protein, 221 aa, Thecacoris madagascariensis
  misc_feature (220)..(220): Xaa can be any naturally occurring amino acid
YTSSSRFLFMKNKVRMICDCRATPVKVIQDNKLAEPLNFCGSTLRSPHGCHAQYMENMGSIASLVMAVTINEDDDEIENDQSKGSKLWGLVVCHHTDPRFVPFPLRYACDFLIQVFGVQVNKEIQLVAQTREKHILQTQTVLCDMLLRDAPVAIITQSPNVMDLVKCDGAALYYRKKFWLLGVTPTEEQIKDIAEWLLEYHGESTGLNIDTLMEAGYPGXS

SEQ ID NO: 4386 - protein, 382 aa, Arabidopsis thaliana
MNRRQQVKRRVGKYEVGRTIGEGTFAKVKFARNSETGEPVALKILDKEKVLKHKMAEQIRREIATMKLIKHPNVVQLYEVMASKTKIFIILEYVTGGELFDKIVNDGRMKEDEARRYFQQLIHAVDYCHSRGVYHRDLKPENLLLDSYGNLKISDFGLSALSQQVRDDGLLHTSCGTPNYVAPEVLNDRGYDGATADMWSCGVVLYVLLAGYLPFDDSNLMNLYKKISSGEFNCPPWLSLGAMKLITRILDPNPMTRVTPQEVFEDEWFKKDYKPPVFEERDDSNMDDIDAVFKDSEEHLVTEKREEQPAAINAFEIISMSRGLNLENLFDPEQEFKRETRITLRGGANEIIEKIEEAAKPLGFDVQKKNYKVSENSVTEMK

SEQ ID NO: 4387 - protein, 164 aa, Triticum aestivum
MEGRMFGLETPLMTALQHLLDVPDGEAGGPGNAAGEKQGPTPTRAYVRDARAMAATPADVKELPGAYAFVVDMPGLGSGDIKVQVEDERVLVISGERRREEKEDAKYLRMERRMGKLMRKFVLPENADMEKISAVCRDGVLTVTVEKLPPPEPKKPKTIQVQVA

SEQ ID NO: 4388 - protein, 245 aa, Akebia trifoliata
MCILITDFPNRSSNNSPQRKMGRGKIEIKRIENTTNRQVTFCKRRNGLLKKAYELSVLCDAEVALVVFSNRGRLYEYSNNSVKTTIERYKKACVDSSNSGSVSEANAQFYQQESLKLRQQIGNLQNLNRHLMGEALGSMSIKELKQLETRIEKGISRIRSKKNELLFAEIEYMQKREIDLQNDNMYLRAKIAENERAGQHMNLMPGNEYEVMSSAPFDSRNFLQVNLLEPNNHYSHTDQTALQLG

SEQ ID NO: 4389 - protein, 442 aa, Nicotiana tabacum
MATSVSTIGAVNKTPLSLNNSVAGTSVPSTAFFGKTLKKVYGKGVSSPKVTNKSLRIVAEQIDVDPKKQTDSDRWKGLVQDFSDDQQDITRGKGMVDSLFQAPTGTGTHHAVLQSYEYVSQGLRQYNLDNKLDGFYIAPAFMDKLVVHITKNFLKLPNIKVPLILGIWGGKGQGKSFQCELVFRKMGINPIMMSAGELESGNAGEPAKLIRQRYREAAEIIRKGNMCCLFINDLDAGAGRMGGTTQYTVNNQMVNATLMNIADNPTNVQLPGMYNKQENARVPIIVTGNDFSTLYAPLIRDGRMEKFYWAPTREDRIGVCTGIFRTDNVPAEDVVKIVDNFPGQSIDFFGALRARVYDDEVRKWVSGTGIEKIGDKLLNSFDGPPTFEQPKMTIEKLLEYGNMLVQEQENVKRVQLADKYLKEAALGDANADAINNGSFFAS

SEQ ID NO: 4390 - protein, 154 aa, Lycopersicon esculentum
MSLIPRIFGDRRSSSMFDPFSIDVFDPFRELGFPSTNSGESSAFANTRIDWKETPEAHVFKVDLPGLKKEEVKEEVEEDRVLQISGERNVEKEDKNDKWHRMERSSGKFMRRFRLPENAKMDQVKASMENGVLTVTVPKEEVKKPEVKPIEISG

SEQ ID NO: 4391 - protein, 154 aa, Lycopersicon esculentum
MSLIPRIFGDRRSSSMFDPFSIDVFDPFRELGFPGTNSGESSAFANTRIDWKETPEAHVFKADLPGLKKEEVKVEVEEDRVLQISGERNVEKEDKNDKWHRVERSSGKFMRRFRLPENAKMDQVKASMENGVLTVTVPKEEVKKPEVKSIEISG

SEQ ID NO: 4392 - protein, 130 aa, Triticum aestivum
  misc_feature (54)..(54): Xaa can be any naturally occurring amino acid
  misc_feature (71)..(71): Xaa can be any naturally occurring amino acid
  misc_feature (79)..(79): Xaa can be any naturally occurring amino acid
  misc_feature (105)..(105): Xaa can be any naturally occurring amino acid
  misc_feature (111)..(111): Xaa can be any naturally occurring amino acid
  misc_feature (117)..(117): Xaa can be any naturally occurring amino acid
  misc_feature (125)..(125): Xaa can be any naturally occurring amino acid
RVKDPKVSLDFYSRVMGMSLLKRLDFPEMKFSLYFLGYEDLSAAPADPVQRTGXGTFGQKATIDSLNNWGXTESDPGIXKGTIMGIKPSLGSGHIRVTGDMSYKXSNVSKXLGVNFXEEPNYWKXKDPSR

SEQ ID NO: 4393 - protein, 441 aa, Arabidopsis thaliana
MANDYISFVFKSLLLLIHLVFLGQHHVDSASVVKSLPGFEGPLPFELETGYIGVGEEEEVQLFYYFIKSERNPKEDPLLLWLTGGPGCSAISGLLYENGPLTMKLDVYNGTLPSLVSTTYSWTKNSSMIFLDQPVGTGFSYSRTELFNKPSDTGEAKRIHEFLQKWLGKHQEFSSNPFYVGGDSYSGITVPATVQEISKGNYQCCKPPINLQGYMLGNPITDSKIDGNSQIPYAHGMALISDELYESLKRICKGEYEHVDPYNTECLKLLEEFNECTSKLYRSHILYPLCEMTNPDCYIYRYSLSHYWVNDETVRKALQINKESIREWKRCDWSKPYTKDIISSVPYHMNNSINGYRSLIFSGDHDFEVPLIGTQVWIKSLNYAIVDKWRPWMINNQVAGYTRTYANKMTFATVKGGGHTAEYKPDETFIMFQRWINGQAL

SEQ ID NO: 4394 - protein, 372 aa, Oryza sativa
MLRRWFCCTQFHAPYREHENEFPDIPEEKEDLNLFVNIWLAGNGFAPKSDDPTKAPPPIEVPELSFDELKEKTDNFGSKALVGEGSYGRVYYATLDNGKQVAVKKLDASTEPEVDNDFLTQVSIVSRLRHENFVEMLGYCVEGNQRLVAYEFATMGSLHDILHGRKGVPGAQPGPALDWMQRVRIAIDAAKGLEYLHEKVQPSIVHRDIRSSNVLLFEDYKAKIADFNPSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPPPPPAVAPET

SEQ ID NO: 4395 - protein, 430 aa, Mycobacterium avium
MDSDGTIGGVTTHQLPVHSSAHHRQQRTFAQSSKLQDVLYEIRGPVHQHAARLEAEGHRILKLNIGNPAPFGFEAPDVIMRDMIQALPYAQGYSDSQGILPARRAVVTRYELVDGFPRFDVDDVYLGNGVSELITMTLQALLDNGDEVLIPSPDYPLWTASTSLAGGTPVHYLCDETQGWQPDIADLESKITERTKALVVINPNNPTGAVYSGEILSQMVDLARKHELLLLADEIYDKILYDDAKHINVASLAPDMLCLTFNGLSKAYRVAGYRAGWLAITGPKDHAGSFIEGINLLANMRLCPNVPAQHAIQVALGGHQSIEDLVLPGGRLLEQRDVAWSKLNEIPGVSCVKPAGALYAFPRLDPEVYDITDDEQLVLDLLLQEKILVTHGTGFNWPAPDHLRIVTLPWARDLAAAIERLGNFLVGYRQ

SEQ ID NO: 4396 - protein, 375 aa, Bacillus cereus
MTSSNNKAASIYEGTNINAWGSFENIEETKLFDPIQIGSWSLRNRIAMAPMTRCFANHETGVVGADVVEYYRKRAADGVGFIITEGIVISPRAKGNPGVPGIYTQEQIDSWKPVTEAVHKEGGTIIAQIWHVGRMSHHEIIGGKMPQAPSAIAAEGNVPRFRKPFDTPEAMTLEEIQEVISQYAQAAKNAIEAGFDGVEIHGAHGYLIDQFTYEFANKRTDKYGGDLKQRLTFMKEVTEAVIEAVGADKTLLRFSAFKGDNPTYMWENPELAIETFVNMFKEVGLTMIHPSTMNYTQVIADGKNFHQLVRKYWDATIVGVGNLNPKEAEEALQEGTIDVAAFGRPLIANPDFVHRIKHAESLVEYDAKEHLATLI

SEQ ID NO: 4397 - protein, 256 aa, Thiobacillus denitrificans
MLTLIPLPAFEDNYIWVWHDAKYAVAVDPGDPAVLSTYLDSRGLALAAVLVTHHHRDHTGGNTWLRQRYNCAIYAPDNPRIPAVSHVVRGGDSVAVPELGLALAVLATPGHTLDHVSYVGNGHLFCGDTLFGCGCGKLFEGDAAMMSASLDALAALPPTTRVCCAHEYTLSNIDFAKTIDGANPALLERERIDRAARAQNRPTLPSTLALERTTNPFLRFHDADMRAFAVGELGSPDPGPATVFGAIRAAKDRWDG

SEQ ID NO: 4398 - protein, 139 aa, Nicotiana tabacum
LDIFDPFEGFPFSGTVANVPSSARETSAFANARIDWKETPDSHIFKMDVPGIKKEEVKVEVEEGRVLQISGERSREQEEKNDTWHRMERSSGKFMRRFRLPENAKMEEIKAAMENGVLTVTVPKEEEKKSEVKAIDISG

SEQ ID NO: 4399 - protein, 269 aa, Brassica napus
  misc_feature (104)..(104): Xaa can be any naturally occurring amino acid
  misc_feature (110)..(110): Xaa can be any naturally occurring amino acid
  misc_feature (119)..(119): Xaa can be any naturally occurring amino acid
  misc_feature (144)..(144): Xaa can be any naturally occurring amino acid
  misc_feature (156)..(156): Xaa can be any naturally occurring amino acid
PFCLYTFQNKKLILDRLSVHTVIARLSDQSSKIYQYTAQTQKKRKTVPPPHSLISCHVDRRTVIPVVTTDFTGTFTFIAARCLLKLPSFTNKFFGNCEGHIFKXVVDNGXLTYFVEGDXAGRLIPKAFLERVKDDFNKRYGGGXAATAQANSLNKXEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIVLSVCGGFNCGK

SEQ ID NO: 4400 - protein, 706 aa, Fusarium oxysporum
MAPRGFEDEELTISLSSSHVRRPQQQQQQQSQQQQQHASSDAPTPGSRPADAPLKERIKTEQRIGAYKVLRTLGEGSFGKVKLAIHNGTGQQVALKIIARKKLISRDMAGRVEREIEYLQLLRHPHIIKLYTPNEIIMVLEYAGGELFDYIVQHGRMKEPEARRFFQQMLCAVEYCHRHKIVHRDLKPENLLLDENLNVKIADFGLSNIMTDGNFLKTSCGSPNYAAPEVIGGKLYAGPEVDVWSCGVILYVLLVGRLPFDDEHIPSLFAKIAKGTYSIPQWMPAGAANLIKKMLVVNPVHRATIEDIRADPWFTTDLPAYLQLPVEEFFNTGVDPNKAIKKNDIAPNASEKVQERLHNEVTEKISKTMGYGKSDVEEALQAAEPAAIKDAYMIVRENKMMQVNHNPEALLAEPEGSSPMLSMSSARSTTSQATTTPRPYVSKVGILPSSLPAYHKDYMEREKAGSVENSPPKVLINDEPPSNRTDAEKEETARRLRPHSRSQLRMDEANTRPQGMTPINPPKKNKPVRWQFGIRSRNSPWEALLCIHKALHKLGATYIPDEDYESRTAEERAEASGEGSFADSHDNNRGSSSSIDPKKRYNLPADPWHINVRWDTSAIKKKAASVPGTPSSPSTPEGQHHPKEPFVALHMDIQIYEMEHGVYLVDFKCSGYETAHGRLLEEKDVTSPFPFLDMAAKLIMQLAEAD

SEQ ID NO: 4401 - protein, 137 aa, Nicotiana tabacum
IFDPFEGFPFSGTVANVPSSARETSAFANARIDWKETPDSHIFKMDVPGIKKEEVKVEVEEGRVLQISGERSREQEEKNDTWHRMERSSGKFMRRFRLPENAKMEEIKAAMENGVLTVTVPKEEEKKPEVKAIDISG

SEQ ID NO: 4402 - protein, 487 aa, Streptomyces avermitilis
MTQAPQKAPYTTNNVGIPVESDEHSLTVGPDGPILLQDHYLIEKMAQFNRERVPERVVHAKGSGAYGFFEVTNDVSQFTKADLFQPGKRTEMLARFSTVAGEQGSPDTWRDPRGFALKFYTEHGNYDMVGNNTPVFFVRDTIKFQDFIRSQKRHPVTGLRSNDMQWDFWTLSPESAHQVTWLMGDRGIPKTYRHMNGYSSHTYMWINGAGERFWVKYHFKTDQGIDFLTQAEADELAGSDADKHRRDLFESIESGNAPTWTLKVQIMPFEDAADYRFNPFDLTKVWPHGDYPLIDVGRMVLNKNPEDYFIHIEQAAFEPSNLVPGIGPSPDKMLLGRLFSYPDTHRYRIGPNYAQLPPNRPHAPVNSYAKDGPMRYVPSNAARPYAPNSYGGPAADYGQFGDPASWETAGELVREATKPHREDDDWGQPGTMVRQVLDDAARDRLVSNVSGHLKADVSRPVLDRAVQYWRNIDKEIGDRIASNVNGG

SEQ ID NO: 4403 - protein, 617 aa, Zea mays
  misc_feature (62)..(62): Xaa can be any naturally occurring amino acid
  misc_feature (85)..(85): Xaa can be any naturally occurring amino acid
  misc_feature (103)..(103): Xaa can be any naturally occurring amino acid
  misc_feature (156)..(156): Xaa can be any naturally occurring amino acid
  misc_feature (402)..(402): Xaa can be any naturally occurring amino acid
ITMDPTKFRPSSSHDTTVTTTNAGAPVWNDNEALTVGPRGPILLEDYHLIEKVAHFARERIXPERVVHARGASAKGFFECTHDVXPSLTCADFLRAPGVRTPXVIVRFLDGDPRERGSPGDDPRTPRGVPPVKVLPPARGNWGTCLGKQTFPVFFXIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMEPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEXVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKANIVGVHTAAFCHPQAAAPQAPRRRPAAAAAASTHGAVASINRQRALRTPAIREKSSIHGVIGCNSPRDPRYLHCPRDPRSLHCHRDAASPSPPPVADFADLHARRGFRLPQAP

SEQ ID NO: 4404 - protein, 144 aa, Glycine max
  misc_feature (62)..(62): Xaa can be any naturally occurring amino acid
  misc_feature (94)..(94): Xaa can be any naturally occurring amino acid
  misc_feature (107)..(107): Xaa can be any naturally occurring amino acid
FAFLISYDNPGILAGLGCSASSQAKRGRGLELSRIQAHRGPDWSQLHQYGDHYLAHHRLAIXDPAHGEHPLFNADYTESVPVNGEIYNHEELMXQLPNDTFQTGCDXDVIAHLHEEHGDYYMDMLDGIFSAALLDSRDSMHIVA

SEQ ID NO: 4405 - protein, 384 aa, Unknown
  Burkholderia sp. 383
MTQQFASLFQPFTFPNGITLRNRVLMAPMTTWSSNPDGTVSDQELAYYRRRVNGVGAVLTGCTHVTENGIGFTDEFAAHDDRYTPSLRALAQAAKSGGAPAILQIFHAGNKAVPALVPDGELVSASAMKAPPGPFNNGELESRALTHDEIGEMIRAFGETTRRAIEAGFDGIELHGAHGFLIQNFFSPRFNQRADAWGGSLENRMRFPLALVAEIRRVIAQHADRPFLLGYRISPEEPDAGGLRVDDALTLIDRLIVAGIDYIHVSLADLLDAKPLDATDERRTIERVVAAVQQRVPVIAAGQIRTPAQAEAALALGLSVVAVGKGLVMNPAWVEQAMRGEAAAIRTQLHPVDVPQLVIPDKLWGVIDAMKGWFPVHRDEPAVA

SEQ ID NO: 4406 - protein, 357 aa, Oryza sativa
MTSRTSPGGRVSSTPFSRLPRAVLSSYEYLSQGLRTYDFDNTMGGFYIAPAFMDKLVVHISKNFMTLPNIKVPLILGIWGGKGQGKSFQCELVFAKMGINPIMMSAGELESGNAGEPAKLIRQRYREAADIIKKGKMCCLFINDLDAGAGRMGGTTQYTVNNQMVNATLMNIADNPTNVQLPGMYNKEDNPRVPIIVTGNDFSTLYAPLIRDGRMEKFYWAPTRDDRVGVCKGIFRTDNVPDEDIVKIVDSFPGQSIDFFGALRARVYDDEVRKWVSDTGVENIGKRLVNSREGPPEFEQPKMTIEKLMEYGYMLVKEQENVKRVQLAEQYLSEAALGDANSDAMKTGSFYGSAPSS

SEQ ID NO: 4407 - protein, 432 aa, Sulfolobus tokodaii
MDCIFIFRRDLRLEDNTGLNYALSECDRVIPVFIADPRQLINNPYKSEFAVSFMINSLLELDDELRKKGSRLNVFFGEAEKVVSRFFNKVDAIYVNEDYTPFSISRDEKIRKVCEENGIEFKAYEDYLLTPKSLFHHRNFTSFYNEVSKVKVREPETMEGSFDVTDSSMNVDFLLTFKKIESPLFRGGRREGLYLLHRNVDFRRRDYPAENNNYRLSPHLKFGTISMREAYYTQKGKEEFVRELYWRDFFTLLAYYNPHVFGHCYRREYDNISWENNESYFEAWKEGRTGYPIIDAGMRMLNSTGYINGRVRMLVAFFLVKVLFVDWRWGERYFATKLVDYDPAINNGNWQWIASTGVDYMFRVFNPWKQQEKFDPEAKFIKEWVEELKDVPPSIIHSIYKTKVPGYPSPIVNWLERVNYVKSEYKNVKAVL

SEQ ID NO: 4408 - protein, 654 aa, Prochlorococcus marinus
MCGIAGLICKDRQILALDEIGSKMNTSLLNRGPDDSGIWIDNDIGILLSHTRLSVNDLSKAGHQPMLSSSNRFVLTFNGEIYNHWDLRQELEITQGSQNWKSHSDTETLIQAIECWGVYKTLTKLIGMFAFGIFDRKENKFYLARDRFGEKPIYWGITGVGTRKVLIFGSDLKALKSYPEFNNTINRESMGLFINYNYVPDPHSIYENIWKLEAGKILEIDVTDDDYSKIYPMSWWQLEDTIKNVDGREIENESEAINLLKQELIKSVKSQSKADVKITSFLSGGIDSSLVSALLQETSNSQINTFTIGFENKRFDEATYARRISNYLGSNHSELIFTNEDALNIVPKINEYYSEPFADPAAIPTLLLCNAAKSQGYTVALSGDGADELFGGYNRYTMAPKIWKYFGIIPNFMKPMLINSVNKLSTQSIDLIGSILKIRQFRERLYKITDKISYSNSLEDLYYRLIREWSDVSSITEYKYNQPFTPISNERLNQSIHELKLDPVTFMMVIDCLSYLPGNNQVKLDRASMAVGLETRSPFLDKNVGELIWRLPINLKIKNNCGKYILKEILADYIPKKLFERPKAGFATPINEWIKGPLREWAEEMLNSNKVRDEGFLNPEITTKLLNEHIQGVKDNSKKLWSALIWESWIDKNI

SEQ ID NO: 4409 - protein, 489 aa, Triticum aestivum
  misc_feature (311)..(311): Xaa can be any naturally occurring amino acid
  misc_feature (481)..(481): Xaa can be any naturally occurring amino acid
MVISHASSSAGEAVYSTFSSRYVREELPRYRMPEGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKLLNDLLVEKNKKTGWNVPIHVDAASGGFIAPFLQPELEWDFRLPLVKSINVSGHKYGLVYPGVGWVIWRSKDDLPDELIFHINYLGTDXQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIVAELDAHAVHAIKLSNAAAAEGASKSTVDAVTEAFKGLAXGNKKAGVC

SEQ ID NO: 4410 - protein, 336 aa, Pseudomonas putida
MSRVTLSRYLIEQTRSNNTPADLRFLIEVVARACKEISHHVSKGALGGVLGSMGTENVQGEVQKKLDVISNDILLEANEWGGHLAGMASEEMDNAYQIPGRYPKGAYLLVFDPLDGSSNIDVNVSVGTIFSVLRCPNQYLSQNESLNEEAFLQPGTEQVAAGYAIYGPQTMLILTLGNGVKGFTLDRELGSFVLTHENIRVPETTAEFAINMSNQRHWEAPVQRYVGELLAGETGPLKKNYNMRWIASMVADVHRILTRGGLFMYPRDAREPSKPGKLRLMYEANPMSFIIEQAGGASTNGYDRILDIKPESLHQRVSVILGSKEEVERVTAYHKE

SEQ ID NO: 4411 - protein, 431 aa, Arabidopsis thaliana
  misc_feature (142)..(142): Xaa can be any naturally occurring amino acid
MSLTLEFLLLLIVLILSHHAHSGSIVKFLPGFEGPLPFELETGYIGIGEEEEVQLFYYFIKSEKNPEEDPLLLWLSGGPGCSSLTGLLFENGPVALKFEVYNGSVPSLVSTTYSWTKVKMANIIFLDQPVGSGFSYSRTPLXKISDTGEVKRIYEFLQKWLSKHQQFFSNPFYVGGDSYSGMIVPPLVQEIGKGNYQINLQGYILGNPITDTESEQNYQIPYAHGMALISDELYKSMERICKGNYVKVDSLNTKCYKLIKDYQKCIHKLNKYHILLPDCDITSPDCFLYRYTLITFWANNKSVREALQVNKGSIGKWVQCNYKNISYNYDIKSSVAYHMKNSIDGYRSLIYNGDHDMMVPFLATQAWIRSLNYSITDDWKPWMINDQIAGYTRSYSNKMTFATIKGSGHTAEYKPKETSIMFKRWISAQPL

SEQ ID NO: 4412 - protein, 476 aa, Magnaporthe grisea
MSLPKDFLWGFATASYQIEGAIDKDGRGPSIWDTFTAIPGKVADGSSGVTACDSYNRTQEDIDLLKSVGAQSYRFSISWSRIIPIGGRNDPINQKGIDHYVKFVDDLLEAGITPLITLFHWDLPDGLDKRYGGLLNREEFPLDFEHYARVMFKAIPKCKHWITFNEPWCSSILAYSVGQFAPGRCSDRSKSPVGDSSREPWIVGHNLLVAHGRAVKVYREEFKAQDKGEIGITLNGDATFPWDPEDPRDVDAANRKIEFAISWFADPIYFGEYPVSMRKQLGDRLPTFTEEEKALVKGSNDFYGMNCYTANYIRHKEGEPAEDDYLGNLEQLFYNKAGECIGPETQSPWLRPNAQGFRELLVWLSKRYNYPKILVTENGTSVKGENDMPLEKILEDDFRVQYYDDYVKALAKAYSEDGVNVRGYSAWSLMDNFEWAEGYETRFGVTFVDYENGQKRYPKKSAKAMKPLFDSLIEKD

SEQ ID NO: 4413 - protein, 250 aa, Arabidopsis thaliana
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYENLQRQQRNLLGEDLGPLNSKELEQLERQLDGSLKQVRCIKTQYMLDQLSDLQGKEHILLDANRALSMKLEDMIGVRHHHIGGGWEGGDQQNIAYGHPQAHSQGLYQSLECDPTLQIGYSHPVCSEQMAVTVQGQSQQGNGYIPGWML

SEQ ID NO: 4414 - protein, 339 aa, Colletotrichum gloeosporioides
MVVSQPEVDFAREKDRLAEAQPQGQRAASSHDDAAPPPIGMTEPDERRGTRSRHDHSGKRDKVVRFGDYILGNTIGEGEFGKVKLGRKQDGGVQVIPVAVKLIKRDSVGNNPSRLAKIYREIAILRGISHPNIVRLHEMVETERHIGIILEYASGGELFDYILNHRYLKDNAARRLFAQLVSGVGYLHKKGIVHRDLKLENLLLDRNRNIIITDFGFANTFDGTRKGDLMQTSCGSPCYAAPELVVSDSLYTGRKVDVWSCGVILVSTAARYAMLAGYLPFDDDPANPEGDNINLLYKIVNTPLTFPEYVTPTPVTYSAASRSQSPQASGSLRGGRTAG

SEQ ID NO: 4415 - protein, 372 aa, Arabidopsis thaliana
MENGEAKQSVPLLTPYKMGRFNLSHRVVLAPLTRQRSYGNVPQPHAAIYYSQRTTPGGFLITEATGVSDTAQGYQDTPGIWTKEHVEAWKPIVDAVHAKGGIFFCQIWHVGRVSNSGFQPNGKAPISCSDKPLMPQIRSNGIDEALFTPPRRLGIEEIPGIVNDFRLAARNAMEAGFDGVEIHRANGYLIDQFMKDTVNDRTDEYGGSLQNRCKFPLEIVDAVAKEIGPDRVGIRLSPFADYMESGDTNPGALGLYMAESLNKYGILYCHVIEARMKTMGEVHACPHTLMPMRKAFKGTFISAGGFTREDGNEAVSKGRTDLVAYGRWFLANPDLPKRFQVDAPLNKYDRPTFYTSDPVVGYTDYPFLESTA

SEQ ID NO: 4416 - protein, 364 aa, Candida glabrata
MSSQYVVFQGPENFRHRIIFATLSGKPIKIEKIRSQDLNPGLRDHEVSFLRLMEAVTNGSVIEISYTGTTVIYRPGIIIGGPYTHTCPPSKPVGYFVEPMLYLAPFSKKKFSIVFKGITASHNDAGIEAIKWGLMPVMEKFGVRECALHTLKRGSPPQGGGEVHLVVDSLIAQPITMHELDRPVISSIRGVAYSTRVSPSMVNRMIDGAKQVLKNVKCEVNITADVWRGENSGKSPGWGITIVAETKKKGWCYFAEEIGGSGDIPEEIGSKVAYKLIEEISKSAAVDRNQLPLAITYMVIGKEDIGRLRITREQVDERFIQMLRDIKKIFGTEVFLKPVDDIGSDDFIATVKGIGFTNTNKKIA

SEQ ID NO: 4417 - protein, 434 aa, Oryza sativa
MESRGKILMERYELGRLLGKGTFGKVHYARNLESNQSVAIKMMDKQQILKVGLSEQIRREITTMRLVAHKNIVQLHEVMATRNKIYFVMEYVKGGELFEKVAKRGKLTEVVAHKYFQQLISAVDYCHSRGVYHRDLKPENLLLDENENLKVSDFGLSALSESKRQDGLLHTTCGTPAYVAPEVISKIGYDGAKSDIWSCGVILFVLVAGYLPFQGPNLMEMYRKIQHGEFRCPGWFSRKLQKLLYKIMDPNPSTRISIQKIKESTWFRKGPEENRILKERTLNENTTKNVAPVLGVRRKKNAHEDVKPMSVPNLNALEIISFSKGFDLSGMFIVKEWRNEARFTSDKSASTIISKLEDVAKALNLRVRKKDNGVVKMQGRKEGRNGVLQFDIEIFEVTTSYHIIEMKQTSGDSLEYRQLLEEGIRPALKDIVLA

SEQ ID NO: 4418 - protein, 199 aa, Sesamum indicum
MATLGGVHDSNSNPDTHSLARFAVDQHNTKENGLLELVRVVEAREQVVAGTLHHLVLEVLDAGKKKLYEAKIWVKPWMDFKQLQEFKHVRDVPSFTSSDLGAKTDDQVSGWRPVPVHDPVVQDAAHHAIKTIQERSNSLFPYELSEVVHANAEVVDTSAKFDMLLKVKRGGKEEKYKVEVHKSTEEGGFNLKKVDLDHS

SEQ ID NO: 4419 - protein, 769 aa, Xanthomonas oryzae
MTAQTGGLRAWCIAATLAALTAALAACLQWSSLQGPWRAITAVAAVLAVVCGICAAAAAYRAAPAQHALAQRLEEAERARERLQQELQRHGELEQELLRAKQAAEAAMLAKGEFLATMSHEIRTPLNGIIPMLELISSGQLSLDQRDMLQTATSSSLQLLRIVDDILDYSKLEANKLELEITTFNLRELLDGVVQLLQRTAEGRQLRLSLDIEPSVRLLVRGDPIRLRQVLGNLIGNAIKFTERGSVDIQLRRLGETRAQHLLRFQVRDTGIGIAPDQQTRLFRSFAQADASTTRLYGGTGLGLAICKRIIDLMGGRIGVESEPGRGSTFWFEIPLLKVIGDLQQATRADAVRVMVISSDARLSQRLKRLLDSWGVSHVLMETTQEALERVRRHSDTEGFRCVIADHDTLRYSARAVHRALARPENANSARLIWLYGEEPVPAELRDHATLVPRQSPDETLRPLVLPPDPKPVPTATLASAMIPEPLPPPMANAREVRILLVEDNPVNLLVAQKLLAVLGFEADTATDGETALTRMESIRYDMVFMDCQMPVLDGYAATRRWRAMETESGSRPLPIVAMTANAMACDHERCLAAGMDDYLSKPVAREQLDACLQRWLPRQALLPGPSTAGQFTHDPESASAGAQACALPILDNSVIDELYEVAGADTITILQLFLEDAPPIIEQLEAAAANRDSMQLRDLAHTLKSSSANVGAQAVSNAARRIELAARTGTIERPSAMVALVIAEYARARLALLGQVARLQAAASTPNP

SEQ ID NO: 4420 - protein, 364 aa, Ustilago maydis
MASSNPQTVPCAYKTGRTLGQGTYAVVKEAVHIKTGQYYACKVISKKLMEGREHMVRNEIQALKRVSQGHRSIVTLVDYFETMNNLYLVTDLCVGGELFDRICERGNYYEKDAAHIVRTIVDAVVYLHDQGIVHRDLKPENLLFRDKTEESDLLIADFGLSRVVDDEKITVLSTTCGTPGYMAPEIFKKTGHGKPVDMWAIGVITYFLLCGYTPFDRDTTMEEMQAIINADYRFEPTQYWEDVSEDAKDFINKLLTIDPAKRLSAKEALQHRWLQEAAPTEGGAQPVASAEQKDLLPDIKSAFNAKRTFRKAVNGIRLINRLRTNEQQPNKEEIEKLRQTIREAEDESSNLDQVLLAQETRAAN

SEQ ID NO: 4421 - protein, 254 aa, Ipomoea batatas
MRVRFFFYFAYFLITLVFFPSVTLQSYSGGHRQEATGFCGEEGEREDNLIRMATTTLGGISDSASAENSVEIESLARFAVEEHNKKENAMIELVRVVKAEEQVVAGKLHHLTLEVIDAGKRKLYEAKVWLKPWMNFKELQGFNHIEDIPTLTSSDLGAKRDWPNTGLKSVPVNDPVVQEAAQHAVKTIQQRSNSLLPYELQEIVHANAEVIDDSAKVHMLIKTKRGEKEEKFSVEVPKNNEGAFFLNHMAPANS

SEQ ID NO: 4422 - protein, 488 aa, Candida glabrata
MDVERQTFKVFNQDFTIDKRFELIKEIGHGAYGIVCSARFTEASEETTVAIKKVTNIFSKTLLCKRSLRELKLLRHFRGHKNITCLYDMDIVFYPDGSINGLYLYEELMECDMHQIIKSGQALTDAHYQSFTYQILCGLKYIHSADVLHRDLKPGNLLVNADCQLKICDFGLARGYSENPEENNQFLTEYVATRWYRAPEIMLSYQGYTKAIDIWSTGCILAEFLGGKPLFKGKDYVDQLNRILQVLGTPPDETLRRVGSKNVQDYIHQLGYIQKIPFSELFPNANEDALDLLEGMLAFDPQKRITVDKALEHPYLTIWHDPADEPECNEKFEFSFESVNEMEDLKRMVVDEVQSFREFVRQPLMDDKSQEDEQQQGSPENYQQTSPTNISPQRLHNNGSHDLLQEPEFLTQTPNQNSTIPDQLQESFVGIHSDNLPEHDTDFPPRPQENILASPMGLPSASDRNSMNNDSFLDLERELEFGLDRRYL

SEQ ID NO: 4423 - protein, 137 aa, Nicotiana tabacum
IWDPFEGFPFSGTVANIPTSTRETAAFSSARIDWKETPESHVFKVDLPGIKKEEVKVEVEEGRVLQISGERSREQEEKNDKWHSMERSSGKFLRRFRLPENIKMEEIKATMENGVLTVTVPKMEEKKPEVKAIDISG

SEQ ID NO: 4424 - protein, 219 aa, Arabidopsis thaliana
MAQQSLIYSFVARGTVILVEFTDFKGNFTSIAAQCLQKLPSSNNKFTYNCDGHTFNYLVEDGFTYCVVAVDSAGRQIPMSFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIIALILIIVLSVCHGFKC

SEQ ID NO: 4425 - protein, 196 aa, Arabidopsis thaliana
MASEARESPANNPGLSTNRDEATKGYIMQQTMFRIKDPKASLDFYSRVLGMSVMGSYILRYSRLLKRLDFSEMKFSLYFLGYEDTTTAPTDPTERTVWTFGQPATIELTHNWGTESDPEFKGYHNGNSEPRGFGHIGVTVDDVHKACERFEELGVEFAKKPNDGKMKNIAFIKDPDGYWIEIFDLKTIGTTTVNAA

SEQ ID NO: 4426 - protein, 433 aa, Crocosphaera watsonii
MVNYKKGLVLGATAAVLTAIAVTGAGLRLPRSVAYLQDNPKKLVDEVWQVINDTYVDATFNQVDWLAVRQKYVGKSKTYNSKEEAYKAIREMLEQLDDPYTRFMDPQEFQNMQIDTSGELTGVGIQITKDEETKELTVVAPIEDTPAFEAGILAKDVITKINGKTTEGMEVEDAVKLIRGKPGSKVTLTIRRSNEEFNYPIIRARIELHPVKARIEETPSGKVGYIRLTQFSAQASKEMRDAIRDAEAANVNGYILDLRSNPGGLLYSSIEIARMWLDQGRIVSTVSRNGEVEAQRATNRALTDKPLVIMVDGGSASASEILSGALQDNNRATLVGTKTFGKGLVQSVRRLGDGTSGLAVTIAKYLTPSGRDINKQGIEPDIVVELTEAQRKDLQQERDKIGDFGDPQFDRAYEELEKEIAKSNGTNARGTMR

SEQ ID NO: 4427 - protein, 458 aa, Myxococcus xanthus
MTGSSQPWRAALTAFFLLSAPWAHAAEPLRKDAGTAGRAEQAERDDATYRQLEVFARVLSYVENNYVESPDRQRLMYGAIQGMLETLDPHTVFLPPDVYREMKIDTSGEWGGLGIEIARKGERIVVVAPIDDTPAARAGIKAGDELVGIDGERTEGMDVGRALQKMRGPAGGRVLLTIMREGFSAPREIAIIRDHIRIVSVEGALHGGIGHVKVKNFQDRTDLYLRKELDRLRALNGGKELRGLVLDLRNNPGGLLDQAVAVSDRFLPGNLPIVSTRGRDGRSATVERSKDRDTEKDYPVVVLVNAGSASASEIVAGALQDHGRATILGAPTFGKGSVQTVIELEDGSGLKLTIARYYTPKGRSIQERGITPDFLVPDEPGGKVPRDVVREKDLRRHFRAEPTAATEPAAPEPRGLPENLKPWDVTAKLEDYALRVALDYLHGMASAPARTPSRAAGR

SEQ ID NO: 4428 - protein, 248 aa, Populus tremuloides
MGRGRVQLKRIENKINRQVTFSKRRTGLLKKAHEISVLCDAEVALIVFSHKGKLFEYSTDDCMEEILERYERYSYAERQLVATDLDSQGDWTLEYNRLKAKVELLQRNHRNYVGEDLDSMSLKELQNLEQQIETALKHIRARKNHLMSQSISEMQRKEKAIQVQNNMLVKQIKEKEKKDKAVAQPAFWDQQNHGPDASSFLLSQPAGLPLPCLNIGGSYQEEAPEARRNGLGHTLEPIYSFHLGGYGA

SEQ ID NO: 4429 - protein, 150 aa, Brassica napus
MTNYGSIPTSSHPSPPIDLEYISRAKHRIKSGLATRRPWKTMFDLQSTNLPHGFFDAISRIKTNLVYFRANYAVVVLLVLFLSLVYHPTSLLVLAVLVVFWIFLYFLRDEPLVVFRHQIDDRTVMICLSVLTIVMLLFTHATANVLGAVA

SEQ ID NO: 4430 - protein, 503 aa, Triticum aestivum
METGGKDGNPLKNYRIGKTLGIGSFGKVKIAEHIKTGHKVAVKILNRRKIKNMEMEEKVKREIKILRLFMHPHIIRLYEVIEAPADIYVVMEYVKSGELFDYIVEKGRLQEEEARRFFQQIISGVQYCHRNMVVHRDLKPENLLLDNNCDVKIADFGLSNVMRDGHFLKTSCGSPNYAAPEVISGKLYAGPEVDVWSCGVILYALLCGTLPFDDENIPNLFKKIKGGIYTLPSHLSGPARDLIPRMLVVDPMKRITIREIREHPWFEAQLPRYLAVPPPDTAQQVKKIDEESLVKVISLGFDKNLLVESIHNRLQNEATVAYYLFLDNKSRTTTGYLGAGYQEAMESSFSPITPSETQSPAHGNRQQPYMESPVGLRPHFPADRKWALGLQSRAHPREVMTEVLKALQELNVYWKKIGHYNMKCRWSPPGFPGQENMNHTNYNFSAEPIETDDLGDKLNLIKFELQLYKTRDEKYLLDLQRASGPHLLFLDLCAAFLAQLRVF

SEQ ID NO: 4431 - protein, 375 aa, Staphylococcus aureus
MKSKYEPLFDKVELPNGVELRNRFVLAPLTHISSNDDGTISDVELPYIEKRSQDVGITINAASNVSDVGKAFPGQPSIAHDSDIEGLKRLATAMKKNGAKALVQIHHGGAQALPELTPGGDVVAPSPISLKSFGQKQEHSAREMTNEEIEQAIKDFGEATRRAIEAGFDGVEIHGANHYLIHQFVSPYYNRRNDVWANQYKFPVAVIEEVLKAKEAYGNKDFIVGYRLSPEEAESPGITMEITEELVNKISHMPIDYIHVSMMDTHATTREGKYAGQERLPLIHKWINGRMPLIGIGSIFTADEALDAVENVGVDLVAIGRELLLDYQFVEKIKDGREDEIINYFDPEREDNHHLTPNLWHQFNEGFYPLPRKDK

SEQ ID NO: 4432 - protein, 591 aa, Zea mays
MCGILAVLGVAEVSLAKRSRIIELSRRLRHRGPDWSGLHCHEDCYLAHQRLAIIDPTSGDQPLYNEDKTVVVTVNGEIYNHEELKAKLKTHEFQTGSDCEVIAHLYEEYGEEFVDMLDGMFSFVLLDTRDKSFIAARDAIGICPLYMGWGLDGSVWFSSEMKALSDDCERFITFPPGHLYSSKTGGLRRWYNPPWFSETVPSTPYNALFLREMFEKAVIKRLMTDVPFGVLLSGGLDSSLVASVASRHLNETKVDRQWGNKLHTFCIGLKGSPDLKAAREVADYLSTVHHEFHFTVQEGIDALEEVIYHIETYDVTTIRASTPMFLMSRKIKSLGVKMVISGEGSDEIFGGYLYFHKAPNKKEFHEETCRKIKALHLYDCLRANKATSAWGVEARVPFLDKSFISVAMDIDPEWKMIKRDLGRIEKWVIRNAFDDDERPYLPKHILYRQKEQFSDGVGYSWIDGLKDHASQHVSDSMMMNAGFVYPENTPTTKEGYYYRMIFEKFFPKPAARSTVPGGPSVACSTAKAVEWDASWSKNLDPSGRAALGVHDAAYEDTAGKTPASADPVSDKGLRPAIGESLGTPVASATAV

SEQ ID NO: 4433 - protein, 546 aa, Rhodopseudomonas palustris
MAAKDVKFDTDARDRMLRGVNILADAVKVTLGPKGRNVVIDKSFGAPRITKDGVSVAKEIELSDKFENMGAQMVKEVASRTNDEAGDGTTTATVLAQAIIKEGLKAVAAGMNPMDLKRGIDLATAKVVESIKAASRPVNDQHEVAQVGTISANGEAQIGRFIADAMQKVGNEGVITVEENKGLETEVEVVEGMQFDRGYLSPYFVTNADKMTAELEDVFILLHEKKLSSLQPMVPLLESVIQAQRPLLIVAEDVEGEALATLVVNKLRGGLKIAAVKAPGFGDRRKAMLQDIAILTGGQVISEDLGMKLENVTIDMLGRAKKVSINKDNTTIVDGAGEKAEIEARVSQIRTQIEETTSDYDREKLQERVAKLAGGVAVIRVGGMTEVEVKERKDRVDDALNATRAAVQEGIVVGGGVALIQAGKVLDGLTGENPDQNAGITIVRRALEAPLRQIAQNAGVDGSVVAGKVRESDDKAFGFNAQTEEYGDMFKFGVIDPAKVVRTALEDAASVASLLITTEAMIADKPEPKSAPAGGMGGMGGMDGMM

SEQ ID NO: 4434 - protein, 317 aa, Arabidopsis thaliana
  misc_feature (230)..(230): Xaa can be any naturally occurring amino acid
LKQIQFVDMCDPTRDDGSSRSRVVSTMQKRAYFQRQWPLVDVVRASVVVIVHFLCLLAPFNFKWEALRFGLVLFALTTLSITFSFHRNLSHRSFKIPKWLEYPWAYSAVFALQGDPMDWVSIHRFHHQFTDSDRDPHSPKEGLLFSHILWIFDTQYIKYKCGGRDNVLDLKKQWFYKFLRRTIAVHILMFWTILYLYGGLPYLTCGGGVGIFIGYHVTWLVNSACHIWGXSRSWNTKDTSRNGFDDLVNIFRWLSLFTMGESWHNNHHAFESSARQGLEWWQIDITWYLIRLFEVLGIATDVKLPSELQKQKMALVR

SEQ ID NO: 4435 - protein, 324 aa, Candida tropicalis
MSTTPTIPTIKLNSGYEMPLVGFGCWKVNNETAADQIYNAIKTGYRLFDGAEDYGNEKEVGEGINRAIKEGLVKREELFITSKLWNNFHDPKNVETALNKTLSDLNLDYVDLFLIHFPIAFKFVPIEEKYPPGFYCGDGDNFHYEDVPLLDTWKALEKLVEAGKIKSIGISNFTGALIYDLIRGATIKPAVLQIEHHPYLQQPKLIEYVQKAGIAITGYSSFGPQSFLELESKRALNTPTLFEHETIKSIADKHGKSPAQVLLRWATQRNIAVIPKSNNPERLAQNLSVVDFDLTKDDLDNIAKLDIGLRFNDPWDWDNIPIFV

SEQ ID NO: 4436 - protein, 325 aa, Magnaporthe grisea
MADQHDVDLDSIIDRLLEVRGSRPGKQVQLLEAEIRYLCTKAREIFISQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLNSMEQIRRVMRPTDIPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPAEKKQKYVQRLGGRSSNASSRITSSKP

SEQ ID NO: 4437 - protein, 532 aa, Ralstonia eutropha
MRKTLKNISLVSVGLVAGVLATLQISATAQNSAGPLPLDQLRLMADIFGQIKREYVEPVDDKKLLTEAIKGMVASLDPHSAYLDEKDFKELQEGTRGRFAGLGIEISQEEGLVKVINPIEDTPAFRAGIQPGDLITRIDDKPVRGLPLEQAVKRMRGEPGTKVTLTIYRKSEERTFPISITRAEIRVQSVKTKMLDNNTIGWVRLTSFQERTVGDLGRRLNEMAQKNPGLKGIVLDLRNNGGGVLQGAVGVAAAFLPDDSTVVSTNGQVPDAKRVYKATFNNYRLSSLEDDPLKDLPALYKKIPMVVLTNAYSASASEIVAGALQDHHRALIMGKTTFGKGSVQTVRPLTNDTGIKLTIAYYYTPTGKSIQAKGIRPDIPVDQNPEGDPDDALITREIDTERHLHNKQESEEPEMNEREQRRVEELRRLEEENAKKTPEEREKERRKKPIEFGSADDFMLQQAIAQLDGRPVKRSKSKLETNPPADKPAKAAPAKKGASAPAAKPAAPAPGKQPPASAPIGEPLGTPTGKAP

SEQ ID NO: 4438 - protein, 196 aa, Brassica napus
  misc_feature (40)..(40): Xaa can be any naturally occurring amino acid
  misc_feature (50)..(50): Xaa can be any naturally occurring amino acid
  misc_feature (87)..(87): Xaa can be any naturally occurring amino acid
SGHGRKEVESTNKNVKKRKILEHNSIKHMSYESVSDISLXSCGYEEDVRXNMKLILGAVIIAVALVALSSTTKFPENRDFLIGCISXSYVVVNGVVELIVYSKEENAIVYTHPPEVSFTSTVLVVSSKLPRFSDEYTLTIDSADPKSISAGKSVQLTKSVTQWFTKDGVLVEGLLWKDVEALIKDYAKEGEPKKKK

SEQ ID NO: 4439 - protein, 349 aa, Zea mays
MSLGKTDMSQERLYHQDRMDVPPVHFSTPPPPPCQQQQQHGGHGEQQKLERFSDEVDSRLSAEQKEPASGGALVVSVSGGGDGASIELSKKRRGRPPGSKNKPKPPVVITREAEPAAAMRPHVIEIPCGCDVADALARFAARRNLGICVLAGTGAVANVSLRHPMPCGGGGAPTAIMLHGQYEVLSISATFLPPAMSAVAPQAAAAAACLSISLAGPHGQIVGGAVAGPLYAASTVVLVAAAFTNPTFHRLPADDDASVSVSVSVSLSAGSGDPADEHRGGHQDRREQPPQEHRPLAVRRQPAPHPASAAQTVEPCGPPDVPIYAACHPQPHDVMWPPPPRAPQMPPPY

SEQ ID NO: 4440 - protein, 374 aa, Petroselinum crispum
MESSSAATADHTHIKGVPTHGGRYVQYNVYGNLFEVSRKYVPPIRPVGRGAYGIVCAAMNSDTREEVAIKKIGNAFDNRIDAKRTLREIKLLRHMNHENVIAIKDIIRPPQIESFNDVYIVYELMDTDLHQIIRSNQQLTDDHCRYFLYQLLRGLKYVHSANVLHRDLKPSNLLLNANCDLKIGDFGLARTTSETDFMTEYVVTRWYRAPELLLNCSEYTAAIDIWSVGCILGEVMTRQPLFPGKDYVHQLRLITELIGSPDDASLGFLRSDNARRYVRQLPQYPKQQFSARFLNKSPGALDLLEKMLIFDPNRRITVDEALCHPYLAALHDINEEPVCPRPFSFDFEQPTCTEENIKELIWKESVKFNPDPIL

SEQ ID NO: 4441 - protein, 558 aa, Onion yellows
MCSIFGILNIKTDPQILRDQALKLSSLMRHRGPDWSRIFASQKAILAHERLSIIDVNAGAQPLYNKTKTLILAINGEIYNHLDLRKQYKDKYEFQKESDCEVILALYQEKGVNFLDELQGMFAFILYDLTKNTYLIGRDHMGIIPLYMGYYLNQNFYIASEMKALIPICQTLSIFPPGNYLYSESGKMVKYYKRNWMDYQNVYNNQTNTNQLRNFLEASVKKILMSDVPYGVLLSGGLDSSIISGITKKFAKHRIEESSKKEVCFPSLHSFAVGLKGAPDLKAAKEVDNHLGTAHHEINFTIQEGIDALKDVIYHIETYDITTIRASIPMYLMARKIKAMGIKMILSGEGADEIFGGYLYFHKAPNAQEFHKETVRKLASLHLYDCSRANKAMSAWGVEARVPFLDKNFLDVAMRLNPKDKMCGTNGKIEKHILRQTFESYLPKKIVWRQKEQFSDGVGYSWIDALKQLAQTKITDTQLKNAYVRFPYNTPTNKEGYMYREIFEILFPLPSAISLFPGGPSIACCTAKAIEWDKAFKQINDPSGRAALGVHNEAYKDK

SEQ ID NO: 4442 - protein, 279 aa, Bacillus licheniformis
MVSSLKDTVTLHNGVKMPWFGLGVFKVEEGSQVVESVKAAIKNGYRSIDTAAIYQNEEGVGKGIKESGVPREELFITSKVWNSDQGYEKTLAAFDESLRKLGLDYLDLYLIHWPGKDKYKDTWRALEKLYKDGRVKAIGVSNFNVHHLESLLEDAEIKPMVNQVEFHPRLTQTELRDYCKKQGIQVEAWSPLMQGKLLDDQVLTDIAKKYNKSVAQVILRWDLQNEVVTIPKSIKEHRIIENADIFDFELSAEDVEKINALNKDERVGPDPDTMVNGFE

SEQ ID NO: 4443 - protein, 250 aa, Methylobacillus flagellatus
MFEIIPILAFEDNYIWLLHQHGHALVVDPGDAHPVLEILDARGLQLRAILVTHHHQDHTGGVEELIQATSAQVFAPAKEQFSFPHHPVTAGDRLDIPGIALSLSVLDVPGHTVGHVAYYGDGMLFSGDTLFGAGCGRLFEGTPGQMYSSLQQLAQLPVNTRVYCGHEYTERNLAFALSLEPHHEALLSRREATAALRAQGLPSLPSSMALELATNPFLRCHEPGIIAASKSAATDPVSVFAAIREMRNHF

SEQ ID NO: 4444 - protein, 393 aa, Triticum aestivum
  misc_feature (43)..(43): Xaa can be any naturally occurring amino acid
  misc_feature (221)..(221): Xaa can be any naturally occurring amino acid
  misc_feature (292)..(292): Xaa can be any naturally occurring amino acid
  misc_feature (322)..(322): Xaa can be any naturally occurring amino acid
  misc_feature (369)..(369): Xaa can be any naturally occurring amino acid
QVCTKKQAGTGPEFPGYRRPTRPMRTMEMEEKAKREIKILRLXIHPHIIRLYEVIYTPTDIFVVMEYCKYGELFDCIVEKGRLQEDEARRIFQQIISGVEYCHRNMVAHRDLKPENLLLDSKYNVKLADFGLSNVMHDGHFLKTSCGSPNYAAPEVISGKLYAGPEVDVWSCGVILYALLCATRPVPFDDDNIPKLFNKIKGGFYILPSHLSALARDLIPXRMLVVDPMRRITIRDIRDHPWFQNRLPRFLAVPPPDTAQPAKMEIAEDTLQEVANLGYDKDHVCESLCNRXINEETVAYYLLLENRFRATSGYLGANYQQXNESASPSTRNYLPRSNDSQGSGLRPYYRVETKWALGLQSRAQPRAIXIEVLKALKELNVRWKKNVDYNMKC

SEQ ID NO: 4445 - protein, 376 aa, Vitis aestivalis
MGCFPCAGKSNKKGKKNQEKNSKDQIPSTSERLKVNSSVDGRKDASKDGGSDHIAAHTFTFRELAAATKNFRAECLLGEGGFGRVYKGRLESTNKIVAIKQLDRNGLQGNREFLVEVLMLSLLHHPNLVNLIGYCADGDQRLLVYEYMALGSLEDHLHDLPPDKKRLDWNTRMKIAAGAAKGLEYLHDKASPPVIYRDLKCSNILLGEGYHPKLSDFGLAKLGPVGDKTHVSTRVMGTYGYCAPEYAMTGQLTLKSDVYSFGVVLLEIITGRKAIDNSKAAGEHNLVAWARPLFKDRRKFSQMADPMLHGQYPLRGLYQALAVAAMCVQEQPNMRPLIADVVTALTYLASQKYDPETQPVQSSRMGSSTPRSRREL

SEQ ID NO: 4446 - protein, 139 aa, Nicotiana tabacum
LNIWDPFEGFPFSGTVANIPTSTRETAAFSSARIDWKETPESHVFKVDLPGIKKEEVKVEVEEGRVLQISGERSREQEEKNDKWHSMERSSGKFLRRFRLPENIKMEEIKATMENGVLTVTVPKMEEKKPEVKAIDISG

SEQ ID NO: 4447 - protein, 134 aa, Nicotiana tabacum
LDIWDPFEGFPFSGTVANVPTSAFANARIDWKETPEAHVFKVDLPGIKKEEVKVEVEEGRVLQISGERSREQVEKNDKWHRMERSSGKFLRRFRLPENTKMEEIKAAMENGVLTVTVPKMEEKKPDVKAIDISA

SEQ ID NO: 4448 - protein, 477 aa, Bacillus subtilis
MIHQHPESFPKHFLWGSASAAYQIEGAWNEDGKGPSVWDVFTKIPGKTFKGTNGEIAVDHYHRFKEDVALMAEMGLKAYRFSVSWPRVFPKGKGEINEAGLAFYDSLIDELLSHHIEPVLTLYHWDLPQALMDEYGGFESRNIIEDFNHYCITLYKRFGDRVKYWVTLNEQNYNFNHGFITAMHPPGVKDRKRFYEANHIAFLANAKAIESFREYVPEGKIGPSFAYSPAYPLSSHPEDILAFENAEEFTNNWWLDMYCWGTYPQIPFRCLEKQGWAPTIEAGDMDLLAKGKPDFVGVNYYQTITYERNPLDGVSEGKMNTTGQKGTNQETGIPGVFKTKKNPHLTTSNWDWTIDPIGLRIGLRRITSRYQLPVFITENGLGEFDKVEDGTVQDDYRIDYLRSHLEQCRQAISDGVDLIGYCSWSFTDLLSWLNGYQKRYGFVYVNRDEESTSDLKRLKKKSFYWYQDVIKTNGESL

SEQ ID NO: 4449 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVNARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 4450 - protein, 438 aa, Pseudomonas putida
MLHSPRLTQLALSIALAVGAPLATAAEPAKAAAVPATEVTAKAPLPLEELRTFAEVLDRIKAAYVEPVDDKTLLENAIKGMLSNLDPHSAYLGPEDFQELQESTSGEFGGLGIEVGQEDGFIKVVSPIDDTPASRAGVQAGDLIVKINGAPTRGQTMTEAVDKMRGKVGEKITLTLVRDGGNPFDVNLTRAVIQVKSVKSQLLENDYGYIRITQFQVKTGDEVGKALAKLRKDNGKKLRGVVLDLRNNPGGVLQSAVEVADHFLTKGLIVYTKGRIANSELRFSADPADASAGVPLVVLINGGSASASEIVAGALQDQKRAVLMGTDSFGKGSVQTVLPLANDRALKLTTALYYTPNGRSIQAQGIVPDIEVRPAKLTAEADTENFKEADLQGHLGNGNGGADRPTGSSKRKERPQDDDFQLSQALSLLKGLNITKGD

SEQ ID NO: 4451 - protein, 325 aa, Cryptococcus neoformans
MSLGRTLKLNNGVVAPQIGFGTWQAAPGEVEKAVEEAIKVGYRHIDCALIYRVFDATGVYGIVAQGIKASGVPRKDLFLVSKLWNNSHRPEKVEADLDTSLKQLGTDYLDVYLIHWPVPFAPGDNLFPKTEDGKVAIDWDGPSVVDTWKELIRISKETKKVKAIGVSNFNVELLEKLIKETGVVPTMNQIECHPSLIQPELFKYCKEKNIVITAYSPLGNNTTGKPRIIDQPQIIDIAKKLNKEPAQVLINWAAHQGFAVIPKSVTPSRIKSNFEDFKLNDDVFEEINKVGKANAARANIPAEYNPSWPINVFGEKSEEQYKKVW

SEQ ID NO: 4452 - protein, 222 aa, Canavalia lineata
MARQKIKIKKIDNVTARQVTFSKRRRGIFKKAEELSVLCDAEVGLIIFSATGKLFEYPSSSMKDIITKYNQHSHDNNQLGRPQNLQVEQCVDLSKEVAERNQQLRQMKGEDFQGLNLDDLQQLEKTLETGLERVNETKEKRIMDEIVALHKKGLKLEEENKHLKQKMAMLCMGKSSFLVDSDITLQEVVSSESMNVCSCNSGPSLEDDSSDTSLKLGLPFPN

SEQ ID NO: 4453 - protein, 659 aa, Kluyveromyces lactis
MGNSGSKPSKKASKSKKIESASSNGSKSRSSSKASEVSSKKDTSPQLQKSDTMQSNKSGRSIRSLKSRRSQSQLQSPSNPGTPKLSANNHETSLSRKNSSTLPLSRHGSSQSASKEDERNGQTLKTARSSSFSTTGDLPPSMVQMAPKTPILKGSTNNPLYYENALTDDDYDDNNDDSISYKSSSSRHRSSARRASSSSRRRSNGSAHHLEVPQSGNSISMVNHGNSTSGSPIQMSRSSSRSSTHSRKSSMSMGQYSTPMASPGLNAMDPDVQDYFDTAGASQREIDDGNGNDYRGVSNGGTDDHPEGLGNDVELNAEGKPKKKKPIKPIDIDETIQKLLDAGYSAKKTRSVALKNSEITQICQMAREIFLSQPSLLELSPPVKIVGDVHGQYADLLRLFTKCGFPPSANYLFLGDYVDRGKQSLETILLLLCYKIKYPENFFLLRGNHECANVTRVYGFYDECKRRCNIKTWKTFIDTFNALPLAAIVAGKIFCVHGGLSPVLNSMDEIRHVSRPTDVPDFGLINDLLWSDPTDSPNEWEDNERGVSYCYNKVAINKFLNKFGFDLVCRAHMVVEDGYEFFNDRSLVTVFSAPNYCGEFDNWGAVMSVSEGLLCSFELLEPLDSTALKQVMKKGRQERKLANQQQQQQQQQQLEQIQE

SEQ ID NO: 4454 - protein, 401 aa, Pichia angusta
MSQPSLTDTNLFKPIKVGNVELKHGFFSAPTTRFRASDDFVPTDSMLSYYEQRAENNGGLIVAEATFPDYSFGLYPNAPMIKTPEQVAAWKKIVDAVHKQGSFFSIQLWHLGRVAVPQLNKKYNVPLVGPSKLYVDESSEKAAKEAGNELHELTIPEIEAIVKEFAAGAKRVVDEAKADFVEILAGGGYLLDQFNHSNINKRTDKYGGSIENRARLILEVVDACIEAVGAEHVGIKLSPYAAVNGLQGVDTEIHPISRYGYILSELERRGKEGKRIAYITMIEPRVNGTEDSKDTRAFDSSWVGEIWKSTLLRAGAYLNQFSNYLIQDVNKDDRTLIGAARYFTSNPDLIERLRKGQELTPYDRSKFYTPATNDGYITWTKYGEDPEKYKGLVAVKPQPLS

SEQ ID NO: 4455 - protein, 402 aa, Pichia angusta
MTPSTSLASSNLFKPIKVGKVELKNRLVFAPTTRYRASKDFVPTDSMLKYYEQRAENNGGLLTAEATYVDFNFGLYPFTPMIKTPAQVAAWAKIIEAVHKQGSYFSIQLWHLGRAADPKFNKEKGVPFVAPSAIYLDQDSEKAAREAGNELRELTIPEIEAIVKEFAAAAKRAIHEAKADFIELHSAHGYLLDQFIQPNINKRTDKYGGSIENRARLVLEVVDACIEAVGAEHVGIRLSPYAKFQGSEGVDSEINPIASFGYILSELEKRARDGNRLAYVSVVEPRVSGNVDSNDQRKFDTSWIREIWKGILFRAGGYLKENEQSLEHDVNQDDRTLIGVSRYYTSNPDLVERLKKGLSLTPYDRSRFYNHSSNDGYLTWPKYGEDEEKYKAVLDVEPKALA

SEQ ID NO: 4456 - protein, 635 aa, Geobacillus kaustophilus
MCGFIGCIHDRPRAIEQTWKTTLVEMNRLITHRGPDDEGYFFDDYVSFGFRRLSIIDLEAGHQPLSYENDRYWIIFNGEIYNYLELREELAAKGYSFATHSDTEVIVALYSAEKEKAVEKLRGMFAFVIWDKQEKTVFAARDPFGIKPFFYAEQGDRTFFASEKKSILLALRQESPNGDSLQHYLTFQYVPEPLTMSAGIYKLEPGHYLKKKVGKPLTIHRYWKASFEPIRQSEEELVKKIRDALFDSVNVHMRSDVPVGAFLSGGIDSSFIVAIAKQFHPHLKTFSVGFEREGFSEIDVAKETAEKLGVDNISYVISPQEYMEELPKIMWHMDDPLADPAAVPLYFVAREARKHVTVVLSGEGADELFGGYNIYREPESLRLFARMPNIVKAVLRVIAKMLPDGMKGKSFLERGTTPLEERYVGNAKIYSEKEKAALLKTYQEGREYTAVTAPFYRETLHYPPVNRMQYIDLHTWLRGDILVKADKMTMAHSLELRVPFLDKKVFEVARQIAPDMKTANGTTKYILRKAAEGIVPDHVLNRKKLGFPVPIRHWLKNEMYDWARQLINESETDHLFHKDVLYRLLDEHARHKADHSRKLWTVLAFMVWHQVYVEKKYDFAQSVQNEKRPASVLEA

SEQ ID NO: 4457 - protein, 402 aa, Pichia angusta
MSKTPTLANTNLFKPIKVGKVELKNRLVFAPTTRYRASKDFVPTDSMLKYYEQRAENNGGLLVTEATYPDYSFGLYPDTPMIKTPAQVAGWKKVIEAVHNKGSFVSIQLWHLGRTASAEFNKSKGLPLVGASPIYMDEDSEKAAKEAGNELRALTIPEIENIVTEYAAAAKRAIHEAKADFIELHGAHGYLLDQFNQPGSNKRTDKYGGSIENRARLILEAVDACIEAVGAEHVAIRLSPYAAVQGIKGVDSEIHPISYFGYVLSELERRAQEGKRLAYISVVEPRVNGIYDSKDKREFNTSWISEIWKGVLLRSGAYLNENYKFLQHDVDENDRTLIGVSRYYTSNPDLADRLKNGHELTPYDRSKFYKHSSNDGYLTWTRYGEKEPQYKDLVDVAPEPLA

SEQ ID NO: 4458 - protein, 259 aa, Oryza sativa
MISPDAARNVVGIIGNVISFGLFLAPVPTFWRICKRKDVEEFKADPYLATLLNCMLWVFYGIPVVHPNSILVVTINGIGLLVEGTYLLIFFLYSPNKKRLRMCAVLGVELVFMLAVILGVLLGAHTHEKRSMIVGILCVFFGSIMYFSPLTIMGKVIKTKSVEYMPFFLSLVCFLNGVCWTAYALIRFDIYVTIPNGLGALFGAIQLILYACYYRTTPKKTKAAKDVEMPSVVVSGTGAAAAAGGGNTGGGSVSVTVER

SEQ ID NO: 4459 - protein, 683 aa, Pasteurella multocida
MKLSKTKSYLATFLLSTFLMSFNLVEAVQPKIKLSDIVTPQPTEENQLATKRATTRLTQSHYRKFQLNDAFSEKIFERYLKSLDFSRNTFLQSDIDEMRAKYADKFDDALNEGDLSIAFAMYDLMMKRRYDRYKYALSLLDKEPDLSGQDQIEIDREKSPWPKDNAELDKLWEQRVKNDIINQKLKDKKWSDIKKRLIKRYDLAIRRLTQTKADDILQVYLNAFAREVDPHTSYLAPRTAKSFNESMNLSLEGIGATLQQTEDDGTTIKSLVPGAPAERSKKLKAGDRIIGVGQASGEIEDVVGWRLEDIVDKIKGKKGTKVRLEIEPAKGGKSKIITLVRDKVRIEDQAAKLTISKVEGQIVASIKIPSFYIGLTQDVRKLLAEMKTKKAKALIIDLRDNGGGALTEAVGLSGLFISDGPIVQVRDAFQRIRVHEDPDSEQVYSGPLLVMINRFSASASEIFAAAMQDYNRGIIIGQNTFGKGTVQQSRSLNFAFDANQEPLGLIQYTIQKFYRIDGGSTQLKGVATDIDFPAAIDAKEYGEEREDNALPWDKIPAANYFEVAQARDAVAFLTPKHIERIAKDPEFVALNEELKIRDERNALKYLSLNYQKRKIENDKDDARRLKDLNARFKREGKKPLKDLDDLAKDYEAPDFYLKEAERMAADLVQFETEKMGMNQKSTN

SEQ ID NO: 4460 - protein, 190 aa, Marsilea quadrifolia
DEHGEVVAEIRKSDLEPYLGLHYPATDIPQASRFLFMKNRVRMICDCRSNPVRVIQDKNLRQPLSLAASTLRAPHGCHSQYMANMGSIASLVMAVIVNDNEEETSNRNQQPKMRKLWGLVVCHHTTPRAVPFQLRSACEFLMQVFGLQLNMELELAAQMREKHILRTQTLLCDMLLRDAPIGIVSESPNI

SEQ ID NO: 4461 - protein, 208 aa, Candida glabrata
MIARKKNILKVIILGDSGVGKTSLMHRYVNDKYSQQYKATIGADFLTKEVVLDDDKVVTMQVWDTAGQERFQSLGVAFYRGADCCVLVYDVTNAKSFENIKSWKDEFLVHANISSPESFPFVILGNKVDIEDSKKVVSEKAGQELAKSLGDVPLFLTSAKSAINVDTAFEEIAKSALQQNQNDAHAFEDDFNDAINIQLEGESNSCSC

SEQ ID NO: 4462 - protein, 138 aa, Nicotiana tabacum
DAWDPFEGWPLFRSISDQFRSNFPSSSSDTTSFDWKETPNAHVFKADVPGLRKEEVKVELEDDRILQISGERQRELEDKGNTRHRVERSSGKFVRRFRLPENAKVDQVKANMENGVLTVTVPKENANKPEMKSIDISG

SEQ ID NO: 4463 - protein, 464 aa, Escherichia coli
MKAFPETFLWGGATAANQVEGAWQEDGKGITTSDLQPHGVMGKMEPRILGKENIKDVAIDFYHRYPEDIALFAEMGFTCLRISIAWARIFPQGDEAEPNEAGLAFYERLFDEMAQAGIKPLVTLSHYEMPYGLVKNYGGWANRAVIDHFEHYARTVFTRYQHKVALWLTFNEINMSLHAPFTGVGLAEESGEAEVYQAIHHQLVASARAVKACHSLIPEAKIGNMLLGGLVYPLTCQPQDMLQAMEENRRWMFFGDVQARGQYPGYMQRFFRDHNITIEMTESDAEDLKHTVDFISFSYYMTGCVSHDESINKNAQGNILNMIPNPHLKSSEWGWQIDPVGLRVLLNKLWDRYQKPLFIVENGLGAKDSVEADGSIQDDYRIAYLNDHLVQVNEAIADGVDIMGYTSWGPIDLVSASHSQMSKRYGFIYVDRDDNGEGSLTRTRKKSFGWYAEVIKTRGLSLKK

SEQ ID NO: 4464 - protein, 153 aa, Bacillus cereus
MSEEKKDSSRPPVRNYLKQIDDFFEQTPLRNVIADLNHFFQKGNRLLTFPVDLYEVGEELVVTAELPGIQKEQIQIEIQNEYLKVSVKEEILEEEEQTSHNYYRRERSISEASRLIKLPYSINKKAAKASYQNGVLEIRAPKLPQQHDILSID

SEQ ID NO: 4465 - protein, 605 aa, Bacillus cereus
MIFHRGPDDEGYFRDEHVQFGFRRLSIIDLEAGHQPLTYENDRYVIIFNGEIYNYVELREMLLEKGATFATQSDTEVIIALYAHMKEKCVDYLRGMFAFMIWDREEKKLFGARDHFGIKPLYIAQQGDTTFFASEKKSIMHVMEDKGVNPTSLQHYFTYQYGPEPETLTIDVNKIEPGHYFVKEIGKEMEIHRYWKPYFNASSATKEEHIQAIRDVLYDSVKVHMRSDVPVGSFLSGGIDSSIIASIAREMNPNLLTFSVGFEQRGFSEVDVAKETAEKLGVKNHNVFISAKEFMDEFPKIIWHMDDPLADPAAVPLYFVAKEARKHVTVVLSGEGADELFGGYNIYREPNSLKMFSYIPSPGKSVLKALSGALKEGFKGKSFLERGCTPIEERYYGNAKIFREEEKAELMKYYNESVNYMDITKPLYNEIKDYDDVSKMQYIDMFTWLRGDILLKADKMTMANSLELRVPFLDKEVFDVASKIPTEFKIANGTTKAILREAARGIVPDHVLDRKKLGFPVPIRHWLKDEMHDWAINIINESKTEHLIDKQYVLNLLEAHCADKGDYSRKIWTVLAFMVWHQIYVEHKYDTNKFHEETKRAYSLV

SEQ ID NO: 4466 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVAARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 4467 - protein, 205 aa, Eucalyptus globulus
MGRGRVQLKRIENKINRQVTFSKRRCGLLKKAHEISVLCDADVALIVFSTKGKLFEYATDCCMERILERYERYSYAESQVLTNNAETNGNWTLEHAKLKARMEILQKNQKNLMGEELDSLSLKELQNLEHQLDTALKNIRSRKIQLMCESISELQRKDKALQEQNNMLAKKVKEKEKALAQQTQWDNPQDDGLTSSSGSLPSEWN

SEQ ID NO: 4468 - protein, 932 aa, Vibrio parahaemolyticus
MTRYGLRARVITLTLAPTLIIGLLLSGFFSFNRYQDLEKQVITTGNSIIEPLAIASESHLLAESREAVRRLISYAHRKNSKLVRSIAVFDEHHELFVTSNFHPNFEALMFPKDKPIPKLGNSEIYENSLILRVPILSEGHYLSELSNENQGTKAIGYIAVEMDLSSLRLQQYQEVFSAFLVLILGLGLASVFASRLMHDVTQPITHMKNVVDRIRRGHLDVRIEGKMHGELDQLKNGINAMAVSLSEYHVEMQHSIDQATSDLRETLEQLEIQNVELDIAKKRAQEAARVKSEFLANMSHELRTPLNGVIGFTRQMLKTQLSNSQTDYLQTIEKSANNLLNIINDILDFSKLEAGKLALENIPFDFRESLEEVINLQATSAHEKGLEITLKVDPKIPPGLVGDPLRIQQILTNLVGNSIKFTERGNIDVSVEMRSQAGDSVELQFMVRDTGIGISERQQAQLFQAFSQADASISRRYGGTGLGLVITQKLVSQMGGEISLTSRLHQGSTFWFTLRLNSTEMPMSDLIEVELLTGKQLLLVEPNMQAASVTQQILSQEGILVTYRSSLPENEEHYDYVLLNLAANQTYDEQSVAAWIEQAKRMAPSVIMGTPSTELALADQIMTEHQIQCLTKPLSRRKLLQSLINEHVEAPQAITAPVETEESERLPLTVLAVDDNPANLKLISALLKERVETVTACSNGQQAVNLATEKKYDLIFMDIQMPLMDGVTACQNIKELELNKDTPVIAVTAHAMAGERDRLLAAGMDDYLTKPIEEHVLQQVLVHWNPNTCTESIGKVAPSYVDEPESEAPATAENTQPDVIIDWQAALKQSANKEDLAKDMLRMLIDFIPEVEEVVDHALEQDDYSREELIHVIHKLHGSSSYCGVPRLKSLCATLEHALRSGASIEEIEPEMFELQDEMIKVTTTAKLYLEQ

SEQ ID NO: 4469 - protein, 132 aa, Triticum aestivum
  misc_feature (69)..(69): Xaa can be any naturally occurring amino acid
  misc_feature (102)..(102): Xaa can be any naturally occurring amino acid
MVSFEMNDLKKIGLGLTGFGVFFSFLGIVFFFDKGLIAMGNILFLSGLGLTIGLKSTMQFFTKPKNYKXFSRVLIGWPFFGMLLEAYGFIVLLSGYSGNSRXFLQRILLAGFSTTSLVPDVTETIRVIHSSS

SEQ ID NO: 4470 - protein, 466 aa, Shigella flexneri
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKQGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 4471 - protein, 440 aa, Rhodospirillum rubrum
MTWKTWISASAIAFTAFTAGQLYHTEQAEAARGEETYQLLDLFADVFERVKRDYVEEVGDDQLIEAAINGMLTSLDPHSSYLNAKHFEDMQVQTKGEFGGLGIEVTQEDGFIKVVSPIDETPAALAGLQPGDFITHLDGESVLGLSLADAVEKMRGPVGKEIRLTIQRVGKEPFDVTLKRDTIKIQSVKSRMEGDVGYVRITSFSEQTEKSLREALDDLRSKGGDSIKGYVLDLRNNPGGLLEQAIAVSDVFLDKGEIVSTRARDAKDTQRFNARPGDLTKGMPVVVLINSGSASASEIVAGALQDHHRALIVGTKSFGKGSVQTIMPLPGHGAMRLTTARYYTPSGRSIQALGIDPDIQVEPARIEAISAQNEMRSEAELRNALKNDTLKPSLGVKPANGLPPSQVRNDQTPQADTDYQLARAVDLIRGLAIYRSKSIQ

SEQ ID NO: 4472 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGANTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 4473 - protein, 524 aa, Arabidopsis thaliana
MDSFSYSSMKSMLIQARGSLNSRLSEFEPLVLLLVPLVSLFLAQIIGSVFGVVHEKGLKACLIGFIMGLLKMIPGVQNYIDAEKQKVVDQLQSGSSSKKKNKTEVLPVKGLGVEVLEKMENEKRNDAIWQGKCSGTVFAHTNPLHIDVFQSVVRFESEVVAMTAALLGSKETASGGQICGNMTSGGTESIVLAVKSSRDYMKYKKGITRPEMIIPESGHSAYDKAAQYFKIKLWRVPVDKDFRADVKATRRHINRNTIMIVGSAPGFPHGIIDPIEELGQLALSYGICFHVDLCLGGFVLPFARKLGYQIPPFDFSVQGVTSISVDVHKYGLAPKGTSTVLYRNHEIRKHQFVAVTEWSGGLYVSPTIAGSRPGSLVAGAWAAMMSLGEEGYLQNTSKIMEASKRLEEGVREIHELFVIGKPDMTIVAFGSKALDIFEVNDIMSSKGWHLNALQRPNSIHICITLQHVPVVDDFLRDLREAVETVKANPGPITGGLAPIYGAAGKMPDRGMVNELLVSFMDSQY

SEQ ID NO: 4474 - protein, 671 aa, Idiomarina loihiensis
MCGIAGVFHHQTERAIEPQTLVNMAAIMHHRGPDGFGYEVQQDYGVGFSHARLSIIDLDEKRGRQPFISADKRLMLTHNGEFYDFKRIRADLTARGARFNSKSDSEIVLHLFERYGLEDTLKELRGEFAFGLFDAKDESLYLVRDRFGIKPLYWTETEHGVVFGSELKVLFAHPDVKREFSAEGLYHQLIQVMVPGSTAFEGINQVQPGYVVKLQRKNGKVVATEHKYWDVDFPPEESYPGADVDEESYIEGVRAKLLEAVQHRMTADVPVGCYLSGGIDSCAILGLASASTQTSVKAFTIGFDSADYDETPIAEEMAAATKADHHIMRLKADDLYDHFVKTLWHTERTIYNTLGVAKYLMSKEVHEAGYKVVMTGEGSDELFAGYPAFRKDMFLHGLDHLPEVERVEWQELLEKNNKLFKGAMLAREEFVSEAFNQKMGFTPSCVQPWLSCSSVALPLMSENKRKQVEGYDPSLAIANTLDKDMLDGRHPLDRAQYVWIKTMLEGQILTWGGDRVDMANSMEARPAFLDHHLAEYAFTVPPHLRIKGNKEKYVLREAMKGLLPETLYKREKFAFMAPPAHTDPEKWKAVEKLAEQFLNAEAVKSAGLLDYDEVVRTFERHQDENVPNEERVQLDAVINHMLGVQVLHHHFVATDVPAQAQQRATELGWTA

SEQ ID NO: 4475 - protein, 373 aa, Sinorhizobium meliloti
MASLFDPITIGDISLSNRVVMAPLTRNRSPQAVPNDLNVAYYEQRASAGLLITEGTAISHQGQGYADVPGLYKPEALAGWRKVTDSVHKAGGKIVVQMWHVGRISHDSLQPQGGKPVAPSAIRAKSKTYLVNPDGTGSFAETSEPRALEPAEIAGIVEDYRKASRAAIEAGFDGVEIHAANGYLIDQFLRSGSNERTDAYGGSIENRARFLFEVVDAVTKEIGAGRVGIRISPVTPANDAFDPDPQPLFTYVVEGLARYPLAYVHVIEGATGGARDHQQGDRPFDYTSLRAAYAAAGGRAAWMTNNGYDRGLALKTVESGEADLVAFGKPFIANPDLVRRLRDNVALNAPDQATFYGGGAKGYTDYPSLENVA

SEQ ID NO: 4476 - protein, 370 aa, Photorhabdus luminescens
MRNIMLFERYSLNGLSLSNRIVMPPMTRSRAGTNGIATDLMAEYYAQRASAGLIISEGTQISQQGQGYAWTPGIYKPEQIIGWKKVTDAVHMAGGKIFAQLWHVGRVSHTILQPNNSEPVSPSALQAKGVKVFLDVAGRGPEHGIGEMVQHSQPRALTLDEIPDIVNDYVQAANNAIAAGFDGVELHAANGYLINQFIDSQTNLRDDEYGGTLQNRLRFLREVATSVASAIGKDKLGVRLAPLTTLMGSKDDTPEATYLAAASVLNDIGIAYIHIAEADWEDAPVMPVTFKEAFRLLYHGTLIYSGKYTLERAEEALTKGWADLIGFGRPFIANPDLPYRLANKLELNPPIKEKFFGGNMEGYTDYLAIN

SEQ ID NO: 4477 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGHNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 4478 - protein, 345 aa, Bacillus anthracis
MNSELFSPYTIKDVTLKNRIVMSPMCMYSSENEDGQVTNFHLIHYGTRAAGQVGLVMIEATAVLPEGRISNKDLGIWDDSLIEGLHKTTTFIHDNGAKAAIQLAHAGRKAELETDALAPSAVPFNETMKIPVEMSIHQIKNTILAFQQAAIRSKQAGFDVIEIHGAHGYLINEFLSPLSNKRTDEYGGSPENRYRFLREIIDSINEVWNGPLFVRISANDYHPDGLTVQDYVQYTKWMKEQGVDLIDCSSGAVVPARIDVYPGYQVQYAKHIKEHANIATGAVGLITTGAQAEQILNNNEADLIFIGRELLRNPYFPRIAANELGFELEEPHQYERAPGKISTNK

SEQ ID NO: 4479 - protein, 479 aa, Glycine max
MILLFGYILSKGNNIHSRLLCPSCISIGYRAPPRVSYVGPPPTTPTPEIESKPEIMEKVGVAVNSKNQESKATSTITIKGFMSLLMKSVDENGDGSKRVISLGMGDPTLTTYFPISNVAEKAVAEALQSHRFRGYAPTAGLPQARIAIAEYLSRDLPYQLSSDDVYITCGCTQAIDVSVAMLARPGANIILPRPGFPLYELSASFRGVEVRHYDLLPEKGWEVDLDAVEALADQNTVALVIINPGNPCGNVYSYHHLEKIAETAKRVGTIVIADEVYGHLAFAGKPFVPMGVFGSIVPVLTLGSFSKRWIVPGWRLGWFVTNDPSGTFRNPKVDERFKKYFDLLGGPATFIQAAVPQIIEHTEKVFFKKTIDNLRHVADICCKELKDIPYIICPYKPEGSMAMMVKLNLSLLEDISDDIDFCFKLAKEESVIILPGTAVGLNNWLRIIFATDPVALVEGLKRVKSFCERHARKWSMTTE

SEQ ID NO: 4480 - protein, 682 aa, Cryptococcus neoformans
MVTGDAKYRQMAEYTIDQDDKTPYTTYFGVKVSDTDNSLRAGARGPTLLEDFHNREKIQHFDHERIPERVVHARGAGAFGEFKLHTPLTGITTAKVLTDTSKVVPAYVRFSTVAGSRGSADTVRDVRGFATRLYTDEGNWDIVGNNIPVFFINAQTAHDNAWDFMSLHKPALHMQQWITSDRAIPRSYRMMQGFGVHTFRLINEEGKSTFVKYHWIPHLGTHSLVWDEALKIAGQDPDFHRRDLWDAIEAGTYAKWDLGVQLIKEEDEHKFDFDLLDATKLIPDELVPVQKIGTLTLNRNPVDYFSEVEQVAFCTQHIVPGMDFTDDPLLAGRNFSYPDTQVSRLGINWKHIPVNRPVCPFMTTMREGQMSMFSKNNRTPYHPNRNENLPLTSPKEGGFKSYPAKVSGIKERVQAPKFNDHSSQATLFWNSMSDVEKKHIIDAYKFELSHCTDNLVIQNVINCINEIDHGLATAVHSGFPHLSLPEAKPNHGKRTEYLSQITGKNQIFTAAGRKIGIFLVPGYVYSQVAPLLAAFKAAGCMVKFVGPTLGPVEASDGQSFTTEFTFEGCRSTYFDALIFAGGPDNAFLSKLKVGRLIHAAREAYMHLKAVGAVGNATQWLVDTCLPGEFSPKVKTESSVVQENGVVFAPINPTLHSAQFAKQFLDGVANHRVWDREVSHIAA

SEQ ID NO: 4481 - protein, 100 aa, Zea mays
  misc_feature (72)..(72): Xaa can be any naturally occurring amino acid
  misc_feature (85)..(85): Xaa can be any naturally occurring amino acid
  misc_feature (90)..(90): Xaa can be any naturally occurring amino acid
  misc_feature (93)..(93): Xaa can be any naturally occurring amino acid
  misc_feature (96)..(96): Xaa can be any naturally occurring amino acid
  misc_feature (99)..(99): Xaa can be any naturally occurring amino acid
MDWGNRTKAAAAAAAPDERAGGGEGLGGYVKVMTDEQMEVLRKQISIYATICEQLVEMHRVLTEHQDTIAGXGCLAHLYCDPLIXPGGHXITXARXRWXP

SEQ ID NO: 4482 - protein, 581 aa, Oryza sativa
MYRAAAAAASSISRSSSALRKQLSRGGCGEQRLWARGYAAKEVAFGVGARAALLQGVNDLADAVKVTMGPKGRNVIIERSHRAPKVTKDGVTVAKSIEFEDSAKNVGANLVKQVAEATNKVAGDGTTCATVLTQAILTEGCKAVAAGVNVMDLRNGINKAISSITTHLKSKAWIINSSEEINQVATISANGEKEIGDLISKAMEKVGKDGVITITDGKTLDNELEAVQGMKLSRGCISPYFVTDQKTQKCEMENPLILIHDKKISTMNSLLPVLEMSIKNRRPLLIIAEDVEGEALSMLVLNKHRAGLKICAVKAPGFGENRRANLDDVAVLTGGEVVSEDQGLDLGKVELQMLGTAKKVTVSLDDTIILDGGGDKQQIEERCQQLRESMDKSTAVFDKEKAQERLSKLSGGVAVLKIGGASEVEVGEKKDRVTDALHAARAAVEEGIVPGGGVALLYATKELDKIITANEDEKIGVQIIKNALKAPLMTIAANAGIDGGVVIGKLIEQDNLNMGYDAARGEYVDMIKAGIIDPVKVIRTALQDASSVSLLMTTTEAAVAEPPAAKARMASRMPQMSGMDF

SEQ ID NO: 4483 - protein, 260 aa, Chromobacterium violaceum
MGESLMAAMFSIAPVGAFTDNYIWVLREGARAVAVDPGEAAPLLRHLEQEQLRLEAVLITHHHADHCGGLADVLRAWPGIPVYGPAGLPGVSHPVMEGDAVSLSMGRAEVLEVPGHTLDHLAYLLEDALFCGDTLFAAGCGRLFEGTPGQMLASLKKLAGLPPNTKVYPAHEYTLSNLRFALAADQHNPILAMRHSRDSALRDRGLPTLPSTIALETASNPFLRSGEPALREALRRRGGQPGDSEETCFALLREWKNDFR

SEQ ID NO: 4484 - protein, 282 aa, Bacillus licheniformis
MMTAKNLQDRIKLNNGTAMPWFGLGVFKVEEGPELVQAVKTAIKHGYRSIDTAAIYGNEEGVGQGIREGLKEAGISREDLFVTSKVWNDDLGYDETIAAYEASLEKLGLDYLDLYLIHWPVEGRYKAAWKALETLYEQGRVKAIGVSNFQIHHLEDLLKDAAVKPAINQVEYHPRLTQKELQAFCRAHGIQLQAWSPLMQGQLLSHPLLKDIADKYGKTPAQVILRWDLQNGVVTIPKSTKAERIAQNADIFDFELTTEEMKQIDALNENTRVGPDPDNFDF

SEQ ID NO: 4485 - protein, 134 aa, Zea mays
MRKHRIVSLVAALLILLALAVSSNRNAQEDSMADNTGTLVGGIQDVPENENDLHLQELARFAVDEHNKKANALLGFEKLVKAKTQVVAGTMYYLTIEVKDGEVKKLYEAKVWEKPWENLKGLQEFKPVEEGASA

SEQ ID NO: 4486 - protein, 595 aa, Agrobacterium tumefaciens
MMNAANYRKWGAQRHQSGDTDFSIWAPASATVKLWLNDAEFDMHTAGDGWHDITKPALPGDRYGFVLADRTRVADPASNRQQEGPRGPSLIVNHDFAWKNPNWKGRPWHEAVVYELHIGTFTPEGTFAAAAEKLEYLADVGITTIELMPLATFAGSRGWGYDGVLQFSPQRDYGTPDELKAFIDQAHGHGIMVLLDVVYNHFGPAGNTLQAYAPAFFKKHETPWGPAPDFNRAEVRSFFLQNAFYWLETYRFDGLRIDAADHLAGGDGEVDFLIEMAREVKRTIRNRHVHLVIEDARNAASPMTPMADGAILVDAQWNDDFHHVIHVATTNEEGGIYEDFASRPYENLRRSLATGFVYQGEPRPSRNFAASGEPSGHLPPHRFVNFLHNHDQAGNRLRGERLRALIPPPLFGTLEAILLLCPQTPLVFMGDEHGSANPFFFFSDHPDHNREQEIRNRLKQAESFQGELPPDASQMVMDPNDQHTMQLSTLKWTHAETTEGRQSRADMAALLAKRRGHIWPLLCSHFEKGISLDCEPRCLAIDWHFKAGRLEMRANLSENMCELPAVKGEILHRNGSVGNTRYEGYAAQFAIYAGR

SEQ ID NO: 4487 - protein, 484 aa, Proteus mirabilis
  misc_feature (53)..(53): Xaa can be any naturally occurring amino acid
MEKKKLTTAAGAPVVDNNNVITAGPRGPMLLQDVWFLEKLAHFDREVIPERRXHAKGSGAFGTFTVTHDITKYTRAKIFSEVGKKTEMFARFSTVAGERGAADAERDIRGFALKFYTEEGNWDMVGNNTPVFYLRDPLKFPDLNHIVKRDPRTNMRNMAYKWDFFSHLPESLHQLTIDMSDRGLPLSYRFVHGFGSHTYSFINKDNERFWVKFHFRCQQGIKNLMDDEAEALVGKDRESSQRDLFEAIKRGDYPRWKLQIQIMPEKEASTVPYNPFDLTKVWPHADYPLMDVGYFELNRNPDNYFSDVEQAAFSPANIVPGISFSPDKMLQGRLFSYGDAHRYRLGVNHHQIPVNAPKCPFHNYHRDGAMRVDGNSGNGITYEPNSGGVFQEQPDFKEPPLSIEGAADHWNHREDEDYFSQPRALYELLSDDEHQRMFARIAGELSQASKETQQRQIDLFTKVHPEYGAGVEKAIKVLEGKDAK

SEQ ID NO: 4488 - protein, 472 aa, Spinacia oleracea
MATAVSTVGAATRAPLNLNGSSAGASVPTSGFLGSSLKKHTNVRFPSSSRTTSMTVKAAENEEKNTDKWAHLAKDFSDDQLDIRRGKGMVDSLFQAPADAGTHVPIQSSFEYESQGLRKYDIDNMLGDFYIAPAFMDKLVVHITKNFLNLPNIKIPLILGVWGGKGQGKSFQCELVFAKLGINPIMMSAGELESGNAGEPAKLIRQRYREAADLIAKGKMCALFINDLEPGAGRMGGTTQYTVNNQMVNATLMNIADNPTNVQLPGMYNKQDNARVPIIVTGNDFSTLYAPLIRDGRMEKFYWAPTREDRIGVCTGIFKTDKVPAEHVVKLVDAFPGQSIDFFGALRARVYHDEVRKWVNSVGVDNVGKKLVNSKDGPPVFEQPEMTLQKLMEYGNMLVQEQENVKRVQLADQYMSSAALGDANKDAIDRGTFFGKAAQQVSLPVAQGCTDPEAKNYDPTARSDDGSCTYNL

SEQ ID NO: 4489 - protein, 464 aa, Listeria monocytogenes
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKNQKFMGTSTIGSSEACMLGGMAMKFAWRKRAEKLGLDIYAQKPNLVISSGYQVCWEKFCVYWDIDMRVVPMDKDHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIYNDGSHLPIVCYKLKDDANVKWTLYDLADRLQMRGWQVPAYPLPKNLENIIIQRYVCRADLGFNMAEEFIQDFQASIQELNNAHILFHDTQQSGVHGFTH

SEQ ID NO: 4490 - protein, 435 aa, Spinacia oleracea
MATAVSTVGAATRAPLNLNGSSAGASVPTSGFLGSSLKKHTNVRFPSSSRTTSMTVKAAENEEKNTDKWAHLAKDFSDDQLDIRRGKGMVDSLFQAPADAGTHVPIQSSFEYESQGLRKYDIDNMLGDFYIAPAFMDKLVVHITKNFLNLPNIKIPLILGVWGGKGQGKSFQCELVFAKLGINPIMMSAGELESGNAGEPAKLIRQRYREAADLIAKGKMCALFINDLEPGAGRMGGTTQYTVNNQMVNATLMNIADNPTNVQLPGMYNKQDNARVPIIVTGNDFSTLYAPLIRDGRMEKFYWAPTREDRIGVCTGIFKTDKVPAEHVVKLVDAFPGQSIDFFGALRARVYHDEVRKWVNSVGVDNVGKKLVNSKDGPPVFEQPEMTLQKLMEYGNMLVQEQENVKRVQLADQYMSSAALGDANKDAIDRGTFFG

SEQ ID NO: 4491 - protein, 124 aa, Nicotiana tabacum
LGFPGSNSGETSAFANTRVDWKETPEAHVFKADLPGLKKEEVKVEIEDDRVLQISGERNVEKEDKNDTWHRVERSSGKFMRRFRLPENAKMDQVKAAMENGVLTVTVPKEEVKKPDVKSIDISG

SEQ ID NO: 4492 - protein, 124 aa, Nicotiana tabacum
LGFPGSNSRETSAFAHTRVDWKETPEAHVFKADLPGLKKEEVKVEIEDDRVLQISGERNVEKEDKNDTWHRVERSSGKFMRRFRLPENAKMDQVKAAMENGVLTVTVPKEEVKKPDVKSIDITG

SEQ ID NO: 4493 - protein, 145 aa, Bacillus cereus
MRNLFPEITKRQNGIFDFGPSLLEGMTDAFFKPMNMDTFKVDVHEQSDKYTVKADLPGFQKENIQVEFEQDVLTIQATNHNEVEEKNENGIYIRKERSIGSVTRRFNFQQVEEENVKANYKDGVLTIELPKLKEEKNSKTTINIE

SEQ ID NO: 4494 - protein, 124 aa, Nicotiana tabacum
LGFPGSNSGETSAFANTRVDWKETPEAHVFKADLPGLKKEEVKVEIEDDRVLQISGDRNVEKEDKNDTWHRVERSSGKFMRRFRLPENAKMDQVKAAMENGVLTVTVPKEEVKKPDVKSIEITG

SEQ ID NO: 4495 - protein, 407 aa, Candida albicans
MTIESTNSFVVPSDTKLIDVTPLGSTKLFQPIKVGNNVLPQRIAYVPTTRFRASKDHIPSDLQLNYYNARSQYPGTLIITEATFASERGGIDLHVPGIYNDVQAKSWKKINEAIHGNGSFSSVQLWYLGRVANAKDLKDAGLPLIAPSAVYWDENSEKLAKEAGNELRALTEEEIDHIVEVEYPNAAKHALEAGFDYVEIHGAHGYLLDQFLNLASNKRTDKYGCGSIENRARLLLRVVDKLIEVVGANRLALRLSPWASFQGMEIEGEEIHSYILQQLQQRADNGQQLAYISLVEPRVTGIYDVSLKDQQGRSNEFAYKIWKGNFVRAGNYTYDAPEFKTLINDLKNDRTIIGFSRFFTSNPDLVEKLKLGKPLNYYNREEFYKYYNYGYNSYDESEKQVIGKPLA

SEQ ID NO: 4496 - protein, 338 aa, Listeria monocytogenes
MSKLFSEYKLKDVTLKNRIVMSPMCMYSVENKDGIATDFHFAHYVSRAAGGTGLVILEATAVQEVGRISEFDLGLWNDEQVPALKKLVGGLHYHGAKAGIQLAHAGRKAVLPGEIVAPSAIAFDEKSDKPVELTKEAIKEVVADFKRAAYRAKEAGFDVIEIHAAHGYLIHQFLSPITNRREDNYGGPAGNRYKILSDIIKAVKEVWDGPIIVRVSATDYAHGGLQLEDHIPFAKWMKADGVELIDVSTGGLVNVAPPVFPGYQVPFADEIRRGAGIATGALGLITRGEQAEEILCNERADLIIVGRELLRNPYFAKDAAKQLGETIEAPKQYSRAWK

SEQ ID NO: 4497 - protein, 255 aa, Rhodobacter sphaeroides
MPLELVTVPCLSDNYAFLVHDAGTGETSVVDVPEAGPILKALEERGWHLSQILLTHHHSDHVAGVEELRAATGARVAGAAADAHRLPPLDLELAEGDLVRVGASEGRVIEVPGHTVGHIAFHFPDSSLAFTGDSLMAMGCGRLFEGTAEAMWQSLRKLSALPPETMICSGHEYAASNARFAATLEPDSPMLIFRVGSIAAARKEGRPTVPSHLSDEIATNPFLRAGEASLKAAVGMVDAEDAEVFAEIRRRKDKF

SEQ ID NO: 4498 - protein, 272 aa, Brassica napus
MAAAVSTVGAINRAPLSLNGSGAGAASVPATTFLGKKVVTASRFTQSNNKKSNGSFKVVAVKEDKQTDGDRWKGLAYDTSDDQQDITRGKGMVDSVFQAPMGTGTHNAVLSSYEYISQGLKQYNLDNMMDGLYIAPAFMDKLVVHITKNFLTLPNIKVPLILGVWGGKGQGKSFQCELVMAKMGINPIMMSAGELESGNAGEPAKLIRQRYREAADLIKKGKMCCLFINDLDAGAGRMGGTTQYTVNNQMVNATLMNIADNPTNVQLPGMYN

SEQ ID NO: 4499 - protein, 515 aa, Glycine max
MDRSTGRGGGGSVDMFLRNYKLGKTLGIGSFGKVKIAEHVRTGHKVAIKILNRHKIKNMEMEEKVRREIKILRLFMHHHIIRLYEVVETPTDIYVVMEYVKSGELFDYIVEKGRLQEDEARHFFQQIISGVEYCHRNMVVHRDLKPENLLLDSKFNIKIADFGLSNIMRDGHFLKTSCGSPNYAAPEVISGKLYAGPEVDVWSCGVILYALLCGTLPFDDENIPNLFKKIKGGIYTLPSHLSPGARDLIPRMLVVDPMKRMTIPEIRQHPWFQVHLPRYLAVPPPDTLQQAKKIDEEILQEVVNMGFDRNQLVESLSNRIQNEGTVTYYLLLDNRFRVSSGYLGAEFQETMDSGFNRMHSGEVASPVVGHHSTGYMDYQGVGMRQQFPVERKWALGLQSRAQPREIMTEVLKALQELNVCLEEDWTLYHECRWVAGTAGHHEGMINNSLHSNHYFGNDSGIIENEAVSKSNVVKFEVQLYKTREEKYLLDLQRVQGPQFLFLDLCAAFLSQLRVL

SEQ ID NO: 4500 - protein, 137 aa, Arabidopsis thaliana
  misc_feature (106)..(106): Xaa can be any naturally occurring amino acid
  misc_feature (109)..(109): Xaa can be any naturally occurring amino acid
MEMESFIDDLLNFSVPEEEEDDDEHTQPPRNITRRKTGLRPTDSFGLFNTDDLGVVEEEDLEWISNKNAFPVIETFVGVLPSEHFPITSLLEREATEVKQLSPVSXVLXTGSHSSTTAYLKQAGKPEGWVTGPLPTT

SEQ ID NO: 4501 - protein, 217 aa, Brassica napus
  misc_feature (172)..(172): Xaa can be any naturally occurring amino acid
MAQQSLIYSFVARGTVILVEFTDFKGNFTTVAAQCLQKLPSSNNKFTYNCDGHTFNYLVEDGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSXDFRTTGTQMRRKMWLQNMKIKLIVLAIIVALILIIVLSVCHGFKC

SEQ ID NO: 4502 - protein, 83 aa, Cucumis sativus
ERVVHARGASAKGFLRVTHDITNLSCADFLRAPGVQTPVIVRFSTVIHERGSPETLRDPRGFAVKFYTREVRILVVYAFIGCT

SEQ ID NO: 4503 - protein, 682 aa, Salmonella typhimurium
MNTFFRLTALAGLLALAGQSFAVEDITRADQIPVLKEETQHATVSERVTSRFTRSHYRQFDLDEAFSAKIFDRYLNLLDYSHNVLLASDVEQFAKKKTVLGDELRTGKLDVFYDLYNLAQKRRFERYQYALKVLERPMDFTGNDTFNLDRSKAPWPKDEAELNALWDGKVKFDELSLKLTGKSDKEIRETLTRRYKFAIRRLAQTNSEDVFSLAMTAFAREIDPHTNYLSPRNTEQFNTEMSLSLEGIGAVLQMDDDYTVINSLVAGGPAAKSKSISVGDRIVGVGQAGKPMVDVIGWRLDDVVALIKGPKGSKVRLEILPAGKGTKTRIITLTRERIRLEDRAVKMSVKTVGKEKVGVLDIPGFYVGLTDDVKVQLQKLEKQNVNSIVIDLRSNGGGALTEAVSLSGLFIPSGPIVQVRDNNGKVREDSDTDGVVYYKGPLVVLVDRFSASASEIFAAAMQDYGRALIVGEPTFGKGTVQQYRSLNRIYDQMLRPEWPALGSVQYTIQKFYRVNGGSTQRKGVTPDIIMPTGNEETETGEKFEDNALPWDSIDAAKYVKSDDLAPFGPELLKEHNARIAKDPEFQYIMKDIARFNAMKDKRNIVSLNYAQREKENNEEDALRLARINDRFKREGKPLLKKLDDLPKDYQEPDPYLDETVKIALDLAHLEKEKPAEQAAANK

SEQ ID NO: 4504 - protein, 431 aa, Arachis hypogaea
GRGEFGVTYLCIDRGSRELLACKSISKRKLRTAVDVEDVRRKVAIMRHLPRSSSIVSLREACEDDNAVHLVMELCEGGELFDRIVARGRYTERAAAVVARTVVEVVQLCHRHGVIHRDLKPENFLFANKKENSPLKAIDFGLSVFFKPGEKFSEIVGSPYYMAPEVLKRNYGPEIDIWSAGVILYILLCGVPPFWAESEQGGAQAILRGLIDFKREPWPSISESAKSLVKQMLEPDPKLRLTAKQVLEHPWIQMLRRAPNIPLGDAVKSRLKQFSMMNRFQKKALRVIADFLSNEEVEDIKDIFQKMDTDNDGIVSIEELKAEFQNFGSQLAESEIQMLLEAVNTNGKGTLDYGEFVAVSLHLKRMANDEHLRKAFSYFDKDGNGYIEPDELRNALMEDGTDDCADVANDIFQEVDTDKDGRISYEEFVAM

SEQ ID NO: 4505 - protein, 289 aa, Salmonella enterica
MEYSILSNNLKMPMVGFGVFKVTDKEECQQSVLSAIRSGYRLIDTAAVYGNEDAVGDAVREAIATGLCTREELFITSKLWVQDMANYDLAKAGIEASLKKSGLDYFDLYLLHQAMGDYFSAWRALEDAYEAGKLKAIGVSNFYAHVLANFCETVRITPMVNQVELHPYFAQPAALETMKHYNVQPEAWAPLGGGRHKPYENVMLQRIADAHQKTIAQVVLRWNVQRGVTVIPKSTRQERIEENFAIWDFSLTDNEMAQINALDLGYVGEAVKHFNPEFVRGCLGVKIHD

SEQ ID NO: 4506 - protein, 687 aa, Ralstonia solanacearum
MRYPHLFKPLQLNQLTLRNRIVSTAHAEVYAEPDGLPGERYIRYYEEKAKGGVGLAVCGGSSPVSIDSPQGWWKSVNLATDRIIDPLARLAETMHRHGAKIMIQATHMGRRSAFHGEHWPHLMSPSGVREPVHRGNAKIIEVEEIQRIITDFAAAAKRVKAAGMDGIEISAAHQHLIDQFWSPRTNHRTDEWGGSLENRLRFGVEVLKAVREAVGKDFCVGLRMCGDEFHEDGLDHEQLKEIAQAMSETGLIDYLGVIGSGADTHNTLANCMPPMALPPEPFVHLAAGIKSVVKVPIMHAQSIRDAGQAERLLASGMIDLVGMTRAQMADPHMVIKIRDGREDEIKQCVGANYCIDRQYNGLDVLCIQNAATSREETMPHVIEKSRGPKRKVVVVGAGPAGLEAARVARSRGHDVVLFEKNHEVGGQIMLAAKAPQREQMSGIVRWFDMETKRLGVDRRLGVEVDTKAIMAEKPDIIVLATGGRAFSDQVPDWGVADGLAVSSWDILSGKVEPKQNVLVYDGVSTHAGAGVADFIASRGSKVEIVTPDVKVADDCGGTTFPIFYRRLYAQGVIHTPNYWLDRVYEEDGKKIAVIRNEYTEELEERAIDQVVIENGITPNDALYWKLKPESVNRGQIDVHKLFAAEPQPWLSEELGNGRFLLFRVGDCISMHNIHGAIYDALRLVKDF

SEQ ID NO: 4507 - protein, 102 aa, Nicotiana tabacum
PNSYVFVVDMPGLKSGDINVQVEDDNVLLISGERKREEEKEGAKYIRMERRVGKFMRKFTLLENANTDAISAVCQDGVLTVTVQKLPPPEPKKPKTIEVKIA

SEQ ID NO: 4508 - protein, 471 aa, Streptococcus pneumoniae
MTIFPDDFLWGGAVAANQVEGAYNEDGKGLSVQDVLPKGGLGEATENPTEDNLKLIGIDFYHKYKEDISLFSEMGFNVFRTSIAWSRIFPKGDEEEPNEAGLKYYDELFDELHAHGIEPLVTLSHYETPLYLARKYHGWVDRRMIHFYEKFARTVLERYKDKVKYWLTFNEVNSVLELPFTSGGIDIPKENLSKQELYQAIHHELVASSLVTKIAREINSEFKVGCMVLAMPAYPMTPNPKDVWATHEYENLNYLFSDVHVRGYYPNYAKRYFKENDINIEFAAEDAELLKNYTVDFLSFSYYMSVTQSALPTQYNSGEGNIIGGLVNPYLESSEWGWQIDPIGLRIILNRYYDRYQIPLFIVENGLGAKDQLIKDELNNLTVQDDYRIQYMKEHLLQVAEALQDGVEIMGYTSWGCIDCVSMSTAQLSKRYGLIYVDRNDDGSGTLNRYKKMSFTWYKEVIESNGESLFK

SEQ ID NO: 4509 - protein, 642 aa, Streptococcus pneumoniae
MDNREALKTFMTGENFYLQHYLGAHREELNGEHGYTFRVWAPNAQAVHLVGDFTNWIENQIPMVRNDFGVWEVFTNMAQEGHIYKYHVTRQNGHQLMKIDPFAVRYEARPGTGAIVTELPEKKWKDGLWLARRKRWGFAERPVNIYEVHAGSWKRNPDGSPYSFAQLKDELIPYLVEMNYTHIEFMPLMSHPLGLSWGYQLMGYFALEHAYGRPEEFQDFVEECHTHNIGVIVDWVPGHFTINDDALAYYDGTPTFEYQDHNKAHNHGWGALNFDLGKNEVQSFLISCIKHWIDVYHLDGIRVDAVSNMLYLDYDDAPWTPNKDGGNLNYEGYYFLQRLNEVIKLEYPDVMMIAEESSSATKITGMKEIGGLGFDYKWNMGWMNDILRFYEEDPIYRKYDFNLVTFSFMYVFKENYLLPFSHDEVVHGKKSMMHKMWGDRYNQFAGLRNLYTYQICHPGKKLLFMGSEYGQFLEWKSEEQLEWSNLEDPMNAKMKYFTSQLNQFYKDHRCLWEIDTSYDGIEIIDADNRDQSVLSFIRKGKKGEMLVCIFNMVPVERKDFTIGLPVAGIYEEVWNTELEEWGGVWKEHNQTVQTQEGLWKDYEQTLTFTLPAMGASVWKIKRRLKSTKTVTNKNPKGVENEK

SEQ ID NO: 4510 - protein, 115 aa, Brassica napus
  misc_feature (6)..(6): Xaa can be any naturally occurring amino acid
  misc_feature (14)..(14): Xaa can be any naturally occurring amino acid
  misc_feature (75)..(75): Xaa can be any naturally occurring amino acid
  misc_feature (100)..(100): Xaa can be any naturally occurring amino acid
  misc_feature (102)..(102): Xaa can be any naturally occurring amino acid
MTSEHXFISRKDEXDRVIVFERGDLVFVFNFHWTSSYFDYRIGCSNPGKYKIVLDSDDPLFGGFGRLDRTAEYFXFEGSYDGRPSSFMVYTPCTTAVVYXLXDRDDGLETLGPKP

SEQ ID NO: 4511 - protein, 106 aa, Nicotiana tabacum
PNCYIFIVDMPGTKANEIKVQVEDDNVLVVSGERKRDKEKKDEKESVKYLRMERRVGKFMRKFVLPENANIDSITAVCQDGVLKVTVEKLPPPERKKPKTIDVKLA

SEQ ID NO: 4512 - protein, 466 aa, Unknown
  Pseudomonas sp. ND6
MQGARRAVAAGFDAIEFHGAHGYLLGQFLSPFTNKRTDQWGGSLENRARFALEVVRAVRTQVGPDFPLLYRLSVTEPYEGGLSLEDGLAFCQMLEPYVDALDVSAGNYDTAMVLLPMGAPGSLVNYAKAVKQRVSLPVIGVGRLTWLLEDMAKAIDNNELDFVALGRAGLADPDTVIKTRRGEPESVRRCIAVNECISRWMFNGKGTQCVINPTLGEERRAQLARRPAAVKQRVLVVGAGPAGCEAAILAAQRGHQVVLLERRNRVGGQLHAWAAASPFRQEILNMITFYETELGKAGVEVRLNAVADEVVPAEWDHVLLATGTAPATGPMDVVDMLADNALPTALELIVYGETETAMYAAIWLAENQRKVTLVSPSDKVGVDSNDMQRDHLESVLKQLGVSIALNGKPPEAGTVVMATARQPSTAHAALERYLNVQPIGTRLRGGRMYEATQSGFWAAANLGELQ

SEQ ID NO: 4513 - protein, 235 aa, Arabidopsis thaliana
MSSYSIASAISRISPLIRYAYHYSPNSSTLQSQPQSTRRPKRFDQLCVFSMASEARESPANNPGLSTNRDEATKGYIMQQTMFRIKDPKASLDFYSRVLGMSLLKRLDFSEMKFSLYFLGYEDTTTAPTDPTERTVWTFGQPATIELTHNWGTESDPEFKGYHNGNSEPRGFGHIGVTVDDVHKACERFEELGVEFAKKPNDGKMKNIAFIKDPDGYWIEIFDLKTIGTTTVNAA

SEQ ID NO: 4514 - protein, 639 aa, Geobacillus stearothermophilus
MIAVGPTDLEIYLFHEGSLYKSYELFGAHVIKKNGMVGTRFCVWAPHAREVRLVGSFNEWNGTNFNLMKVSNQGVWMIFIPENLEGHLYKYEITTNDGNVLLKSDPYAFYSELRPHTASIVYNIKGYQWNDQTWRRKKQRKRIYDQPLFIYELHFGSWKKKEDGSFYTYQEMAEELIPYVLEHGFTHIELLPLVEHPFDRSWGYQGIGYYSATSRYGTPHDLMYFIDRCHQAGIGVILDWVPGHFCKDSHGLYMFDGAPAYEYANMQDRENYVWGTANFDLGKPEVRSFLISNALFWMEYFHVDGFRVDAVANMLYWPNSDVLYKNTYAVEFLQKLNETVFAYDPNILMIAEDSTDWPRVTAPTYDGGLGFNYKWNMGWMNDILTYMETPPEHRKYVHNKVTFSLLYAYSENFILPFSHDEVVHGKKSLLSKMPGTYEEKFAQLRLLYGYLLTHPGKKLLFMGGEFGQFDEWKDLEQLDWMLFDFDMHRNMNMYVKELLKCYKRYKPLYELDHSPDGFEWIDVHNAEQSIFSFIRRGKKEDDLLIVVCNFTNKVYHGYKVGVPLFTRYREVINSDAIQFGGFGNINPKPIAAMEGPFHGKPYHIQMTIPPFGISILRPVKKGSVKSFMKTPHPPSHGAS

SEQ ID NO: 4515 - protein, 164 aa, Zea mays
MDAVMFGLETPLMAALQHLLDVPDGDAGAGGDNKTGSGGSATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 4516 - protein, 673 aa, Oceanobacillus iheyensis
MSNQEQNKKNQQLDQFRVNDKDKSLTTNQGLKMNEDEFSLKAGERGPSLLEDFHLREKITHFDHERIPERVVHARGFAAHGEFEVYESLAPYTKANFLGEAGKKTPVFVRFSTVAGSRGSGDMARDVRGFATKFYTDEGNYDLVGNNIPVFFIQDGIKFPDLIHAVKPEPHNEIPQAQSAHDTFWDFVANNQETAHMIMWHLSDRAIPRSFRMMEGFGVHTFRFVNEEGQAFFVKFHWKPVLGVHSVIWDEALKLNGNDPDFQRRDLYDAIENGQYPEYELGLQIIKEEDEFNFDFDVLDPTKIWPEEDVPVKIVGKMTLNQNIDNYFAETEQVAFHPGHVVPGIDFTNDPLLQARLFSYTDTQLIRLGGPNFHEIPINRPVCPFHNNQRDGYGRQTINSGQVSYHKNSLADNTPTPVSEENGGYKHYQEKVEGKKVRARSISFEDHFTQAALFWNSMSDVEKNHIIDAFSFELGKCKEVAIREQVLDMFSNVSHDLVTGIAENLGLAIPKKKEIDYTKSSPALSQANTKKKADTRKVGIIVADGFDEELFSHIKALNEANINPEIISDHQGSISSKEGNKIPVHHTFKTADSVLFDSILIASKEGTKPLFTKEAPNFVKEAYMHYKPISALQDGASVLHDLGLTDEKGVVTNNASQFVEAVAEARFWNRDGK

SEQ ID NO: 4517 - protein, 713 aa, Pseudomonas fluorescens
MSTKKPANDKSQLAGTDTPDRANTNAKLDSLEKFRSDATGQALRTNQGVKVADNQNTLKAGARGPSLLEDFIMREKITHFDHERIPERIVHARGTGAHGFFQSYENHSTLTKAGFLQDPGKKTPVFVRFSTVQGPRGSGDTVRDVRGFAVKFFTDEGNFDLVGNNMPVFFIQDAIKFPDFVHAVKPEPHNEIPTGGSAHDTFWDFVSLVPESAHMVIWAMSDRAIPKSLRSMQGFGVHTFRLINAEGKSRFVKFHWRPTAGTCSLVWDEAQKLAGKDTDYHRRDLWEAIEMGDYPEWELGVQVIEEENEHDFDFDILDPTKLIPEEIVPITPLGKMTLNRNPDNFFAETEQVAFCPGHIVPGIDFSNDPLLQGRLFSYTDTQISRLGGPNFHELPINRPVAPFHNGQRDAQHRTVIDKGRASYEPNSIDGGWPKETPPAAQDGGFESYPERIDANKIRQRSESFSDHFSQARLFFNSMSAHEKEHIIAAYSFELGKVEREFIRARQVNEILANIDLELAKRVAANLGLPAPGKGTVDVPKTSLDRSPSLSQANLLPENIKTRKVAILAANGVDGAAIDAMKKALAAEGAHAKLLGPTSAPVKTADGKSLAVDASMEGLPSVAFDAVFVPGGAASVKALSGDGVALHYLLEAYKHLKAIALQGEAKQLLDVLKLEADAGLLEGKDVGALTKPFFSAIGQHRVWDREAKAKAIPA

SEQ ID NO: 4518 - protein, 644 aa, Crocosphaera watsonii
MTQQSIETIKRDYPYQYFGAHPSQNETIFRVYAPRATRVSLLREGNGWDCFAETMTKNDEGVWEITIPENLTWKEYKYYIENHSDYLGQPYEMSRIDPFSPQLAVTWGNDDTRNFNSIVGDRNYFNWSHKHIDLPHEPMSIYEMHLSTFHDGNYRDIAHKIVGHLGYMGFTHVQIMPPFQTPIHQSWGYLVGCPYAIYERHGTVDDFKYLVNHCHAHGIGVIVDVPLGFGVQDWDCGLANYDGTDLYHHSGSKGWNNQWNSRIYNVGDVYVQNYLIGLCTYLYHELGVDGARIDAVAAQIFFDYDRGFWDWPKNDREQVDSENWDLFNGLGGDRYFEERGYWLSEAVDFAGMRFLKDLHARLQHTAPKFITIAEESRRVFPRLACPVHEGGLGFTYAQNMGEMHRVRSYLQIPIEQRLIEHIEILIHNNSAETMVNAMNTHDECANGKVRLITELGNHVPLIGLAALCWFRPGAPMIFQGDEFGEEGYFDVFQGVDWSKTGDYAAIHQQQISNNFHDLNQLLRNEPALARHNIHSMIRNGSNNERKWFSFIRWGSDVGFDSDKWEDHKDDIIFVRNETPYQVECNVEIYVPVVGEYKVIYNSIDQRYIGSQHYNQHDPYWTIHSSGQFLYFDVHPFQNIAFKLK

SEQ ID NO: 4519 - protein, 759 aa, Paracoccidioides brasiliensis
MASKATEGLRKIQGMVESMHPGNKKVADLARDTVDVHAPAPFTTDHGTKVSNTDNWLRAASENQTGPSLLEDQIAREKIHRFDHERIPERVVHARGTGAFGHFKLVESAEDATSAGVLTDTSRTTPVFVRFSTVQGSKGSFDTVRDVRGFATKFYTQEGNWDLVGNNIPVFFIQDAIKFDISKQSIPFSFLSRCYLSSVHAVKPERQRSPQGNCHNNFWDFVSCILKATHMFMWAMSDRAIPRILPVCRGFGVNTFVLVNRQGKRHFVKFHWMPELGVHSLVPDESFKLGGQDPDYHRKDLMEAIDNKVYPKWKFGIQVIPEEKEHEFEFDILDATKIWPEDLVPVRYIGEMELNRNVDEFFPQTEQVAFCTSHIVPGIEFSDDPLLQGRNFSYFDTQISRLGVNWEELPINRPVCPVMNHNRDGAMRHKITQGTVNYWPNRFEACPPTNPEDGGFVTYPQKITRTLSYMVSNKFANTSPAQLFYNSLSYEQLHIQNAFCFELDHCYDPVVTTDSSSDLLKSPYRSHELSQSKSALQHQTGLDVPTKGQKTINLSQEYINERQPFCTHNPRGENTILIGDGTTQSPSPLSNRGNSHECSAHHNGTKRQPIFADHEDRETGAGVIPDHNYIGQRSTLLTPRSYPVARISRSCASLGAFRHWIAEQFGHCKAIGATGEAVDLIAQVLNSLPGLNVALASSSDVVEWYGVVTSSKLHEPHTLTEGFKLFPEAKDFLGKFLYQVSQHRNYQRDMVGLTDQVAF

SEQ ID NO: 4520 - protein, 444 aa, Prochlorococcus marinus
MKIRKLLKKNFIILFATTFSGLFLNNFAEATVLNNSYKEVIDHVWQIVYRDFLDSSGKFQKSNWINLRKEVLSKTYSDSNEAYDAIRDMLSNLDDSYTRFLEPKEFNQMRIDTSGELTGVGIQIVKDKESDDLIIISPIEGTPAFDAGIKARDKILSIDDISTEGMNIEEAVKLIRGQRGTKVKLEILRGSKSFFKILSRERIEIKTVSTKVNQAKNGLLIGYVRIKQFNANASKETRDAIKDLETKKVAGYVLDLRSNPGGLLESSIEISRHFINKGVIVSTVSKDGLKETKRGNGQALTKKPLVVLVNEGSASASEIVSGAIKDNKRGKLVGKKTFGKGLVQSMRTLVDGSGLTVTVAKYLTPNGTDINESGIIPDIEVKMNINPILQREIGTRKDKQYRAGEKELVNIIKRNNNISEFNPNTANLNALLKINKENKVFSLN

SEQ ID NO: 4521 - protein, 510 aa, Sorghum bicolor
MAVFISSSGSPGRATATTTTTTTLLLAVLAAAAAAGLLLAPVAARGSPPEHDKQLQLQQQEDDRIPGLPGQPNGVAFGMYGGYVTIDDNNGRALYYWFQEADTADPAAAPLVLWLNGGPGCSSIGLGAMQELGPFRVHTNGESLLLNEYAWNKAANILFAESPAGVVFSYSNTSSDLSMGDDKMAQDTYTFLVKWFERFPHYNYREFYIAGESGHFIPQLSQVVYRNRNNSPFINFQGLLVSSGLTNDHEDMIGMFELWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVSPSGAGHLVPVHRPAQAFLLFKQFLKGEPMPAEEKNDILLPSEKAPFY

SEQ ID NO: 4522 - protein, 478 aa, Chromobacterium violaceum
MHHPSLKPFPDDFLWGAASAAYQVEGAFDADGKGPSVWDVFVREPGRTFQGSNGDVAVDHYHRMEEDVALMAEMGLTAYRFSVSWPRVLPRGRGEPNEAGLAFYDRLIDALLARGIEPVLTLYHWDMPQALQDEYGGWEDRRIVDDFGDYCALLFRRYGDRVKTWVSLNEQNYNLSNAYLLATHPPAAADRKRFYAANHIAFLANARAIRLFRQWVPDGRIGPSFAYSPAYPASCAPADMLAFDNAEEFTNHWWLDVYCRGRYPQIALAWLRERGEAPDIRPGDIEALAAARPDFIGLNYYYTLSYAHNPPDGVGMQRINTTGQKGSTPASGVPGLYRTAPNPALETSNWDWAIDPAGLRIALRRLTSRYGLPVLITENGLGEFDRLEDGDRVRDDYRIAYLRSHLHACREAISDGVALLGFCAWSFTDILSWLNGYQKRYGFVYVNRDETDARDLRRVRKDSFFWYQRAIASGGREL

SEQ ID NO: 4523 - protein, 280 aa, Streptococcus agalactiae
MTDTMILNDNHKIPTLGLGTWMIDNDRVAQVVKDAIELGYRHINTAQAYNNEKGVGVGIKESGITRESLFVTTKIAAEHKDYESATKSIDQSLEALGLDCIDLMIIHSPQPWKEWRETDKHFDQGNLEAWRALEDAQKSGKVKSIGVSNFLEKDLKNGHVKPAVNQILAHIGNTPFDLIDYCQSKGIQVEAYSPIAHGQALKSDGIQKMAEKYGVSVAQLCIQYLLQLNLIVLPKASSKEHLQSNLDFDFVISDEDMSILKSLMFDDYGEFSNFPVFSEK

SEQ ID NO: 4524 - protein, 759 aa, Streptomyces coelicolor
MSEANPLKRVARKVTEGLHGEAGGPPDGIPGRPGPESPSAAEPTEPREPLPPKPDQTGPDTVSPTGQPTGADQARVAQSGSYLTNAQGTRLYDTDHSLKAGPRGPVLLQDHHLREKVMHFDHERIPERVVHARGAGAHGVFQSYGTAASVTKAGFLAADVETPVFTRFSTVVGSRGSSDTVRDTRGFATKFYTSEGVFDLVGNNIPVFFIQDAIKFPDVVHAAKPHPDREIPQAQSAHDTFWDFVSLHTEATNHTIFFMGDRGIPRSFRMMEGFGVHTFRLVNAEGATTLVKFHWKPKLGVHSLVWDEAQLINGVDPDFHRRDLADAIEAGAYPQWELGIQTFPDNPEQTFEGIDLLDPTNFVPEELAPVQPVGLLTLNRNPSNFFAETEQVAFHVGHLVPGIDVTDDPLLAGRLFSYLDTQITRLGGPNFPQLPINRPQAPVNDMLRDGMHQSAVHRGVAPYRPNSLDGGCPFTAGADTSAFVEAPVRVPEGRKVREASESFADHFSQPRRFWLSMSPVEREHIIGAYTFELGKCYEQAIRERTLQVLANIDPELCAGVAEGLGLPAPEPTVPLAEVEPSPALSQVGGVWPLDGRVVGIVTGGADLEGVGAVREAVLNAGMVPLVVAPTGGTLGSGDAALTVQRSYVTARSVEFDAVLIAGTPDMGGDAYTPRDYKAGPAPAGPGTVDPRVSLLLSEAFRHGKAIGVWAGGTPALEASGVPADAPGVIVADSGTAALERVTELMGSHRVWERFTTPRG

SEQ ID NO: 4525 - protein, 332 aa, Salmonella enterica
MKTLGEFIVEKQHEFSQATGELTALLSAIKLGAKIIHRDINKAGLVDILGASCAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLIYTTGCGVHAFTYDPSLGVFCLCQERMRFPEKGKTYSINEGNYIKFPNGVKKYIKFCQEEDSSTSRPYTSRYIGSLVADFHRNLLKGGIYLYPSTASHPQGKLRLLYECNPMAFLAEQAGGKASDGKERILDIIPESLHQRRSFFVGNRHMVDDVERFIREYPDA

SEQ ID NO: 4526 - protein, 655 aa, Burkholderia vietnamiensis
MCGIDGFLNSVAFDEETARGTLARMTASLAHRGPDGQGMWVDPEAGIALGHRRLAIVDLSVQGRQPMASACGRYVLVFNGEIYNHRELRAELERTGRAPAWRGRSDSEVLVAAIAAWGVDATLRRATGMFAFALWNRASRVLTLARDRIGEKPLYYGRIGDALVFASELKALRGYPGFDGAVDRDALCLYLRQSSVPAPHTIYRGISKLPPGTFIQFEHARDTPRVRAYWALEQAIEAGRERPFDGNADDAVGQLDAVLRQAVARQMEADVPLGAFLSGGIDSSAIVALMQAQSAKPVDTFTIGFHEAGYDEAGYAKAVARHLGTRHTELYVTADHALAVVPKLPSIYDEPFSDASQIPTFLVSDLTRRHVKVSLSGDGGDELFGGYTRYFLTPRLWRKLHRVPAAVRARIAAALHALRPDHADQLAAVAQGAWGGVDARDGASRIGDRLHKLGHVMTAESRIGLYRLLMSSVHHPERLALAGQEPPTPLDTVSAWPAHLSFAEQAMAIDTLTYLPTDILAKVDRAAMAVGLETRMPFLDHHVVEFAWRLPAAVRLPQGQPKALLRRLLDQYVPRALIDRPKQGFCAPVDHWLRGALRDWAEALLEPSRLRAEGFFDAAAVERLWRQHLTGRMNWQHQLWTVLMFQAWLEGQRAA

SEQ ID NO: 4527 - protein, 505 aa, Helicobacter pylori
MVNKDVKQTTAFGAPVWDDNNVITAGPRGPVLLQSTWFLEKLAAFDRERIPERVVHAKGSGAYGTFTVTKDITKYTKAKIFSKVGKKTECFFRFSTVAGERGSADAVRDPRGFAMKYYTEEGNWDLVGNNTPVFFIRDAIKFPDFIHTQKRDPQTNLPNHDMVWDFWSNVPESLYQVTWVMSDRGIPKSFRHMDGFGSHTFSLINAKGERFWVKFHFHTMQGVKHLTNEEAAEVRKYDPDSNQRDLFNAIARGDFPKWKLSIQVMPEEDAKKYRFHPFDVTKIWYLQDYPLMEVGIVELNKNPENYFAEVEQAAFSPANVVPGIGYSPDRMLQGRLFSYGDTHRYRLGVNYPQIPVNKPRCPFHSSSRDGYMQNGYYGSLQNYTPSSLPGYKEDKSARDPKFNLAHIEKEFEVWNWDYRADDSDYYTQPGDYYRSLPADEKERLHDTIGESLAHVTHKEIVDKQLEHFKKADPKYAEGVKKALEKHQKMMKDMHGKDMHHTKKKK

SEQ ID NO: 4528 - protein, 145 aa, Bacillus thuringiensis
MRNLFPEITKRQNGIFDFGPSLLEGMTDAFFKPMNMDTFKVDVHEQSDKYTVKADLPGFQKENIQVEFEQDVLTIQATNHNEVEEKNENGTYIRKERSIGSVTRRFSFKQVEEENVRANYKDGVLTIELPKLKEEKNSKTTINIE

SEQ ID NO: 4529 - protein, 263 aa, Unknown
  Polaromonas sp. JS666
MIVERIWTGNAYRNFNYLIACPETGEALAIDPLDHEKTLATARVKGWQITQVLNTHEHHDHTGGNAAVIAATGAKLIAHHKAGGRIAGVDRGVKAGDVIKVGKTVELECLDTPGHTMCHICLRSHTEQPALFSGDTLFNAGAGNVHNGGDVNALYATFAEQLARLPDDTLVYPGHDYIENNLRFTLAREPDNAAAKALLPSVTDHDPAKSAVTTLKDEKEFNTFLRLSSPSVIARLRESFPDLPDEPDARTVFAKLRELRNQW

SEQ ID NO: 4530 - protein, 140 aa, Brassica napus
  misc_feature (132)..(132): Xaa can be any naturally occurring amino acid
TINQKKTAKIKMESFMEELLNFSVPEEEGGAVVRSPKNIARRKTGLRQTESFGLLNPDEDLGEGEVEEEDLEWISNKDAFPVIETFVGVLPSEHFSVSSPEREATEGKQLSPVSVLETSSQNISITTTTTTXNNSSGGSN

SEQ ID NO: 4531 - protein, 178 aa, Zea mays
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAEGMGQQGAYNQGMGYMQPQYHNGDISN

SEQ ID NO: 4532 - protein, 547 aa, Rhodobacter sphaeroides
MAAKDVKFDTDARDRMLRGVNILADAVKVTLGPKGRNVVIDKSFGAPRITKDGVSVAKEIELSDKFENMGAQMVKEVASRTNDEAGDGTTTATVLAQAIIKEGLKAVAAGMNPMDLKRGIDLATSKVVEAIKAAARPVNDSHEVAQVGTISANGEAQIGRFIADAMQKVGNEGVITVEENKGLETEVEVVEGMQFDRGYLSPYFVTNADKMTAELDDVYILLHEKKLSSLQPMVPLLEAVIQSQKPLLIIAEDVEGEALATLVVNKLRGGLKIAAVKAPGFGDRRKAMLQDIAILTGGQVISEDLGMKLENVTIDMLGRAKKISINKDNTTIVDGNGDKAEIDARVAQIRNQIEETSSDYDREKLQERVAKLAGGVAVIRVGGMTEVEVKERKDRVDDALNATRAAVQEGIVVGGGVALIQGGKALDGLTGENPDQNAGITIVRRALEAPLRQIAQNAGVDGSVVAGKVRESNEKSFGFNAQTEEYGDMFKFGVIDPAKVVRTALEDAASVASLLITTEAMIADKPEPKSPAGGPGMGGMGGMDGMM

SEQ ID NO: 4533 - protein, 272 aa, Rhodobacter sphaeroides
MTATLEFHDGSRIPQLGFGLWQVPEDRTAEVVREALELGYRLADGAAIYGNEEGLGHGLRTSGLPRDKVFVTTKVWNDAQGFESALRAVEESLKRLGLDRLDLCLIHWPAPKRNLYVETWRALIRLRDEGRITSIGVSNFDLDQIDRLTAETGVTPVLNQIELHPMLQQAELRAGHAERGIVTQSWSPLGRGMAFETPAIREIAERTGRSPAQVVLRWHIELGCAVIPRSTRRAGLAENLALFDFELTEADHAAISALDAGTRTGPDPQSFG

SEQ ID NO: 4534 - protein, 586 aa, Lotus corniculatus
MCGILAVLGCSDFTQAKRVRVLELSRRLKHRGPDWSGLHQHGDCYLAHQRLAIVDPASGDQPLFNEDKSIIVTVNGEIYNHEELRKQLPNHQFRTGSDCDVIAHLYEEHGENFMDMLDGIFSFVLLDTRDNTFIVARDAIGVTSLYIGWGLDGSVWISSEMKGLNDDCEHFEVFPPGHLYSSRERAFRRWYNPTWFSESIPSAPYDPLAVRHAFEKAVIKRLMTDVPFGVLLSGGLDSSLVASITSRYLATTKAAEQWGSKLHSFCVGLEGSPDLKAAKEVADYLGTVHHEFTFTVQDGIDAIEEVIYHVETYDVTTIRASTPMFLMSRKIKSLGVKWVISGEGSDEIFGGYLYFHKAPNKEEFHTETCRKIKALHQYDCLRANKSTFAWGLEARVPFLDKEFINVAMNIDPEYKMIKRDEGRIEKYILRRAFDDEEKPYLPKHILYRQKEQFSDGVGYSWIDGLKDHAAKHVTDKMILNAGNIFRHNTPLTKEAYYYRMIFERFFPQNSARLTVPGGPTVACSTAKAVEWDAAWSNNLDPSGRAALGVHLSAYDDKQNNLINNKPVEFEKLIPMEAPSLGVAIHS

SEQ ID NO: 4535 - protein, 1081 aa, Candida albicans
MNPTKKPRLSPMQPSVFEILSDPELYSQHCHSLRETLLDHFNHQATLIDTYEHELEKSKNANKAFQQALSEIGTVVISVAMGDLSKKVEIHTVENDPEILKVKITINTMMDQLQTFANEVTKVATEVANGELGGQAKNDGSVGIWRSLTDNVNIMALNLTNQVREIADVTRAVAKGDLSRKINVHAQGEILQLQRTINTMVDQLRTFAFEVSKVARDVGVLGILGGQALIENVEGIWEELTDNVNAMALNLTTQVRNIANVTTAVAKGDLSKKVTADCKGEILDLKLTINQMVDRLQNFALAVTTLSREVGTLGILGGQANVQDVEGAWKQVTENVNLMATNLTNQVRSIATVTTAVAHGDLSQKIDVHAQGEILQLKNTINKMVDSLQLFASEVSKVAQDVGINGKLGIQAQVSDVDGLWKEITSNVNTMASNLTSQVRAFAQITAAATDGDFTRFITVEASGEMDALKTKINQMVFNLRESLQRNTAAREAAELANSAKSEFLANMSHEIRTPLNGIIGMTQLSLDTELTQYQREMLSIVHNLANSLLTIIDDILDISKIEANRMTVEQIDFSLRGTVFGALKTLAVKAIEKNLDLTYQCDSSFPDNLIGDSFRLRQVILNLAGNAIKFTKEGKVSVSVKKSDKMVLDSKLLLEVCVSDTGIGIEKDKLGLIFDTFCQADGSTTRKFGGTGLGLSISKQLIHLMGGEIWVTSEYGSGSNFYFTVCVSPSNIRYTRQTEQLLPFSSHYVLFVSTEHTQEELDVLRDGIIELGLIPIIVRNIEDATLTEPVKYDIIMIDSIEIAKKLRLLSEVKYIPLVLVHHSIPQLNMRVCIDLGISSYANTPCSITDLASAIIPALESRSISQNSDESVRYKILLAEDNLVNQKLAVRILEKQGHSVEVVENGLEAYEAIKRNKYDVVLMDVQMPVMGGFEATEKIRQWEKKSNPIDSLTFRTPIIALTAHAMLGDREKSLAKGMDDYVSKPLKPKLLMQTINKCIHNINQLKELSRNSRGSDFAKKMTRNTPGSTTRQGSDEGSVEDMIGDTPRQGSVEGGGTSSRPVQRRSATEGSITTISEQIDR

SEQ ID NO: 4536 - protein, 1559 aa, Nostoc punctiforme
MKAPLPDNEIQRIESLLEYKILDTHSEAAFDDLTHLASYICGTPIALISLIDSDRQWFKSKVGMEALETPRDLAFCAHAILQPEVFVVPDATQDERFATNPLVTSDPDIRFYAGVPLTNPEGYALGTLCVIDRVPRNLSPEQVEALRIIGRQVIKQLEMRRNLASLVLVTHTRKQAHKRRKQFFKTVAGGFGLASAILVLIGVISYQNTRILIDASNQVQKTQGKINKLEELLSEMKDAETGQRGYILTGQESYLEPYQAVVVNIDQKIVELKDLIADQPSQQNQFAALESLIAAKFAILKQTIYLRQNQGFEAALQVIQTNHGKYIMDDIRKVIHEIENEDKRLLQQQSQAAKASANNTVLTLAIAICLGFITLAIVYYFIYREVKERKLTEETLNQERNFISAVLDTASALVIVLDTQGQIVRFNQACEQTTGYSFDEVRGRHFWNLFLIPEQVEPVKAVFEQLRTGEAPKEYENYWVAKDGSLRLISWANAILQDHEGCVEYIVATGIDISDAYDELRLRKRAEQHLKAQYSTTRVLAESTTISEAMPQILQGICESLEWDLSEIWMVNQRVNLLSLLNSWYKMSSEMQEFEILSQQIIFAPGIGLPGRVWVSSEPVWIVDVVKDKDFIRSQMAVQAELHGAFGFPIHSGKKILGVITCFSHEIQQPDPDLAKVMNSIGEQVGQFIERKQAEEELQRQNLRSQLFTEITLKIRQSLKIQEILQVSVTEVQKILHSDRVLIYQPLTDGSGSTVVEAVVSGWLTIKEKKLTDSYFQAEYTQQYYLQQYRQKRNLELADLDIVEIQKRHIELLQQFGVKSNLVIPILVKEELCGLLIVHQCGSSRQWSSFETHLLRQIADQVGIALAQAQMLYAETQQRRELEVARHQAELASKTKSAFLANMSHEIRTPMNAVLGMTGLMLETPLNSEQQDFIETIRISGDALLSLINEILDLSKLEAGEMALETLDFDLSTCLEEVLELLAPSAHNKGLEIAALIYPNVPTQLQGDAGRLRQILMNLISNAIKFTSNGEVVVRAELRSLSSTTATIYFAITDTGLGITFEDQCRLFTPFTQVDASNTRKYGGTGLGLAICKQLVSLMGGEIGVESRLGKGSKFWFEVTFAQQLYPISSESERELLINRRLLVVDDNATNRKIIHHQATRWGMLVDQAASATIALKAIEETAKQKNLYDIAVIDMHMPEVDGMTLGEQIKANSAIAGLPLIMLTSTNQRDEIQRALKIGFAAYLVKPVKPSRLLDTIMTILGTQIKEETEVRSQEFKLKDYENNSNDHSSSSRLLARDFHKLRILLAEDNLVNQKVALKQLQSLGYSADVAGNGKEVLQLLEKIPYDLILMDCQMPVLDGLETTKEIHRWQESSFVSSRRPVVIAMTANAMKEDQQMCLDAGMDDYLSKPVIKEKLAAALQRWGSVIFQAKEIYVLEQKKGSKTDVGSVDLPIDWERLHQLSENNPEFELELLEIFVEDMQPRLEIIKIAIADNDYEQLALQTHQIKGASANVGATTMHLAAQKLEQLAHNQERRGTTHLISELEDFVKCIQEFLITR

SEQ ID NO: 4537 - protein, 586 aa, Lotus corniculatus
MCGILAVLGCSDDSQAKRVRVLELSRRLKHRGPDWSGLHQHGDNFLAHQRLAIVDPASGDQPLFNEDQSIIVTVNGEIFNHEELRKQLPNHKFRTGCDCDVIAHLYEEHGENFVDMLDGIFSFVLLDTRDNSFLVARDAIGVTSLYIGYGLDGSVWIASELKGLNDDCEHFELFPPGHLYSSKEKEFRRWYNPPWFSEAIPSAPYDPLALRQAFEKAIIKRLMTDVPFGVLLSGGLDSSLVASVTARYLADTKAAKQWGSKLHSFCVGLEGAPDLKAAREVADYIGTVHHEFQYTIQDGIDAIEDVIYHVETYDVTTIRAGTPMFLMSRKIKSLGVKMVLSGEGSDEIFAGYLYFHKAPNKEELHQETCSKIKALHKYDCLRANKSTYAWGLEARVPFLDKKFIDVAMGIDPENKMIKRDEGRIEKWVLRKAFDDEENPYLPKHILYRQKEQFSDGVGYGWIDGLKDHAAKHVTDKMMLNASNIYPFNTPNTKEAYYYRMIFERFFPQNSARLSVPGGASIACSTEKAIEWDAAWSNNLDPSGRAALGVHDSAYDDQLNKSVSKGVEPEKIIPKMEVSPLGVAILS

SEQ ID NO: 4538 - protein, 327 aa, Glycine max
NEVNFFVCDENVESRFKMPEKSIPKDAAFQIINDELMLDGAPRLNLASFVTTWMEPECDKLIMASLNKNYVDMDEYPVTTELQNRCVNIIANLFHAPISEEETAVGVGTVGSSEAIMLAGLAFKRKWQTKRKAEGKPYDKPNIVTGANVQVCWEKFARYFEVELKEVKLKEGYYVMDPAKAVEMVDENTICVAAILGSTMTGEFEDVKLLNELLTEKNKETGWDTPIHVDAASGGFIAPFLYPDLEWDFRLPLVKSINVSGHKYGLVYPGVGWVVWRSKDDLPDELVFHINYLGSDQPTFTLNFSKGSSQIIAQYYQLIRLGFEGYK

SEQ ID NO: 4539 - protein, 375 aa, Bacillus cereus
MTSSNNKAASIYEGTNVNAGGSFVSIEETKIFNPIQIGSWPLRNRIAMAPMTRCFADNETGAVGADVVEYYRKRAADGVGLIITEGIVISARAKGNPGVPGIYTQEQIDSWKPVTEAVHKEGGTIIAQIWHVGRMSHHEIIGGKMPQAPSAIAAEGNVPRFRKPFDTPEAMTLEEIQEVISQYAQAAKNAIEAGFDGVEIHGAHGYLIDQFTYEFANKRTDKYGGDLKQRLTFMKEVTEAVIEAIGADKTLLRFSAFKGDNPTYMWENPELAIETFVNMFKEVGLTMIHPSTMSYTQVIADGKNFHQLVRKYWDGAIVGVGNLNPKEAEEALQEGTIDVAAFGRPLIANPDFVHRIKSAESLVEYDAKEHLATLI

SEQ ID NO: 4540 - protein, 249 aa, Unknown
  Fragaria x ananassa
MGRGRVELKRIENKINRQVTFAKRRNGLLKKAYELSILCDAEVALIIFSNRGKLYEFCSSSSMLKTLERYQKCSYGAMEVQKPAKELEESSYREYLKLKTRCESLQQTQRNLLGEDLGPLNTKELEQLERQLESSLKHVRSTKTQHMIDLLSDLQSKEHMLIEANRDLKTKLDEIDSRTQLRQTWEHGHDHQTMLYGTQHAQTQGLMFQPLDCNPTLQIGYNAVVSQEMPAATPAHAQPVNGFIPGWML

SEQ ID NO: 4541 - protein, 590 aa, Pseudomonas syringae
MCGLAGELRFDHQPADLAAVERITHELAPRGPDAWGFHSQGPVALGHRRLKIMDLSDGSAQPMIDSHLGLSMAFNGAIYNFPELRAELESLGYQFHSGGDTEVLLKGYHAWGADMLPKLNGMFAFAIWERDSKQLFIARDRLGVKPLYLSKTDKRLRFASSLPALLKGGDISGMLDPVALNHYLNFHAVVPAPRTLLAGVEKLPPASWMRIDASGKVEQKVWWTLPYGPHDDEKNLTLEDWRDRVLDSTREAVAIRQRAAVDVGVLLSGGVDSSMLVGLLREVGVEDLSTFSIGFQDAGGERGDEFQYSDLIAKHYGTRHHQLRIQESEIIEQLPAAFRAMSEPMVSHDCIAFYLLSREVSKHCKVVQSGQGADELFAGYHWYPQVDGASDPVAAYRDAFVDRSYAEYAETVQPKWRTPNDAAGDFVRDHFAQPGASAAVDKALRLDSTVMLVDDPVKRVDNMTMAWGLEARTPFLDYRLVELSARIPGKFKLPDGGKQVLKEAARLVIPSEVIDRKKGYFPVPGLKHLQGDTLNWVRELLTDSSQDRGLFNPAMVDKLLTNPEGQLTPLRGSKLWQLAALNLWLSEQGL

SEQ ID NO: 4542 - protein, 275 aa, Francisella tularensis
METQSNKLTIVAFAIMHLACLAIFFVNYNITALVVFVVTFSARTFALTAGYHRYFAHKAFQTSRVFQFILALVGTWASQKGPLWWSGHHRYHHIHSDKDTDLHSPKNGIFQSHVGWVFESRSDHVDPKFTKDWVKYPELVWIDKYAHVSFALYLVGLFALGSLISHFYPSLETSGLAFVFWGGILSTVLLYHTTFSVNSICHIFGSKDYETDNSCNNWFIALITFGEGWHNNHHKFAYSVRNNLKVWQIDITYMILCVLRKFRIVWDFKQPKKTI

SEQ ID NO: 4543 - protein, 169 aa, Bdellovibrio bacteriovorus
MSNIPGVCVSPDKETQKYVFNHTMLRIKDPKASLDFYTRVLGMKLVRKLDFAEWKFSLYFLAYVPEGTDVPTENEANARYAFGREAVLELTHNWGTEEQETTPYHNGNTEPRGFGHICISVPDIQQACARFESLGVNFQKRLGEGGMKNIAFVKDPDQYWIEVVQPGLL

SEQ ID NO: 4544 - protein, 878 aa, Bdellovibrio bacteriovorus
MFQRLLKNWAVQIFLIFVLYYLTGRLGLLLALPPGYASLVWPPFGISIAALLLLGINRWPGVLIGAFLVNARHMESISNLLLPLGISMGNTISVIVAALLIRRFLHFPKRFYLEREVILFLFLAGPVAALLSASAGVGLLYLNDVVSQKNASMNWIYWFVGDAIGGLIFAPLALMFSTQSRRYWLKSVTKVLVPVCVAFALILSASQYLTLSEQEKQSAEFTRKAEFTFNVLEKDFNGNIDMLESLKSFFDSSTSVTRQEFRDFSSTLHSRRPEVQALAWIPYNQDKPETLRIEYIEPLPTNSQVLGTDFGTHPDRQALLKKALEKRRLITSGPMNLREFYPQARGIFLLLAIGRPEGVLLEVLRLDGILRDLTGVLNDPSYRVLIEDVTQTSNRELMVDTLSGGRDFHADFRWSSHLEIGDRLWEVTIQQDTSLRQGSAFNTAVFLLTSLVFVFLICTLLLTIANRIITVEEIVDEKTQHLIDLNVQLKKASETKSEFLANMSHEIRTPLNVIVGMSDLLEESPLNEDQKHYVDISKKAGHNLLSIINDILDISKIEAGLLTLEKTEVDLHSLVNDITEMFELKAREKNLELSVYLSEDTHSIFMGDPTRIRQVLSNLISNSLKFTTDGSIRVEVMKNQTEMEGNLIFHVSDTGIGIPRDKIPQLFQPFTQADSTITRKFGGTGLGLSISKRLVKMMNGDITVESELHRGSRFSFSLNLPWLRDVPAEGEHTAEEISQVPTGPAAEQEPLSILIVDDTEDNRLLIKAYLKNTPHQISEACNGRQALELAQKQRFDLILMDMQMPVMDGFTATQKIRKWEQDHQRPASTIWALTAFALKNEIDRSLSVGCNLHLIKPLRKADLLNHIQKLSEERHQHR

SEQ ID NO: 4545 - protein, 648 aa, Desulfitobacterium hafniense
MAWVGEDNALQVQDIKMQSKIQKDSPLLTQEEMYLFNCGEFYYSYRKLGAHFLEHKGRWGTYFAVWAPQARQVSVVGDFNGWCGMNHSLQKWEEQGIWTLFIPGLPTGEIYKYEILNSSGESVLKADPYAFFSEVRPHTASVIYSLEDYAWGDQAWLAQRKTRNPKVLPLSSYEIHLGSWRRTEDGRFLNYAQLVTVLIPYVKSLGYTHIEILPLMEHPYDGSWGYQITGFYACTSRYGTPHDLMYLIDQCHQAGIGVILDWVPGHFCMDAHGLGKFDGSPLYEREVHEQWGTYKFDYSRSEVRSFLISNAVFWLDVFHVDGLRVDGVSSMLYLDYGKEKGAWQPNRYGGRENLEAVGFIKQLNATLHGLYPDALLIAEEATDWQGVTGPLDQEGLGFTFKWNMGWMNDTLRYIGLDFNERRSFHQLLTFPMMYAYAESYILPLSHDEVVHGKKSLLDKMPGDYGQKFAGLRGLTTYFMTSPGKKLLFMGGEIPQFIEWREDRELDWFLMDYELHRKYHGFVQQLNGLYLREKALWEIDGDWTGFEWIDVHNHEQGVIVFCRKGKSFQDRLVVLINFQPYNYERYRIGVEMAKGYREILNTDSTDFGGWGMTNPGLLKVEGVPWHGREFSLEIRVPALGAMILKPELA

SEQ ID NO: 4546 - protein, 210 aa, Papaver somniferum
MSIIPSFFSNQRSNVFDPFSLDIWDPFQGFPFSTGALTANWQGGSDTARETSQLANTRIDWKETPEAHVFRADLPGVTKEEVKVEVEEGRVLQISGERRSRESEEKNDKWHRVERSSGKFLRRFRLPENTKMDEVKATMENGVLTVCVPKVEQRRPEVKSIEISGASEGSTQVPMETPVLRLHKTRLLRDVAMTGNLQASYVVSCLVLFS

SEQ ID NO: 4547 - protein, 438 aa, Chenopodium quinoa
MATAVSTVGAATKAPLNLNGSSAGASVPTSAFLGSSLKKHTSVRFPSSSRASSMTVKAADYEESKQSNTDRWAHLATDISDDQLDIRRGKGMVDSLFQAPMDSGTHVPVQSSLEYESQGLRKYNIDNMLGNFYIAPSFMDKIVVHITKNYLNLPNIKVPLILGIWGGKGQGKSFQCELVFAKMGINPIMMSAGELESGNAGEPAKLIRQRYREAADIIAKGKMCALFINDLDAGAGRMGGTTQYTVNNQMVNATLMNIADNPTNVQLPGMYNKQENARVPIIVTGNDFSTLYAPLIRDGRMEKFYWAPTREDRIGVATGIFRTDNVPEDHVVKLVDTFPGQSIDFFGALRARVYDDEVRKWVSEVGIDAVGKKLVNSRDGPPVFEQPKMTLEKLLEYGNMLVQEQENVKRVQLADKYLSEAALGDANKDAIASGAFFG

SEQ ID NO: 4548 - protein, 307 aa, Burkholderia pseudomallei
MGSRRNLVTTASTMTVEGFFDPATCTISYLLFDSGSGECALIDSVLDYDPKSGRTRTASADQLIARVAALGARVRWLLETHVHADHLSAAPYLKTRVGGEIAIGRHVTRVQDVFGKLFNAGPAFAHDGSQFDRLLDDGDTLALGALSIRAMHTPGHTPACMTYVVTEAHAAHDARDAAAFVGDTLFMPDYGTARCDFPGGDARSLYRSIRKVLSLPPATRLYMCHDYQPNGRAIQYASTVADELRENVHIREGVTEDDFVAMRTARDATLDMPVLMLPSVQVNMRAGRLPEPEDNGVRYLKIPLDAI

SEQ ID NO: 4549 - protein, 460 aa, Bifidobacterium breve
MTMIFPKGFMFGTATAAYQIEGAVAEGGRTPSIWDTFSHTGHTLNGDTGDVADDFYHRWEDDLKLLRDLGVNAYRFSIGIPRVIPTPDGKPNQEGLDFYSRIVDRLLEYGIAPIVTLYHWDLPQYMASGDGREGGWLERETAYRIADYAGIVAKCLGDRVHTYTTLNEPWCSAHLSYGGTEHAPGLGAGPLAFRAAHHLNLAHGLMCEAVRAEAGAKPGLSVTLNLQICRGDADAVHRVDLIGNRVFLDPMLRGRYPDELFSITKGICDWGFVCDGDLDLIHQPIDVLGLNYYSTNLVKMSDRPQFPQSTEASTAPGASDVDWLPTAGPHTEMGWNIDPDALYETLVRLNDNYPGMPLVVTENGMACPDKVEVGTDGVKMVHDNDRIDYLRRHLEAVYRAIEEGTDVRGYFAWSLMDNFEWAFGYSKRFGLTYVDYESQERVKKDSFDWYRRFIADHSAR

SEQ ID NO: 4550 - protein, 548 aa, Oleispira antarctica
MAAKDVLFGDSARAKMLVGVNILADAVRVTLGPKGRNVVIEKSFGAPIITKDGVSVAREIELKDKFENMGAQMVKEVASQANDQAGDGTTTATVLAQAIISEGLKSVAAGMNPMDLKRGIDKATAAVVAAIKEQAQPCLDTKAIAQVGTISANADETVGRLIAEAMEKVGKEGVITVEEGKGLEDELDVVEGMQFDRGYLSPYFINNQEKMTVEMENPLILLVDKKIDNLQELLPILENVAKSGRPLLIVAEDVEGQALATLVVNNLRGTFKVAAVKAPGFGDRRKAMLQDLAILTGGQVISEELGMSLETADPSSLGTASKVVIDKENTVIVDGAGTEASVNTRVDQIRAEIESSTSDYDIEKLQERVAKLAGGVAVIKVGAGSEMEMKEKKDRVDDALHATRAAVEEGVVAGGGVALIRALSSVTVVGDNEDQNVGIALALRAMEAPIRQIAGNAGAAGAAVVDKVKSGTGSFGFNASTGEYGDMIAMGILDPAKVTRSSLQAAASIAGLMITTEAMVADAPVEEGAGGMPDMGGMGGMGGMPGMM

SEQ ID NO: 4551 - protein, 155 aa, Laccaria bicolor
MSVFYYEPYYDFDRLLDGIFTPRTARNGVHKRALQSDATPEGAVRALKPRMDLHEDKEKNLVTATFEFPGSKKEDVHLEIHNGRLVVSVENKISEEHDESGYAVRERRYGKFSRTLQLPQGVKDDEIKAGMEDGVLTVTFPKSGAELAPKKISIS

SEQ ID NO: 4552 - protein, 592 aa, Bacillus thuringiensis
MAETLAKRGPDDNKVWIKGNVAFGHKRLIVVDPEGGKQPMTCLKDEANYAICYNGELYNTEDIRKELLRRGYTFKGHSDTEVLLASYIEWKEECVDHLNGIYAFAVWDEQKEQVFIARDRLGVKPLFYKYDSGRLLFGSELKAILAHPDVKAEVTLEGLSEIFGLGPSRTPGHGIYAGIKELRPGHAMTFSKNGLCIWRYWNVESKKHEDSFEETVEKTRFLLQDAITRQLVSDVPLCTFLSGGVDSSAITAIAAKEYERSGKGQLHTYSVDYEDNDKYFKANAFQPNSDAPFIHLMTETFQTIHHRCVISNEQLAQYLTEAVLVRDLPGMADIDSSLLWFCREIKQDFVVGLSGECADEIFGGYPWFYREDDLQSSAFPWMRSTEAREQLLKKEWRNKLNLQQYVQQRYEESIQEVPILDGESPLEAKRRQLFYLNMVWFMTTLLDRKDRMSMGASLEVRVPFADHRLVEYAWNIPWEMKMYKNREKGLLRKALEGLLPNEILYRKKSPYPKTHNPHYTKAVTVWIQDLLTDKGSILHELFDKEQLSGLIESGGSAFQTPWYGQLMTGPQLLAHLAQIHVWFKEYGVNIKE

SEQ ID NO: 4553 - protein, 548 aa, Oleispira antarctica
MAAKDVLFGDSARAKMLVGVNILADAVRVTLGPKGRNVVIEKSFGAPIITKDGVSVAREIELKDKFENMGAQMVKEVASQANDQAGDGTTTATVLAQAIISEGLKSVAAGMNPMDLKRGIDKATAAVVAAIKEQAQPCLDTKAIAQVGTISANADETVGRLIAEAMEKVGKEGVITVEEGKGLEDELDVVEGMQFDRGYLSPYFINNQEKMTVEMENPLILLVDKKIDNLQELLPILENVAKSGRPLLIVAEDVEGQALATLVVNNLRGTFKVAAVKAPGFGDRRKAMLQDLAILTGGQVISEELGMSLETADPSSLGTASKVVIDKENTVIVDGAGTEASVNTRVDQIRAEIESSTSDYDIEKLQERVAKLAGGVAVIKVGAGSEMEMKEKKDRVDDALHATRAAVEEGVVAGGGVALIRALSSVTVVGDNEDQNVGIALALRAMEAPIRQIAGNAGAEGSVVVDTVKGGTGSFGFNASTGEYGDMIAMGILDPAKVTRSSLQAAASIAGLMITTEAMVADAPVEEGAGGMPDMGGMGGMGGMPGMM

SEQ ID NO: 4554 - protein, 385 aa, Zea mays
MVLSHASSGRDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTDKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEVLLFFDRFFLLLIEHSEYICAGEQKGVLSDTLLEGVSFLFQFSLVL

SEQ ID NO: 4555 - protein, 281 aa, Lactococcus lactis
MTLTDTYTLNNGIKIPKVGFGTWQSASGEEAYNAVKAALEAGYRHIDTAAVYKNEESVGQAIADSGIPREELFVTTKLWGVGTTEDAAKALDESLKKLGLDYVDLYLIHWPNPKAFRPDFETRNLAVWKAMEAGVKAGKIRAIGVSNFHPRHLKPLLKFAEIKPAVNQIMVNPSDQQEEIVSFNVDNNILTEAYSPLGTGKIFEVPELADLASKYNKSIAQVVLRWSLHKGYLPLPKSVTPARIKENAEIFDFDLSIEDIAFIDSLHGKAGLAKNPDEVDF

SEQ ID NO: 4556 - protein, 441 aa, Arabidopsis thaliana
MNRRQQVKRRVGKYEVGRTIGEGTFAKVKFARNSETGEPVALKILDKEKVLKHKMAEQIRREIATMKLIKHPNVVQLYEVMASKTKIFIILEYVTGGELFDKIVNDGRMKEDEARRYFQQLIHAVDYCHSRGVYHRDLKPENLLLDSYGNLKISDFGLSALSQQVRDDGLLHTSCGTPNYVAPEVLNDRGYDGATADMWSCGVVLYVLLAGYLPFDDSNLMNLYKKISSGEFNCPPWLSLGAMKLITRILDPNPMTRVTPQEVFEDEWFKKDYKPPVFEERDDSNMDDIDAVFKDSEEHLVTEKREEQPAAINAFEIISMSRGLNLENLFDPEQEFKRETRITLRGGANEIIEKIEEAAKPLGFDVQKKNYKMRLENVKAGRKGNLNVATEIFQVAPSLHMVQVSKSKGDTLEFHKFYKKLSNSLEQVVWTNNEVKKETAK

SEQ ID NO: 4557 - protein, 259 aa, Unknown
  Vibrio sp. Ex25
MGDGERIVLEIKSIPAFNDNYIWLIQNSDKRCAVVDPGDAKPVLEYLQANELTLEAILITHHHNDHIGGVPDLVRAFPEVAVVGPKSEPIPTLTTPMEEGDKLELFGEIFLVLGLPGHTLGHIGYVGDGKLFCGDVLFSAGCGRIFEGTPEQMFESLNKLTSLPEETQVFCAHEYTASNVAFALAVEPDNEQLRQYRDDVNRLRALNIPTLPTTIRKEKWINPFLRTTNPDVVQSVASRIKNSDPCSVFTALREWKNEF

SEQ ID NO: 4558 - protein, 86 aa, Daucus carota
  misc_feature (45)..(45): Xaa can be any naturally occurring amino acid
  misc_feature (72)..(72): Xaa can be any naturally occurring amino acid
MKKVGEKAETHHTLVPMRKAFHGTFIVAGGYDREDGNTAVAENCXDLVAYGRQFLANPDLPKRFELNAPLNXYDRNTFYISDPVVG

SEQ ID NO: 4559 - protein, 253 aa, Glycine max
  misc_feature (196)..(196): Xaa can be any naturally occurring amino acid
  misc_feature (235)..(235): Xaa can be any naturally occurring amino acid
  misc_feature (239)..(239): Xaa can be any naturally occurring amino acid
ARGGDSTSLLSPYLHFGELSVRKVFQVTRMKQILWTNEGNSAGEESVNLFLRAIGLREYSRYLCFNFPFTHEKALLGHLKFFPWNPDADIFKNWRQGRTGFPLVDAGMRELWATGWIHNRIRVIVSSFAVKMLLLPWKWGMKYFWDTLLDADLESDILGWQYISGGLPDGHELERLDNPEIQGVKFDPEGEYVRQXLPELARMPTEWIHHPWDAPLTVLRAAGVELGQNYPKPIXDIDXARERLTEAIFKMWE

SEQ ID NO: 4560 - protein, 209 aa, Bacillus cereus
MKWIQMPLGPLQTNAYILKNDQNECVIFDPGHEGEKLVTYLQEEQLKPLAVLLTHAHFDHIGAVDTVRDAFHIPVYVHKEEEDWLGDATVNGSQIFMMNRSITAKPADHIIDAEGTLAIGSFNFEIFETPGHSPGSISYYCKEASAVFSGDVLFQMSIGRTDLPGGSFAELIGSIEEKLFVLPDETAVLCGHGPETSIGFEKENNPFLQ

SEQ ID NO: 4561 - protein, 575 aa, Glycine max
MYRFATSLASKARIARSSTQQIGSRVSWNRNYAAKDIKFGVEARALMLKGVEELADAVKVTMGPKGRNVVIEQSFGAPKVTKDGVTVAKSIEFKDKVKNIGASLVKQVANATNDVAGDGTTCATILTKAIFTEGCKSVAAGMNAMDLRRGINMAVDTVVTNLKSRARMISTSEEIAQVGTISANGEREIGELIAKAMEKVGKEGVITISDGKTLYNELEVVEGMKLDRGYISPYFITNDKNQKCELEDPLILIHEKKISSINAIVKVLELALKRQRSLLIIAEDVESDALATLILNKLRAGIKVCAIKAPGFGENRKANLQDLAVLTGGALITEELGLKLEKVDLDMLGTCKKITVSKDDTVILDGAGDKKALEERCEQIRSAIENSTSDYDKEKLQERLAKLSGGVAVLKIGGASEAEVGEKKDRVTDALNATKAAVEEGIVSGGGVALLYASKELDKLQTANFDQKIGVQIIQNALKTPVLTIASNAGVEGAVVVGKLLEQENHDLGYDAAKGEYVDMVKAGIIDPLKVIRTALVDAASVSSLMTTTEAVVSELPNDDKDTPAMAGGMGGMGY

SEQ ID NO: 4562 - protein, 474 aa, Clostridium acetobutylicum
MNNFGEDFIFGGATAAYQAEGATKEDGKGPCIWDEYLKKEGRFTGDTASDFYHKYKEDLKFSRKFGVNGIRISIAWSRVIPDGKGEVNPKGLKFYSDLIDECIKNNVEPFVTLHHFDTPLTLFKDGDWLNRNNIDYFVRFAKVCFEALGDRVKKWITFNEAWAVAQNGYIIGNFPPSIKYDIPKAAQSMHNMMVAHAKVVELYKSMNLDGEIGIVHTLEGKYPITDSKEDKEAAYLDYMISNKFMLDACFKGEYPKETEKTINEIMSKNGGELKIYDGDLEVLKKASSKIDFLGMNYYSSHFLKAYEGESRIHHNGTGEKGTSIFALKGIGERVNNPEVPTTDWDWPIYPKGLHDMLVRIKNEYPNYKKIYVTENGMGYKDDFKDGKIDDTPRIDYINKHLEAILKAKNEGVVVKGYFVWSLMDVLSWSNGYNKRYGLFYVDFKTQNRYAKKSAYWFKRISYEKKLIDFSDIEY

SEQ ID NO: 4563 - protein, 362 aa, Cytophaga hutchinsonii
MKTSNLFEPLKIGSISLKNSIVMAPMTRCRAIGNIPNDLMATYYGQRATAGLIITEGASPSPNGLGYARIPGIFNKEQVEGWKKITTAVHDKGGKIVIQLMHTGRISHPANMPEGASILSASSVKPGGQMWTDSLQMQDYPIPKTMTVEEILQTKEEFVTAAKNAIEAGFDGVELHGANGYLLEQFISPHTNMRGDEYGGGIDRRCKFVLDVVEAVAAAIGKDKTGIRLSPYGVASDMPPYPDIEVTYEYLALALNDLGIDYIHVVDHSAIGAPAVPLSIKEKIRAGFSNTIILCGGFDQAAAERAIDTGLTNAVAFGRPFINNPDLVERLKNNQPLSDKLNTDAFYSADEKGYTDYPVFGG

SEQ ID NO: 4564 - protein, 595 aa, Dunaliella tertiolecta
MASVDCTLVSARGIKDVEIVGKQSPYAVLTVGPKTFKSGTANGGGSDPVWNQTFSFTNVTPDSSVKLEIFNSNVVLRDVAIGGCKAPMDKALSAGKDELTLPIITKKGKPHGEVKLILTLKPDATKQMVTSHKTRKAAGAWILPTYGNTDCWKDYEPGTLLGKGTFGTTYLATEKKTGQKCAVKVISKRKLTTPDEVDDVKKEVQIMHHLAGHPNVVGLKGVYEDKSNVCLAMEVATGGELFDSIVKRGHYSERDAAELIRTIVSVVAHCHNMGVIHRDLKPENFLLSDKSPRAQLKATDFGLSSFFQEGQVFTDIVGSAYYVAPEVLRRSYGKEADIWSCGIILYILLCGFPPFHGDSEKKIFEAIISKSVDFNTQPWPRISAPAKDCVKRMLQRDPKKRATANEIMQHDWMRENGVASDEPLEMEVVSRIKNFSGMNKLKKEALKVIAVNLPIDEISGMREMFMDIDKDKSGNITIDEFAAALHKKGQIVTEKEIEKIMKEADVDGDGTIDYEEFLAATINLGKLQREENLKTAFEHFDLDGNGEISHNELVQCLSKLGINDAHVKDIIKEVDADGNGQIDYNEFCIMMRNLD

SEQ ID NO: 4565 - protein, 275 aa, Bacillus cereus
MHIPTTTLHNGVKMPMIGLGVYKAKEGDEVKQAVKTALEVGYRSIDTATVYENESGVGEAIRESGIPREDIFITTKVWNDDQGYEETLEAFEKSLKKLQMDYVDLYLIHWPVRGKYVDTYRALEKLYEEGKVRAIGVSNFHKHHLELLLPNCKVKPMVNQVELHPMLTQFELRNYCQDEQIQMEAWSPLMRGGEVFQHPIIQAIANKYEKTPAQVILRWDIQSGIVTIPKSVTPSRIKENFTIFDFALTEEEIRQINTLNRDLHVGTNPDKYDTL

SEQ ID NO: 4566 - protein, 629 aa, Methylobacillus flagellatus
MTLQLHIDDKPDAKPHAPEGESTHFRSLPAGAHIVQPGKVRFRIWAPNAEKVWVVLSGLQSDDEPPALQEHEMAADAKPGWFSREIAADAGSRYRYRILNKQGHELTVPDPWSRAQADSVHGDSIVVDPQAYTWRHSGWAGRPWHESVVYEAHVGCLGGFEGLRAQLPQLAAMGFTAIELMPIASFPGERNWGYDGVLQFAPQFSYGSPDQLKTLVDEAHGLGLSIYLDVVYNHFGPEGNYLAHYAPQFFCHEHQTPWGDAIDFAQQEVIEFYGENALYWLEEFQFDGLRFDACHAIWDPAFLVSIAGRIRTEFHGKRHIHLIAENDHNSVTLLQNGYDAQWNDDGHHALHVLLTGETGGYYSDYADNTIEQLARCLGEGFIYQGEISAHRHNSPRGEPSSEMPPSSFVLFLQNHDQIGNRAFGERLITLVPEPALKVATALLLLSPQVPMLFMGEEFGATEPFLYFTSHSDPGLTHAVREGRRAEFAVFPQFQDTSLVERLPDPNAESSFEQSIPRDRQTKAQAAWRAWVTHLLHLRHEHLLPHLGHCRALRYAAFGTHAVHAQWQLENGDMLTIAANLGAVNAARHLDQLVSGPAQILLDHGNAHAALQAGEMPACSIFVCLEHPQA

SEQ ID NO: 4567 - protein, 252 aa, Zea mays
  misc_feature (219)..(219): Xaa can be any naturally occurring amino acid
PSTSRLPALPQKKTARLLLLLRRAGITCGILAVLGCSDWSQAKRARILACSRRLKHRGPDWSGLYQHEGNFLAQQRLAVTKRHLVETEAAEKFGTELHSFVVGLEGSPDLKAAREVADYLGTIHHEFHFTVQDGIDAIEEVIYHDETYDVTTIRASTPMFLMARKIKSLGVKMVLSGEGSDELLGGYLYFHFAPNKEEFHRETCRKVKALHQYDCLRAXKATSAWGLEVRVPFLDKEFINVAMGMDPEWKMY

SEQ ID NO: 4568 - protein, 543 aa, Glycine max
  misc_feature (295)..(295): Xaa can be any naturally occurring amino acid
  misc_feature (448)..(448): Xaa can be any naturally occurring amino acid
MASISHFRTSANSFLSQYEPLSLLLAPLLSLLFAHALRSFFHLLSQNGLKATLLGFLINSLKLVPGVKGYIDAEKQKVVDKLQSDGKSKREGWKTELPSTGLGTSVLEKMREEKINDAVWQGKCSGTVYIGGSESDGHFSLINEACSMFAHTNPLHLDVFKSVARFEAEVVAMTAALLGSKEKSSGRQICGNMTSGGTESILLAVKSSRDYMKSKKGITRPEMIIPESGHSAYDKAAQYFNIKLWRVPVNKNFQADVKAIRRHINKNTILIVGSAPGFPHGVIDPIEIIWQFLPXELGHLASSFGICFHVDLCLGGFVLPFARELGYHIPPFDFSVKGVSSISVDVHKYGLAPKGTSVVLYRNHEIRKHQFVAVTEWSGGLYVSPTIAGSRPGSLIAGAWAAMMSLGKEGYLKNTKAIMEGSRRIQKGIEEIAELFIVGKPDMTIGAXGSAVLDIFEVNDVMSSKGWHLNALQRPNSIHICVTLQHVPIVEDFLNDLKESVKTVKANPGPISGGLAPIYGAAGKMPDRGMVQELLVDYMDGTC

SEQ ID NO: 4569 - protein, 517 aa, Magnaporthe grisea
MVHLTSIPSHEEADDKIVSGVKKVHLQLANDEDKFTTSVYGSRFAIDDLPKHEMAENEMPKEVAYRMIKDELSLDGNPMLNLASFVTTYMEEEAEKLMADSFSKNFIDYEEYPQSADIQNRCVAMIGRLFNAPVGASEGVGAVGTSCVGSSEAIMLAVLAMKKRWKNKRLAEGKSVDKPNLIMSSAVQVCWEKATRYFEVEEKLVYCSPDRYVIDPKETVDLVDENTIGICVILGTTYTGEYEDVRAVNDLLNERGLETPIHVDAASGGFVAPFVVPDLEWDFRCDRVVSINVSGHKYGLVYPGVGWVVWRSAEFLPQELVFNINYLGADQASFTLNFSKGASQVIGQYYQLIRLGKHGYRAIMSNLTRTADYLSDSLEALGFGIMSKKSGEGLPLVAFRLTPDEDRIYDEFAIAHQLRVRGWVVPAYTMAPHTENLKMLRVVVREDFTRNRCDALIADVKLSLELLNQMDKKELERHQDVIHKHGTHSGKASHNHPRFRKEKHSLQGKHGKTHAVC

SEQ ID NO: 4570 - protein, 484 aa, Momordica charantia
MVLQSSNNAKKLLSKLATGNGHGEDSPYFDGWKAYDSDPFHPTLNPRGVIEMGQAENQLSFGFVEKWMRNNPQASICTAEGIDEFKDVDIFQDYHGLPEFRNAVANFMGKVRGDRVKFDPDRVVMSGGATGAHETVAFCLADPGEAFLVPVPYYPGFDRDLRWRTGVEIVPVICESSNNFRLTREALETAYEEAQKSDTKIKGLLITNPSNPLGTVYDRETLETAVAFINDKNIHLVCDEIYAATVFAEPGFVSISEVIENDPSCDRNLIHVVYSLSKDMGFPGFRVGIIYSYNDAVVSCARKMSSFGLVSSQTQHMIASMLSDDEFVESFLVGSAEKLAARHRSFTKGLAQVGIGYLQGSGGLFLWMDLRHLLKEKTLEAEMALWRVIINEVKLNVSPGSSFHCSEPGWFRVCFANMDDKTMDISITRIRTFVLQNKEATKIKKHKFCWRQSSLELRLSSRRLEDIMSPHSPLPQSPMLRATT

SEQ ID NO: 4571 - protein, 389 aa, Oryza sativa
MEGNARGGGHSEALKNYNLGRTLGIGSFGKVKIAEHKLTGHRVAIKILNRRQMRNMEMEEKAKREIKILRLFIHPHIIRLYEVIYTPTDIYVVMEYCKFGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVDPMKRITIREIREHQWFQIRLPRYLAVPPPDTAQQAKMIDEDTLQDVVNLGYEKDHVCESLRNRLQNEATVAYYLLLDNRFRATSGYLGADYQESLERNLNRFASSESASSNTRHYLPGRGPVTLCISSRYFSSLLL

SEQ ID NO: 4572 - protein, 723 aa, Unknown
  Magnetococcus sp. MC-1
MNLDPQQIQELQSGFSADPFAVLGRHDQPDGQVAVTVLSPRTERLFLTNIGQEMTRIPDSDLFHWCGDGRALPYHYRLRRVDAHGSQTEFHDPYSMPPMIGDLDRHLFNEGTHHHAGQFLGAHRMEVEGIRGVCFAVWAPNAQRVSVVGDFNQWDGRIHPMRLHQDSGIWEIFIPALKRGEHYKYEIRTTNGALLLKSDPYGHAHQLRPENASIITEPSNYPWHDEVWMRARSRFNWQKKPISIYEVHLGSWLDAATDPFPNYRELGKRLARYCSEMGFTHVELMPINEHPFDGSWGYQSTGYFAVTSRFGDGDDFRAMVDQLHGANIGVILDWVPAHFPKDAHGLGQFDGTALYEHQDPRLGEHQDWDTLIFNFGRLEVKSFLISSALHMLTRYHLDGLRVDAVASMLYLDYSREDWLPNKYGGRENLEAITFLRELNQAVHHDCPGVLMIAEESTAWPQVTRPPELGGLGFNMKWNMGWMNDTLSYFSKDPIHRKYHHDNLTFSLYYAFSENFTLPFSHDEVVHGKASMLGKMPGDEWQRFANLRLLYTYMFTHPGKKLLFMGCEFGQSQEWNFSQALPWELLEHTFHKGLQQLVKDLNLLYCKETALHERDFTPDGFQWIDCHDSDQSIISFQRKSSEGEVVVLLNFTPIPRDNYRIGVPRPGLYKEIFNADSGHYGGSNYGNGMSQLLTEPYPWMNQLQSLVLNVPPMAGIILRCEQEG

SEQ ID NO: 4573 - protein, 159 aa, Glycine max
VMNCVSFQNDIIEWSRDHRCHHKWTDTDADPHNINRGFFFAHMGWLLVKKHPLVKEKGASLDMSDLTSDPLLMFQRKYYLPLVGIFCSLLPTAIPVYLWSESVWVSFCTSALFRYCLNLHATWFINSAAHTFGYKPYDVTVIATESLLTTLTAWGGGGH

SEQ ID NO: 4574 - protein, 187 aa, Oryza sativa
MADGPGSPGGGGGSHESGSPRGGGGGGGGGGGGGGVREQDRFLPIANISRIMKKAIPANGKIAKDAKETVQECVSEFISFITSEASDKCQREKRKTINGDDLLWAMATLGFEDYIEPLKVYLQKYREVRTDGDSKLTAKAGDGSVKKDVLGSHGGSSSSAQGMGQQAAYNQGMGYMQPQYHNGDVSN

SEQ ID NO: 4575 - protein, 207 aa, Zea mays
MEVEACYNYGFLPADRGRHQPPPPPHATLPHAAEDAGELWEYFPCPFCYIEVEVPFICNHLQEEHCFDTRNAVCPICANNLGKDMAAHFRLQHTHLLKRRKPYRPSSCPAAATSPATYQVNSYYEEAEPQQHYSRPYKDPAPDPLLSQFICSVDAVPGDDNAQKDDKRLKLNKGATASDDDASSKLGLEERLQRIDFLTEILMSTIL

SEQ ID NO: 4576 - protein, 545 aa, Helicobacter hepaticus
MASKEINFSDSARNKLYEGIKQLSDAVKVTMGPKGRNVLIQKSYGAPTITKDGVSVAKEIELADPIANMGAQLVKEVASKTADAAGDGTTTATVLAYSIYKEGLRNITAGANPIEVKRGMDKASAAIIEELKKSSKKIGGKSDIAQVATISANSDENIGALIAEAMEKVGKDGVITVEEAKGINDELSVVEGMQFDRGYLSAYFVTNTDKMTAQLENAYVLLTDKKISNMKEILPLLEATMQSGKPLLIIAEDIEGEALTTLVVNKLRGVLNVSAVKAPGFGDRRKAMLQDIAILTGGQVISEELGKTLEAATLADLGSAARIVIDKDNTTIVDGKGKTKDVKDRIAQIKTEIENTTSDYDREKLQERLAKLSGGVAVIKVGAASEVEMKEKKDRVDDALSATKAAVDEGIVIGGGSALIRASQKVKLKLEGDEAIGYDIIKRAIKAPLAQIATNAGYDAGVVVNEVEKNSKDGFGFNATTGEYVDMFKEGIIDPLKVTRVALQNAVSVSSLLLTTEATINEIKEDKPAPAMPDMGGMGGMGGMM

SEQ ID NO: 4577 - protein, 315 aa, Arabidopsis thaliana
  misc_feature (50)..(50): Xaa can be any naturally occurring amino acid
MEKTLVGGCGGENEEVILGKELDFLGREQVSNIRRDSFVEPLGSILLQLXEAFWVFPWLVFINGICITLSYHRNLSHRSFDLPKWLEYLFAYGGVLAFQGDPIEWVSNHRYHHKHCETQRDPHSPTQGFWFSHMAWIFDTSSILENNTLFPIRGRDLTLTKPLGACSQCGGEENVDDLVRQPFYRFLQRFFLLHMLAYSFLFYFCGGMPLLVWGIGITIAVRLHLTFLVNSVCHIWGTRAWNTSDFSKNNWWVAILTLGEGWHNNHHAFEFSARHGLEWWQLDITWCLIRFLEAIGLATNVKLPTETQMKGKALV

SEQ ID NO: 4578 - protein, 555 aa, Unknown
  secondary endosymbiont of Bemisia tabaci
MAAKDLKFGNDARKKMLKGVNILANAVKATLGPKGRNVVLDKPYGAPSITKDGVSVAREIELEDKFENMGAQMVKEVASKANDAAGDGTTTATVLAQSIVTEGLKAVAAGMNPMDLKRGIDKAVEAAVEELKIISKPCKDSKEIAQVGTISANADAKVGKLISDAMKRVTNEGVITVEEASGLEDDLIVVEGMQFDRGYLSPYFINKQESSSIEFDNPYILLVDKKISNIRDMLSILEVVAKEGKPLLIIAEDVEGEALATLVVNTMRGIVKVSAVKAPGFGDRRKEMLQDIAVLTHGHVISEETGDSLEKATKENLGNAKRVVITKDATTIIDGAGEKSKIEARIQNIKKQIENATSDYDKEKLQERVAKLSGGVAVIKVGAPTEIAMKEKKARVEDALQATRAAVEEGVVPGGGVALIRVASKIANSSLKGDNGDQNVGIRVALRAMESPLRQIVVNAGEEASVIANKIKENKGNDNYGYNAQTEAYGDMIEMGILDPTKVTRSALQYAASIAGLMITTECMVTDLPKEEKASDMGAGGMGGIGGMGGMNGMM

SEQ ID NO: 4579 - protein, 555 aa, Unknown
  secondary endosymbiont of Bemisia tabaci
MAAKDLKFGNDARKKMLKGVNILANAVKVTLGPKGRNVVLDKSYGAPSITKDGVSVAREIELEDKFENMGAQMVKEVASKANDAAGDGTTTATVLAQSIVTEGLKAVAAGMNPMDLKRGIDKAVEAAVEELKIISKPCKDSKEIAQVGTISANADAKVGKLISDAMKRVTNEGVITVEEASGLEDDLIVVEGMQFDRGYLSPYFINKQESSSIGFDNPYILLVDKKISNIGDMLSILEVVAKEGKPLLIIAEDVEGEALATLVVNTMRGIVKVSAVKAPGFGDRRKEMLQDIAVLTHGHVISEETGDSLEKATKENLGNAKRVVITKDATTIIDGAGEKSKIEARIQNIKKQIENATSDYDKEKLQERVAKLSGGVAVIKVGAPTEIAMKEKKARVEDALQATRAAVEEGVVPGGGVALIRVASKIANSSLKGDNEDQNVGIRVALRAMESPLRQIGVNAGEEASVIANKIKENKGNDNYGYNAQTEAYGDMIEMGILDPTKVTRSALQYAASIAGLMITTECMVTDLPKEEKASDMGAGGMGGIGGMGGMNGMM

SEQ ID NO: 4580 - protein, 322 aa, Saccharophagus degradans
MQNLQGMLRDQRVAQDLQEVIFSIELACKDIAKKVQLGALAGVLGATESENVQGETQKKLDVISNDILKASLAANSNVLALASEEEDNVVAANAGGRYVVAFDPLDGSSNIDINGQIGTIFTIFEALDGVAANSGKHFLQQGNKQVCAGYVLYGASTLMVITVDGPTSCLTLDPATQTFSLTNTALQVPDQTQEFAVNLANERFWLPKFKSYVADLKLGEEGVRGKRFNMRWNASMVGDVHRVLMRGGIFMYPSDTRNPKQPAKLRLLYEANPMALLIERAGGKAFNETQRILDVTPCALHERIAVILGSEQEVATCLEYLN

SEQ ID NO: 4581 - protein, 555 aa, Unknown
  secondary endosymbiont of Bemisia tabaci
MAAKDLKFGNDARKKMLKGVNILANAVKVTLGPKGRNVVLDKSYGAPSITKDGVSVAREIELEDKFENMGAQMVKEVASKANDAAGDGTTTATVLAQSIVTEGLKAVAAGMNPMDLKRGIDKAVEAAVEELKIISKPCKDSKEIAQVGTISANADAKVGKLISDAMKRVTNEGVITVEEASGLEDDLIVVEGMQFDRGYLSPYFINKQESSSIEFDNPYILLVDKKISNIRDMLSILEVVAKEGKPLLIIAEDVEGEALATLVVNTMRGIVKVSAVKAPGFGDRRKEMLQDIAVLTHGHVISEETGDSLEKATKENLGNAKRVVITKDATTIIDGAGEKSKIEARIQNIKKQIENATSDYDKEKLQERVAKLSGGVAVIKVGAPTEIAMKEKKACVEDALQATRAAVEEGVVPGGGVALIRVASKIANSSLKGDNEDQNVGIRVALRAMESPLRQIVVNAGEEASVIANKIKENKGNDNYGYNAQTEAYGDTIEMGILDPTKVTRSALQYAASIAGLMITTECMVTDLPKEEKASDMGAGGMGGIGGMGGMNGMM

SEQ ID NO: 4582 - protein, 917 aa, Pseudomonas chlororaphis
MLKKLGIKGRVLLLTLLPTSLMALVLGGYFTWMQQSDLQTQLLQRGEMIAEQLAPLVAPALAHKNIALLERIATQSLEQQDVRAVTFLAPDRTPLAHAGPSMLNQAPTGNGSQMLQRTGSDATRYLLPVFGRHRNLAGDLIPDESDRLLGWVELELSHNSMLLRGYRSLFASLLLIIAGLICTGLLALRMGRTINNPLSQIKHAVTQLKDGNLETRLPLLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLRLPKTRDDAEDLPAPPLLGRRIAVLENHELARQALQHQLEDCGLEVTPFNTLEALTNGVTGVHQTEQAIDLAVLGITSNDMPPERLNQHIWDLEHLGCKVLVLCPTTEQTLFHLSVPNPHSQLQAKPACTRKLRRALADLVNPKVVRNEPSEPIASRPPRVLCVDDNPANLLLVQTLLEDMGAKVLAVDSGYAAVKAVQNESFDLVMMDVQMPGMDGRQSTEAIRQWESERNCTPLPVIALTAHAMANEKRALLQSGMDDYLTKPISERQLAQVVLKWTGLALRNQGPERTGEPSGNGLELQVLDHDEGLRLAAGKADLAADMLAMLLASLEADREAIRAARAANDHNALIERVHRLHGATRYCGVPQLRAACQRSETLLKQEDVKAFAALDELERAINRLATEARINA

SEQ ID NO: 4583 - protein, 881 aa, Ustilago maydis
MEGSSSSDSPSASHDGTSTLDSELGRSVLICLLRLDLRIHDNPLFYYAHQTHKPIVTTAEKTVDLSKLEDEALLGSTADYLLPVFVFDEREVELSGLPGYQRKGPEARTKEYGFWKTGGFRTRFVSESVYDVRSRLRSVGSDLFIRFGIPEDVISNLVKAFQAEGTHVEGVWLQKEMTYPEINVENAIVEKLRGSGVPVQFVNGKTLIHPADLPFESSETPDVFTPFRKKVEALGASMVRPVKHPPAKFKSFPPGVPSTPDYALDVSYEVDVDGLAPRALETKDKQEGQVSFHDILRFLLTPLNDSQLPPTLEASALLQQRHPASAFPLRGGESSALERLDWYFVRGKSADSSRWGKSDPPPVARYKQTRNNLIGHAYSTKMSPFLAYGSVSPRQIWEALDDHERKFGEDQNTYWVRFELLWRDYFFFVAEKFGHLLYDLGGFERATDPRQAAKKMEDGWWRKWDPLKDGPDHEMTRLLEGRTGIPFIDANILELRESGFMSNRGRQNVASFLSKDLGYDWRIGAEFFQSHLIDYDPTSNYGNWQYVAGVGNDPRASRQFNTVKQAKDYDSHGDYVKLWIPALRNLHADYVHTPWLLTADERRRYGLKTTKMDVTIDGYPAQPLFEHEGWQRHYERKQGVGSKMHGNPQEKVKDGKVPRRHRPSCRVQAATYGALSDGSSFDQLSATTGTLHGLDGSGTPRNMVPPLRGASGSIGPSHHARPNSSFPNLGALSIGSASERSGSPFGTSPAGHLSAINKFARTAPSGAPVNLAAPVGRAPGNAFDFGPGRTGSASSLELLNNRARRAGTTDGNGGNGGDAYSGAPNSADVVSHIGPANNSNGLGYGNGNGNGNGNGNSNSNAHASQTVSKADLETSWRRGFK

SEQ ID NO: 4584 - protein, 637 aa, Magnetospirillum magnetotacticum
MCGLAGLFLPRHAALAEADIAAMLRVMRHRGPDGTGIHLSDDRRFQAGFTRLAIIDLATGDQPLVRNGGETVLLGNGEVYNYRELRAELAAKGHTFLTQGDMEAALESFMAKGRDFVHDLNGMYALAILERDDHRLTLVLDRLGIKPLYWARLGNGGILFASEIKALFASGLLRPLVDEVSVAAYLAHGYVPAPATLYKGVSKLPPGSIMSVDASGEVQIERYWRAAAATDLPGDEAGIRAHLVSILDDAVGLQLRSDVPVGAMLSGGLDSGLLVALAARRLDRPLKTYTVRFLGARVDETPLAAQVAERYGTDHTVFELETGSAAQLLPRLVWHADEPLADASLLPNHLINEVIGKETRVVLNGTGGDELFGGYGRYFQLPVEARWLRLPRPLRKAAEAMIGLGNPFLAWQLARAEKFGRDRGGYLHDHCALFPPPMAKLLGCTLPWPIPAQAAFADEYAGPLDSAALYAELNTYLPEDLLTLLDRTTMAHSVEGRVPLLDHRMVEAALAVPPHIRNPGGRQKALERAIAAEYLPDSLLSAPKQGFASPVPAWFESGGLAPLARRLLTSRRALERGWWSREGVERLLAQPGRHAFRLYSLLVLELTVRIHVEGAFAEAPAFGLAEMAEGEDAPCAA

SEQ ID NO: 4585 - protein, 156 aa, Zea mays
MDAVMFGLETPLMAALQHLLDVPDGDNKTGGGATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 4586 - protein, 262 aa, Arabidopsis thaliana
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGGGGWEGGEQNVTYAHHQAQSQGLYQPLECNPTLQMGCCFGDDDDDDRYDNPVCSEQITATTQAQAQQGNGYIPGWML

SEQ ID NO: 4587 - protein, 234 aa, Antirrhinum majus
MGRGKIVIQRIDKSTSRQVTFSKRRSGLLKKAKELAILCDAEVGVVIFSSTGKLYEFSSTSMKSIIERHTKTKEDHHQLLNHGSEVKFWQREAATLRQQLQDLQENHRKLMGEELQGLNVEDLHRLENQLEMSLRGVRMKKVQMLTDEVHELRRKGHLIHQENNELYEKVKLLQQENKELCKKAYGTRDVSAANGTALVPFGFAIGREQFEPIQLHLSQPEPENIETSRASGSK

SEQ ID NO: 4588 - protein, 484 aa, Momordica charantia
MVLQSSNNAKKLLSKLATGNGHGEDSPYFDGWKAYDSDPFHPTLNPRGVIQMGLAENQLSFGFVEKWMRNNPQASICTAEGIDEFKDVAIFQDYHGLPEFRNAVANFMGKVRGDRVKFDPDRVVMSGGATGAHETVAFCLADPGEAFLVPVPYYPGFDRDLRWRTGVEIVPVICESSNNFRLTREALETAYEEAQKSDTKIKGLLITNPSNPLGTVYDRETLETAVAFINDKNIHLVCDEIYAATVFAEPGFVSISEVIENDPSCDRNLIHVVYSLSKDMGFPGFRVGIIYSYNDAVVSCARKMSSFGLVSSQTQHMIASMLSDDEFVESFLVGSAEKLAARHRSFTKGLAQVGIGYLQGSGGLFLWMDLRHLLKEKTLEAEMALWRVIINEVKLNVSPGSSFHCSEPGWFRVCFANMDDKTMDISITRIRTFVLQNKEATKIKKHKFCWRQSSLELRLSSRRLEDIMSPHSPLPQSPMLRATT

SEQ ID NO: 4589 - protein, 1209 aa, Unknown
  Synechocystis sp. PCC 6803
MINSGTLITKIEELQSTLAKMDIALGTVDEAIVWTDGTGQIQWCNTAFDHLMGKLHILILGKNLVELLPLHRNSQPLEVSHHPFTIIVATQQKFTDHYEFNQNGKWLHLEIMTSPLMNAQGAVLVIRDISDRHLQEQTLQQLNENLEKRVLERTQAVSLINNKLEQELRERKKTEIALKATTSRLEALIQNLQAGVLVENENGKIVLVNQVFCDLFGIDVPPEKLIGFDCRQSAQFAKILFEDPEAFIIGIDNILQNRQIVTNEELRLKDGRTFARDYVPIEVGNHHDGRLWLYRNITPQKQAEVSLRKQYQRTLLLKEITEEIRQSLDPVKIFQVAVSRLGQTLQVSRCIVHLYSDMPQPHLTCVAEYLIPGMTSMLDLNLLIADNPHLLRALNQDDAVQVDNLKMVPTAVPLQDFYNQLQVYSLLIIRTSYQDKTNGLLILHQCDRSRSWNTEEVELVKAVADQVGIALAQAKLLEQEREIRQQLIEQNKALMTATKAAEDANRAKSDFLATMSHEIRTPMNAVIGMTGLLLDTHLNTQQQQFTETIRSSGEALLSLINDILDFSKIESGQFKLEIHPFEIQQCVEECLDLVAPQAFAKKLDLVYQIEPQVPMAILGDLTRVRQVLVNILANAVKFTTSGSIQVRVSATVANQQQNKYTIQFSIKDTGIGISPDQQSALFKSFSQVNTSIARKYGGTGLGLAICKRLTEMMGGQIWVESYGEIAGNPPVDWAKTSKNNPLESTGATFYFTITAQSTTIVRRPNDLSCQLSLAGKRLLIVDDNQLSCEGLKQLVTAWGLQAQATTSGWEAFSWLRQGECFDLAIIDLQMEEVDGLQLAEALRTLPTGESLPLVILTPSPTSLAELSARTDISIAACLSSPIKKSLVYEVLCEVFKADETDNSLFNGDWRSGITEAVKRTCSPQEREARIKTLSPLRILLVEDNNINQRVALLMLEKLGYRPDIAGNGLEALQVLHQASYDVILMDVEMPEMDGLSATKAIRQDFPADEQPWIIAVTAYAMQGDRETCLAAGMNDYITKPIRENDLLDALQRIDFSVLSLTKNKPAPLSEPVVNVGLVNPVPEVLKADQLEENLVLDLSILTGIREMAGPDGATFLQVIIGDYLHTTPSLLEKLKTAIAAQEIDTVRATAHSLGSSSANLGAVEFAKQCKQLENLARSGMLSGVDGQYIQLEKEYEKVSQALALQLNPN

SEQ ID NO: 4590 - protein, 275 aa, Sinorhizobium meliloti
MHAVSSNGANIPALGFGTFRMSGAEVLRILPQALKLGFRHVDTAQIYGNEAEVGEAIQKSGIPRADVFLTTKVWVDNYRHDAFIASVDESLRKLRTDHVDLLLLHWPGSDVPMAERIGALNEVRNAGKVRHIGISNFNTTQMEEAARLSDAPIATNQVEYHPYLDQTKVLQTARRLGMSLTSYYAMANGKVPADPLLTEIGGRHGKTAAQVALRWLVQQQDVIVLSKTATEARLKENFAIFDFALTREEMAAVRELARPNGRIVNPQGLAPEWDA

SEQ ID NO: 4591 - protein, 256 aa, Methylococcus capsulatus
MLEILQIPVLEDNYVYLLHEPGSGATAAVDPAVAGPVLEALDARGWRLGHVLNTHHHGDHVGGNLELKAATGCTVVGAAGDRHRIPGIDVALKDGEEFRLGSASARMLDVPGHTSGHVAFWFEDDAALFCGDTLFALGCGRLFEGSAEQMWRSLERLRALPAETKVFCAHEYTQANARFAVTIEPGNAALRERVERVEALRREGAATVPSILSEELATNPFLRPESPEIRARLGLPGVPEVEVFAEIRRRKDVFRG

SEQ ID NO: 4592 - protein, 134 aa, Brassica napus
PRVRGNTQCCQVLIDKGASLAAINSNGWTPLMVARSWHRNCLEEVLNPTTEQPLSQLPKVPSPFLCLPLMSIVKIAQECGWRGDDCLTPCRDPCAVCLERKCTVAADGCGHEFCTNCALYLSTTNITSSKTSQA

SEQ ID NO: 4593 - protein, 560 aa, Bacteroides fragilis
MKKFLNRRNGVLLAAVLVAVAFFSFKSGDDRNFQIAKNLDTFNSIVKELDMFYVDTLDPNKTVREGIDYMLSSLDPYTEYYPEDDQAELQQMLNASFGGIGSLITYNQKLKRSMIAEPFEGTPAAKVGLKAGDILMEIDGKDLAGKNNQEVSQMLRGAVGTSFKLKVERPDEKGGTRPLEFDIVRQTIQTPMIPYDTIFNNVGYINLSTFSGTPSKDFKKTFLKLKKEGITSLVIDLRGNGGGRLEEAVEIANFFLPRGKVIVTTKGKTKQASNTYKTLREPLDLDIPITVLVNGATASASEILSGAFQDFDRAVIVGSRTFGKGLVQTTRPLPYGGVMKLTTSKYYIPSGRCVQAIDYKHRNEDGSVGTIPDSLTTVFHTAAGREVRDGGGVMPDIEVKQEKLPNILFYLVRDNLIFDYATQYCLKHPSIPSPQEFKVTDADYNDFKAMVKKADFKYDQQSEKIMKTLKEAAKFEGYLDEASEEIKALEKKLTHNLDRDLDYFSKDIRSMIADEIIKRYYYTRGGIIQQLKDDDGLQAALKILADPVKYKETLSAPVKK

SEQ ID NO: 4594 - protein, 435 aa, Aspergillus nidulans
MSDLATAPSPSYPGAPGLTYFTPATNPGAAINPAAKETPTLFRPLTIRSVTLKNRVIVAPMCMYSAESDPSSPSVGALTDFHMAHLGHFALKGAGLVFTEALAVQPNGRISPNDAGIWQEGTESEQFKGLKRVADFVHSQGAKFGVQLAHSGRKGSTVAPPLAASRGVRALKADEGVFGWPKDVVGPSGGEENKWEPGNISYWAPRELTVAEIQEIVKAFAKSAEIAVKAGVDVIEIHAAHGYLVNEFLSPVTNRRTDQYGGSFENRTRILREIALAIREVIPEGTPLFLRISATEWIEDQPAAKDFGSWDLKASIELLKDLPEFGVDFLDVSSGGNHKDQKFHFFTDYQTEMAAKLRKELRASGARTLVGAVGFITQPDAAAQIVQGADEEGVEAKADAVLIGRQFLREPEWVLNAAKKLGVQVNPPIQFGRAM

SEQ ID NO: 4595 - protein, 156 aa, Nostoc punctiforme
MALVRWEPFREVESLQRQLNRLFDEIAPTGRREEEGIAFIPSAEIQETPDAVHLKVEIPGVDPKDLDVQVSPEAVSISGERKSEIKTEERGITRTEFRYGRFQRVIPLPSRVQHDKVEAEYKDGILKLRLPKAEEDRNKVVKVNLGDGHRGNGQGQ

SEQ ID NO: 4596 - protein, 1531 aa, Debaryomyces hansenii
MGRYRDRNRETDENDDTNRQATMTTTLVQQHSRQSLGKFVNPSPTKYESTENMDKVVQSVTNATKRLSQISTNTNSSAKKRKTQNRIGPWKLGRTLGRGSTGRVRLAKNVNSGKLAAVKIVPKSNFKKLENPKYKRNSVDSSGSVKDRLPYGIEREIIIMKLISHPNIMGLYDVWENKNDLYLILEYIEGGELFDYLIKKGKLQEFEAISYFKQIINGIHYLHQFNICHRDLKPENLLLDFNKNIKIADFGMAALEVREKLLETSCGSPHYASPEIVAGKNYHGAPSDIWSCGIILFALLTGHLPFDDENIRKLLLKVQNGKFLMPNNLSSESKDLISKMLKVNPSERITIDAILQHPLLTKYPEPSVRKDKVTEYSDLNIRPIDSINNIDKEILKNLSVLFHNRDEQTIISKLLSPEDCSEKTFYYLLVKYRNEHLTASNNTINNYEDDPDLTGSESKQTITRSTSIVKTTTTDPLTGEKHTTIRKIPNSTSNFSNRSRSPKKKPEVLGNITNTAPTFKASTSFNKKKTLMNNNVISRNNSSKSLRKRPPQQQPPKLSRKISGMPDLNDLRLEKTQLNSLYKQQKLNGSFGNKSLFNFESVCQEIFGNAEQHEGDRKIEPKENLRKDKQMDGRTGKLSNIEKCERELAAKVHEKNDARALKLQHQQKEEDAKLQHKKQLESKKRDQSKLLQEKQRQALEKLGSQIQDNNDNNRRGIAHRTQQRHVTEPAPTSSLDPKLGGGAKSLLRAKSLASPSSYVSLRQNTHTSDNTSKVLQTLGIEVAPLKTSTKFNSNLKTSSSKNLSDYLDNETLYSRSDKSIEHQKENISMNKFNEKEKVNQSIAKPNYSRTSTSKLQPLAISRTTTLNSIGYRSLLDGIDENKVQKDLPKRPNGEKDYDTTLSTIETRKNGLIPNPRFSRFSFNGLLNSRFDNPDVTIQNNLVSSGTVVRKSVNQKEPISSRIIEEDPQTSHLKLETGSLKKSSTNLLGLGIVQNHQGKTSRKVSQNSEYCDSNFISVNLSDTADDSQDNTTLEENAISLSHANSVLKDDHANTTVSNTTISKQQEVLNTNVDQRNKRKSSYLGNLEGSKETLVENDKEDKSFQDSIKSMYKDYAKLYNDKKPKSETNTQELGETDDNIPSEKQTRERQSILRDDRINSIDSDNDLSFAADGSSNIDILDSSSIADTNMIENRSEIQLNDNKYSPTITDNQKDFGDEYEDEIDDQFSQHGDQQEYNHEYDHENNHEYNQEDGQEQHEHDHNQQNDQQLQDSDRLQTGTDLRKSTASTQIFSTMNLPKIRDKNSVVEENKEIKHSEVKSEESNQRHNSIFNKLKPKREAPKPPGFKWDDEKSQGHNRFSRISVSSKFDKQQKLNDNYNDSSKSNWFMKFINSLTANSKTPKGEKRKSLIRKFNSDKLDDNETKNFCVLDSTLQSSELTRVIKDTLELKKIEGSVSKVDIDEDFGMISGVIPARYSGGRRLRFKIEIINLKNSSSLHLSKLKGTDKGFKNLTNTVKFIVSKEEQNINRMSSVEA

SEQ ID NO: 4597 - protein, 128 aa, Coccidioides posadasii
MGADDKANHSTYRYNEVPVYTTSQGCPVMDPESSQRIGENGPLLLQDFHLIDLLAHFDRERIPERVVHAKGAGAHGEFEVTDDISDITTIDMLKGVGKKTKLVTRFSTVGGEKGSADSARDPRGFAVK

SEQ ID NO: 4598 - protein, 210 aa, Arabidopsis thaliana
  misc_feature (29)..(29): Xaa can be any naturally occurring amino acid
  misc_feature (42)..(42): Xaa can be any naturally occurring amino acid
  misc_feature (46)..(46): Xaa can be any naturally occurring amino acid
  misc_feature (59)..(59): Xaa can be any naturally occurring amino acid
  misc_feature (85)..(85): Xaa can be any naturally occurring amino acid
  misc_feature (93)..(93): Xaa can be any naturally occurring amino acid
  misc_feature (98)..(98): Xaa can be any naturally occurring amino acid
  misc_feature (126)..(126): Xaa can be any naturally occurring amino acid
  misc_feature (130)..(130): Xaa can be any naturally occurring amino acid
  misc_feature (137)..(139): Xaa can be any naturally occurring amino acid
  misc_feature (153)..(153): Xaa can be any naturally occurring amino acid
GGFGGTAANDESVCTMFGSRYVRTTLPKXEIGENSIPKDAAXQIIXDELMLDGNPWLRXASFVTTWVEPECDKLIMGSICRNYVXMDEYPVTXGLQNXCVDIIARLCNAPLGESETAVGGGTVGCXGAVXVAGLAFXXXWGALRPAGGGPFGXPRLVAGAGGGSRGGVGAFLFVWGGGGWGGGVRGGCGRGGGGGGGGAGGGGGVVGGRG

SEQ ID NO: 4599 - protein, 499 aa, Francisella tularensis
MQIVWFKRDLRVTDNLALSLASEKGDILPLYIIEPELWQQPDMSHRQYLFLSECLEELNTELTKLGQSLAIMLGDAVEIFEQLIQKYNIKNVWSHQETWNDWTYQRDIKLEKFFKQNNIVWHQPYQNGVVRCLADRDNWALLWHQHMSEKIIRAPTKLKFICENQIKIPTAESLGLEYDDCYKRQKGGRIRALRILDSFLYQRGCGYTKEMSSPVTAFKSCSRLSPYIAFGVISLKEIYQKANQRKNEIKESSVKNKTKWLSAMRSFLSRLRWHCHFMQKLEDQPSIEYENLHSAYDQLRTEPLNQQCFEAWKTGNTGYPMIDACMRALIATGWLNFRMRAMLMSFASYHLWLDWRVTSLYLARLFTDYEPGIHYSQVQMQSGTTGINSIRIYNPIKQSIDQDPNGEFIRRWLPELENVSNENIHTPWLEKHNSLDYPDPTIDEKQARKFAADNIYKIRKSSKNSQETKNIVKKHASRKTSRKIKSKQHKVESIQGELF

SEQ ID NO: 4600 - protein, 468 aa, Streptococcus pneumoniae
MTKTLPKDFIFGGATAAYQAEGATHTDGKGPVAWDKYLEDNYWYTAEPASDFYNRYPVDLKLAEEYGVNGIRISIAWSRIFPTGYGQVNAKGVEFYHNLFAECHKRHVEPFVTLHHFDTPEALHSNGDFLNRENIEHFVDYAAFCFEEFPEVNYWTTFNEIGPIGDGQYLVGKFPPGIQYDLAKVFQSHHNMMVSHARAVKLYKDKGYKGEIGVVHALPTKYPLDHENPADVRAAELEDIIHNKFILDATYLGRYSAETMEGVNHILSVNGGSLDLREEDFTALEAAKDLNDFLGINYYMSDWMEAFDGETEIIHNGKGKKGSSKYQIKGVGRRVAPDYVPRTDWDWIIYPQGLYDQIMRVKKDYPNYKKIYITENGLGYKDEFVDNTVYDDGRIDYVKQHLEILSDAIADGANVKGYFIWSLMDVFSWSNGYEKRYGLFYVDFETQERYPKKSAHWYKKVAETQIID

SEQ ID NO: 4601 - protein, 544 aa, Sinapis alba
MKLLHGLALVFLLAAASCKADEEITCEENEPFTCSNTDILSSKNFGKDFIFGVASSAYQIEGGRGRGVNVWDGFSHRYPEKSGSDLKNGDTSCESYTRWKKDVEIMGELNATGYRFSFAWSRIVPKGKVSRGVDQAGLDYYHNLIDALLEKNITPFVTLFHWDLPQTLQDEYEGFLDRQIIQDFKDYADLCFKEFGGKVKNWITINQLYTVPTRGYALGTDAPGRCSPKVDTKQRCYGGNSSTEPYIVAHNQLLAHAAIVDLYRTNYAFQNGKIGPVMITRWFLPYDESDPACIEAAERMNQFFHGWYMEPLTKGRYPDIMRQIVGSRLPNFTEAEAELVAGSYDFLGLNYYVTQYAKPKPNPYPSETHTALMDAGVDLTFNNSRGEYPGPVFAEDANSYYYPKGIYYVMDYFKTKYNNPLIYITENGISTPGSESRCEAIADYKRINYLCSHLCFLRKVIREKGVNIRGYFAWALGDNYEFCKGFTVRFGLSYVNWDDLDDRNLKESGKWYQRFINGTAKNPVKQDFLRSSLSSQSQKKRLAC

SEQ ID NO: 4602 - protein, 499 aa, Schizophyllum commune
MGAQQSRRSGHGSRPCSTMKHDSSRSSSEASDSKGSRSLKTVSVASASAFAAIAAVTPSSSSSAEDISRLSERTRVEKREVQKPPPPRPKSYLEMPQTTVPCQYRTGKTLGSGTYAIVKEAIHIHTGKYYACKVINKKLMQGREHMVRNEIAVLKRISSGHKNIVTLHDYFETTHNLYLCFDLCTGGELFDRICAKGNYYEADAANLVRTILQAVKYIHDCGIVHRDLKPENLLFRTQAEDADIMIADFGLSRVMEEEKLNMLTEICGTPGYMAPEIFKKTGHSKPVDIWAMGVITYFLLAGYTPFDRDSQQLEMEAIIAGDYKFEPEEYWENVSSTAKDFVTQCLTIDPTNRPTAAEALQHKWLSDPTAHFVTDKEGPVDLLPHVKKAFNAKQLWKKAAFSIKALNRMTMLASSGLDKDAAELSENLKKYKEESAREIMEESTITHSHNMETESTTDLTLKEKEVRDAVKASDDISAHDHEDISSKLASVSLDEGQKK

SEQ ID NO: 4603 - protein, 858 aa, Arabidopsis thaliana
MVYTISGVRFPHLPSIKKKNSSLHSFNEDLRRSNAVSFSLRKDSRSSGKVFARKPSYDSDSSSLATTASEKLRGHQSDSSSSASDQVQSRDTVSDDTQVLGNVDVQKTEEAQETETLDQTSALSTSGSISYKEDFAKMSHSVDQEVGQRKIPPPGDGKRIYDIDPMLNSHRNHLDYRYGQYRKLREEIDKNEGGLEAFSRGYEIFGFTRSATGITYREWAPGAKAASLIGDFNNWNAKSDVMARNDFGVWEIFLPNNADGSPAIPHGSRVKIRMDTPSGIKDSIPAWIKYSVQPPGEIPYNGVYYDPPEEDKYAFKHPRPKKPTSLRIYESHVGMSSTEPKINTYANFRDDVLPRIKKLGYNAVQIMAIQEHAYYASFGYHVTNFFAPSSRFGTPDDLKSLIDKAHELGLVVLMDIVHSHASKNTLDGLDMFDGTDGQYFHSGSRGYHWMWDSRLFNYGSWEVLRYLLSNARWWLEEYKFDGFRFDGVTSMMYTHHGLQVEFTGNYNEYFGYSTDVDAVVYLMLVNDLIHGLYPEAIVVGEDVSGMPAFCVPVEDGGVGFDYRLHMAVADKWIELLKKRDEDWQVGDITFTLTNRRWGEKCVVYAESHDQALVGDKTIAFWLMDKDMYDFMAVDRQATPRVDRGIALHKMIRLITMGLGGEGYLNFMGNEFGHPEWIDFPRTDQHLPDGRVIAGNNGSYDKCRRRFDLGDAEYLRYHGLQEFDRAMQNLEETYGFMTSEHQYISRKDEGDRVIVFERGNLLFVFNFHWTNSYSDYRIGCSVPGKYKIVLDSDNSLFGGFNRLDDSAEFFTSDGRHDDRPCSFMVYAPCRTAVVYAAVDDDDDDERSSLVPIGLLPEDV

SEQ ID NO: 4604 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRNIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 4605 - protein, 921 aa, Pseudomonas aeruginosa
MSPAVADDAGVSSVPLQTTATTPSANQNWRLLRDESAQLRIADVLQRKEQFRPLAKRSFIFPASPQAVWLQVQLPAQKVPSWLWIFAPRVQYLDYYLVQDGQLVRDQHTGESRPFQERPLPSRSYLFSLPVDGKPMTLYVRMTSNHPLMAWFDQIDEAGLVGLEKPAYAFGMLLGGMLLLLMYNLIRFAYSRSASSLWLAAVHAALAVCAAANLGLVAFWLPGLKFNQSLTADLGALGAAVSLLWFACSFFRGTAESRLNRLLQGEALLILAVGAIIAFTQQLWFSWLIYLLVILSSLSVPLVAAWHWYRGYQPARLIVAGMIVFNAGFMVFLPVLFGTKQLDPGWLVLGVFSFATLAGLVLSVSLTERQRLIQQLNLQQRTSEAAHTAELQTKAEFLAKISHEIRTPMNGVLGMTELLLGTPLSAKQRDYVQTIHSAGNELLTLINEILDISKLESGQIELDEVQFDLNALIEDCLDIFRVKAEQQRIELISFTQPQVPRVIGGDPTRLRQVVLSLLDNAFKQTEEGEILLVVALDDQGETPRLRIAVQDSGHPFDAKEREALLTAELHSGDFLSASKLGSHLGLIIARQLVRLMGGEFGIQSGSSQGTTLSLTLPLDPQQLENPTADLDGPLQGARLLVVDDNETCRKVLVQQCSGWGLNVSAVSSGKEALAQLRTKAHLREYFDVVLLDQDMPGMTGMQLAAKIKEDPNLNHDILLIMLTGISNAPSKIIARNAGIKRILAKPVAGYTLKATLADELAQRGVSGVTNYLQPAKEAQAPSLPSDFRILVAEDNSISTKVIRGMLNKLNLQPDTASNGQEALSAMKATQYDLVLMDCEMPVLDGFSATEQLRAWEAHEQRPHTPVVALTAHILSEHKERARLVGMDGHMAKPVELSQLRELIAYWVGERDRRRQGDALPS

SEQ ID NO: 4606 - protein, 686 aa, Pseudomonas fluorescens
MAFEAMFQPIQIGKLTIRNRVLSTAHAEVYATDGGMTTERYVKYYEEKAKGGIGLAICGGSSVVAIDSPQEWWSSVNLSTDRIIPHFQNLADAMHKHGAKIMIQITHMGRRSRWDGFNWPTLMSPSGVREPVHRATCKTIEPEEIWRVIGNYAQAARRAKAGGLDGVELSAVHQHMIDQFWSPRVNKRTDEWGGTFEKRMRFGLEVLKAVRAEVGDDFCVGMRLCGDEFHPDGLSHEDMKQIAKYYDDTGMLDFIGVVGSGCDTHNTLANVIPNMSFPPEPFLHLAAGIKEVVKVPVLHAQNIKDPNQATRILEGGYVDMVGMTRAHMADPHLIAKIKMGQIDQIKQCVGANYCIDRQYQGLDVLCIQNAATSREYMGVPHIIEKTTGIKRKVVVVGAGPAGMEAARVAAERGHEVTLFEKKEAIGGQITTASKAPQRDQIAGITRWYQLELARLKVDLRLGTAADTATILDLRPDVVVLAVGGHPFIEQNEHWGAAEGLVVSSWDILDGKVAPGKNVLVYDTICEFTGMSVTDFIADKGSQVEIVTDDIKPGIAVGGTSFPTYYRSLYPKEVIMTGDLTLEKVYREGDKLVAVLENEYTGAREERVVDQVVVENGVRPDEELYYGLKEGSRNKGQMDVEALFAIKPQPCLSETGEGYLLFRIGDCVSQRNTHAAIYDALRLCKDF

SEQ ID NO: 4607 - protein, 585 aa, Triticum aestivum
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPLYIGWGIDGSVWISSEMKGLNDDCEHFEIFPPGHLYSSKQGGFKRWYNPPWFSEVIPSVPYDPLALRKAFEKAVVKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSRKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWVLRKAFDDEEQPFLPKHILYRQKEQFSDGVGYSWIDGLKAHAESNVTDKMMSNAKFIYPHNTPTTKEAYCYRMIFERFFPQNSAILTVPGGPSVACSTAKAVEWDAQWSGNLDPSGRAALGVHLSAYEQEHLPATIMAGTSKKPRMIEVAAPGVAIES

SEQ ID NO: 4608 - protein, 209 aa, Arabidopsis thaliana
MNQKPPPYGYGGAGGGGVGPSSTSNTTIIGTLSARAKQTTQSMITTLRPWREILDLSALSLPRGYDEAMAHLKHNISYFRGNYALAVLAIVFLGLIYHPMSMIAFIVVFIGWILLYFSRDANDSIVISGKEVDDKIVLVLLSLVTVLALVYTDVGENVLVSLIIGLLIVGAHGAFRNTDDLFLDEESARRGGLVSAGSGNRPPSSYTPI

SEQ ID NO: 4609 - protein, 492 aa, Helianthus annuus
MDPYKYRSSSAYNAPFWTTNSGAPVYNNNNSLTVGSRGPILLEDYHLVEKLANFDRERIPERVVHARGASAKGFFEVTHDITALTCADFLRAPGVQTPVIVRFSTVIHERGSPETLRDPRGFAVKFYTREGNFDLVGNNFPVFFIRDGMKFPDMVHSLKPNPKSHIQEDWRIMDFFSHHPESLHMFTFLLDDIGVPQDYRHMDGSGVNTYTLINKAGKAYYVKFHWKPTCGVKSLLEEEAIKIGGANHSHATQDLYDSIAAGNYPEWKLFIQTIDPDHEDRLDFDPLDVTKTWPEDIFPLQPVGRLVLNKNIDNFFAENEQLAFCPAIIVPGIYYSDDKLLQTRIFSYSDTQRHRLGPNYLQLPANAPKCAHHNNHYDGFMNFMHRDEEIDYFPSRYDPARHAEQYPIPPVRLSGKRDKCVIEKENNFKQPGERYRSFSPDRQERFINRVVGGLSDPRVTHEVRSIWVSYWSQADKSLGQKIASRLNVKPNY

SEQ ID NO: 4610 - protein, 448 aa, Streptomyces coelicolor
MATDDAMPAKPMPRFPDGFLWGVSTSAHQIEGAAGLRGPSVWDAFTAEPGRVRDGSTAAVACDHYHRYREDVALLAGLGVDAYRFSVSWPRVDSPGGLDFYDRLVDELCAAGVRPVPTLFHWDLPAGLDWLERDTAARFAEYVSLVAERLGDRVGKWITLNEPAEHTLLGHALGVHAPGRELLFDALPVAHHQLLAHGLAVRALRAAGATDVGIANSHGPTWPASDDPADREAADFYDLLLNRMFADPLLTGRYPEGVGALMPGSAERVEADLEVIAEPLDWYGVNYYAPTRVGAPQGAEIEFGGVTLPAELPFSVRRIEGRPVTDFGWPVVPEGLTELLTGFRDRYGDRLPPVVITENGCSYEGLDDHDRIAYLDGHVRALHRAIEAGVDVRGYFVWSLLDNFEWAEGYARRFGLVHVDFTTLARTPKASYGWFRDLLDGQRRVPVG

SEQ ID NO: 4611 - protein, 217 aa, Populus tomentosa
MEEGRFQNGGGLGAKVMTDEQMEMLRKQISVYATICEQLVEMHKVVSAQQDFAGMGLGNPYCDPLLSSAVHKIGSRQRWTPKPAQLQILEQIFEQCNATPGRQKIKDITRELAQHGQISETNVYNWFQNRRARSKRKQSAVVPNNGESEMETDIESLKEKKTRAEDSQPDENTTPMADHMYFNSPDIGFDQLMGKIESPGPGSCIPYWQMEQYDLFG

SEQ ID NO: 4612 - protein, 446 aa, Methylococcus capsulatus
MRNLSRRIQSHQIRLRPPPFGAKRPVRRSESTSPPPRRRLIVGKRNRSAQVQYSMSHGLTHLSFWPLLFATLALTHVTIVSVTIFLHRHQAHRALSLHPLASHFFRFWLWLTTATVTKEWVSIHRKHHARCETPDDPHSPQCLGIFTVLLRGWMLYRKEARNTATLAQFGNGTPDDWLERKLYSRFPDLGITLMLALNLLLFGIGGLGVWAVQMLWIPFWAAGVVNGLGHHLGYRNFETPDASTNLWPIGFIIGGEELHNNHHAYPASAKFSSRRWEIDIGWLYIRLMTLLKLAKIRNMPPKTIIHTAEPSVDMDTVKAVLRNRAHVLSLYGRRVIVPVLRSEQAKSPKAGRRLLRQTRPLLLREYIKADPAAWHNFSRMLEDSQTLATIFQFKQQLKAVWTDSFTSHEERLERLRAWCLQAKQSDLPWLQHFADTLSGYRLQPAH

SEQ ID NO: 4613 - protein, 259 aa, Magnetospirillum magnetotacticum
MANTPPEIRTFLCRSDNIGVLIRDPASGACAAIDVPEAEAVLAALDAEGWRLTEILVTHRHADHIEGIPEVVERTGARVTAPDKARAAVPGAARYVSEGDTVTVGGLTATVWETPGHCADHVTYHFADAGVVFAGDTLFTLGCGRVMEAEPETLWRSLTRFLDLPDTTEVYSGHDYVLSNGRFALAADPDNAALKQRVAEAERLAETGGFLIPSTIGAEKATNPFLRAGEPALARSAGSEPGADPAAVFTALRSWKNRF

SEQ ID NO: 4614 - protein, 55 aa, Coffea arabica
KRVERSSGQFMRRFRLPENAKMDQIKAAMENGVLTITIPKEEAKKTDVRAIQISG

SEQ ID NO: 4615 - protein, 279 aa, Bacillus anthracis
MKNLQSKAVLNNGVEMPWFGLGVFKVEEGPELVEAVKSAIKAGYRSIDTAAIYGNEKAVGEGIRAGIEATGISREDLFITSKVWNADQGYEETIAAYEESLKKLELDYLDLYLVHWPVEGKYKDTWRALETLYKEKRVRAIGVSNFQVHHLQDVMKDAEIKPMINQVEYHPRLTQKEVQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 4616 - protein, 820 aa, Oryza sativa
MLCLTSSSSSAPPPLLPSLADRPSPGIAGGGGNVRLSVVSSPRRSWPGKVKTNFSVPATARKNKTMVTVVEEVDHLPIYDLDPKLEEFKDHFNYRIKRYLDQKCLIEKHEGGLEEFSKGYLKFGINTVDGATIYREWAPAAQEAQLIGEFNNWNGAKHKMEKDKFGIWSIKISHVNGKPAIPHNSKVKFRFRHGGGAWVDRIPAWIRYATFDASKFGAPYDGVHWDPPACERYVFKHPRPPKPDAPRIYEAHVGMSGEEPEVSTYREFADNVLPRIRANNYNTVQLMAIMEHSYYASFGYHVTNFFAVSSRSGTPEDLKYLVDKAHSLGLRVLMDVVHSHASNNVTDGLNGYDVGQNTHESYFHTGDRGYHKLWDSRLFNYANWEVLRFLLSNLRYWMDEFMFDGFRFDGVTSMLYHHHGINKGFTGNYKEYFSLDTDVDAIVYMMLANHLMHKLLPEATIVAEDVSGMPVLCRPVDEGGVGFDFRLAMAIPDRWIDYLKNKEDRKWSMSEIVQTLTNRRYTEKCIAYAESHDQSIVGDKTIAFLLMDKEMYTGMSDLQPASPTINRGIALQKMIHFITMALGGDGYLNFMGNEFGHPEWIDFPREGNNWSYDKCRRQWSLVDTDHLRYKYMNAFDQAMNALEEEFSFLSSSKQIVSDMNEKDKVIVFERGDLVFVFNFHPNKTYKGYKVGCDLPGKYRVALDSDALVFGGHGRVGHDVDHFTSPEGMPGVPETNFNNRPNSFKVLSPPRTCVAYYRVDEDREELRRGGAVASGKIVTEYIDVEATSGETISGGWKGSEKDDCGKKGMKFVFRSSDEDCK

SEQ ID NO: 4617 - protein, 439 aa, Aster tripolium
MKILLGVGINGGLFGSCVSSRSKVDSSTSGISSHFEIKSTNNVSKDQPTTSNSEHNLPTLTPEDELKVASRLRKFGFNDLKMATRNFRPESLLGEGGFGCVFKGWIEENGTAPVKPGTGLTVAVKTLNHDGLQGHKEWLAEVNFLGDLGNPNLVKLIGYCIEDDQRLLVYEFLPRGSLENHLFRRSLPLPWSIRMKIALGAAKGLAFLHEEAKRPVIYRDFKTSNILLDAEYNAKLSDFGLAKDGPEGDKTHISTRVMGTYGYAAPEYVMTGHLSSKSDVYSFGVVLLEMLTGRRSMDKKRPNGEHNLVEWARPHLGERRRFYRLIDPRLEGHFSIKGAQKAAQLASRCLSRDPKARPLMSEVVDCLKPLPALKDMAGPSYYLQTVQPERAGSSPDPNRTRVGSFSRNGSQHPRTLSIPNASPRHNQFLQDSPNPNGKQ

SEQ ID NO: 4618 - protein, 221 aa, Glycine max
MGSEGPPAAVTVHVTGFKKFHGVSENPTETIVNNLTEYLKKKGLSKGLVIGSCSILETAGQGALIPLYKTLQSAITSKESESSSSNKIIWLHFGVNSGATRFAIERQAVNEATFRCPDEMEWKPQKVPIVPSDVAITRIRKTTLPVEEITKSLANKGYDVMTSDDAGRFVCNYVYYHSLRFAEQNGTKSLFLHVPLFSTINEETQMQFAASLLEVLASTCQ

SEQ ID NO: 4619 - protein, 79 aa, Zea mays
RHRSDLDLCYSMSQRFLDEHHHQQLGKAEEAPPLAPASPAQPAATTNWKISSPGDSPDEVKARLKYWAQAVACTVRLCS

SEQ ID NO: 4620 - protein, 464 aa, Haloarcula marismortui
MLVSLTKCMHVFWHQRDLRIPDNRGLTAAAADDEVLPVYVLDTDLLANIGKRQKAFLLAGVRALKQAYRDHGGELLVKKGTAVDVLSNVVDEYDADRVYYNEHYRPARRNRQRRVDEALPTKSLTDLVLVDPAGLDSQYENHSRFYDDWQAHHKLPPVGSPDSGSLVDVSDPTTAPTIETEMDLPTPGYEGARQRYDDFLTGGIETYNDTRDDMQAAVERPTSAVSRMSPYLAAGMIGIREMWRDASDRHTEATGDAQRNIQKYRYELSWREQSYHLLYYNPTLLSENYKTFPNRIEWENDEDNFEAWKHGETGYPFIDAGMRQLEQEGYIHNRPRQNVASFLTKHLLVDWREGARHFRKRLVDHDPANNAASWQWTASTGTDSVDVRIFDPVAQMSKYDSGADYVTEYVPELRGVPSTKIVDWPTLSDGEREELAPDYYHPIVDRNAAYERAQRVFETALGKR

SEQ ID NO: 4621 - protein, 360 aa, Debaryomyces hansenii
MNNEQPPPQQAHTRQISFNVSDHYQILEVVGEGAYGIVCSAIHKPTNQKVAIKKIEPFERSMLCLRTLRELKLLKHFNHENIISILAIQRPINFNLFNEIYLIQELMETDLHRVIKTQKLSDDHIQYFIYQTLRALKTMHLANVLHRDLKPSNLLLNSNCDLKICDFGLARSIASSEDNFGFMTEYVATRWYRAPEIMLTFQEYTTAIDVWSVGCILAEMLVGRPLFPGRDYHNQLWLIIEVLGTPNMEDYYNIKLKRAREYIRSLPFVKKVPFANLFNSEAINPLAIDLLENLLVFNPAKRITVDNALNHPYLNIYHDPNDEPISEKIPEDFFDFDKRKDELSIEDLKKLLYDEIMKPL

SEQ ID NO: 4622 - protein, 615 aa, Magnetospirillum magnetotacticum
MCGIAGFVGDGDRDILAAMAGAIAHRGPDGEGLWIDPERAVHLAHRRLAVIDLEGGAQPMWSGDGRIGVVFNGEIYNHRALRRDLESLGHVFASDHSDTEVLIHGWRQWGRDLPGRLNGMFAFAIHDRERGSLFLARDRFGEKPLYVVERPGLFAFASEISALLRHPGVPAEADALAIRKFFAYCLFPAPHTPFKAIAKLPAGHWLELSLSGLTTERGCYWRFAIEPEETGRSETELAEELRALLDASVRDRLESDVPLGIFLSGGIDSSAMLALAARHRPAASLDGFSIGFTEASFDESAFARRMAAEVGCRHHVETCDLDAARRDLPDLLARLDEPSGDPSILPTSLLCRFARRSVTVALSGDGGDELFGGYDPLTALAASRRYRALVPGAVHPAIEALAGLLPPSDANMSLDFKIQRWLRGVGREPSMWLPGWMGALSPSEIDQVFGSRLAPEELYSEAIERWEACASPDPIDRALDYFTAFYLQDGILTKSDRASMQVALEVRAPFLDNDVADFARRLPSRFKVAGGQRKVLLKKAVRGLVPDALIDRPKKGFGIPLARWLRDMDPPTAGTPLLDDAWLRQRWERHRTKRQDCRHGLWCWLALERRFSTVN

SEQ ID NO: 4623 - protein, 706 aa, Lycopersicon esculentum
YFSIPIELVYFVQKSAVFPYRWVLVQFGAFIVLCGATHLINLWTSTPHTRTVAMVMTTAKFSTAAVSCATAVMLVHIIPDLLSVKTRELFLKNKAAELDREMGLIRTQEETGRYVRMLTHEIRSTLDRHTILKTTLVELGRALQLEECALWMPTRTGVELQLSYTLHHQNPVGFTVPIQLPVINQVFSANCAVKISPNSAVARLRPTRKYIPGEVVAVRVPLLHLSNFQTNDWPELSPKSYALMVLMLPSNSARQWHVHELELVDVVADQVAVALSHAAILEESMRARDLLIEQNVALDLARREAETAVRARNDFLGVMNHEMRTPMHAVVALSSLLQESELIPEQRLMVETILKSSNLLATLINDVLDLSRLEDGSLQLDVGTFNLHALFREVLNLIKPVAAVKKLFVTLSLSSDFPEVAIGDEKRLMQILLNVVGNAVKFSEEGSVSVSAVNAKSESLIDPRAPEFFPVQSENHFYLRVQVKDTGSGINPQDFPKLFCKFAQNQEPATKNSAGTGLGLAICKRFVNLMEGHIWIESEGVGKGSTAIFIVKLGIPGRLNESKLPFTAGLPANHMQMTFQGLKVLVMDDNGFSRMVTKSLLVHLGCDVTTIGSGDECLRILTREHKVLIMDASITGMNCYDVAVSVHEKFGKRLERPLIVALTGNTDQVTKENCLRVGMDGVILKPVSIDKMRSVLSGLLEHGTVL

SEQ ID NO: 4624 - protein, 484 aa, Hordeum vulgare
GKTLGIGSFGKVKIAEHIITGHKVAIKILNRRKIKSMEMEEKVKREIKILRLFMHPHIIRLYEVIDTPADIYVVMEYVKSGELFDYIVEKGRLQEEEARRFFQQIISGVEYCHRNMVVHRDLKPENLLLDSKCNVKIADFGLSNVMRDGHFLKTSCGRPNYAAPEVISGKLYAGPEVDVWSCGVILYALLCGTLPFDDENIPNLFKKIKGGIYTLPSHLSPLARDLIPRMLVVDPMKRITIREIREHSWFKARLPRYLAVPPPDTAQQVKKLDDETLNDVIKMGFDKNQLTESLQKRLQNEATVAYYLLLDNKLRTTSGYLGAEYQESMDSSFSQISPETPSSASEARQYGSPGFGLRQHFAAERKWALGLQSRAHPREIITEVLKALQELNVCWKKIGHYNMKCRWSPGFFENMMHNNNGFGVESAIIEADGLGDKSTHIVKFEIQLYKTRGDKYLLDLQRVSGPQLLFLDLCSAFLTQLRVL

SEQ ID NO: 4625 - protein, 883 aa, Oryza sativa
MSSAANVMLAIHEKRTTPTDLYRPLRLYIASAYSEREAAAADDDLAAVRDLRADVEQPSLPDPSSLERRRDALLAYARALSLVEPRFPISSDRANVHSLAFTWHDAFKTGKKASVASIHLEKAAVLFNLAAVYSQIALAADRATDVGIRTACGSFQSAAGAFAWMRESGVAAKAVAAGATTVDVTPECAAMLEKLMLAQAQECFFEKVIAGGKPPALCSKVARQVGIFYEEAYAALSAAPLSQHFDKTWVSHVQLKAAQFYADACYRCSLDLHEKEEIAQEIARLKIGISALADAKKVARGAGCRNRHEGNKLESNMKTNLERAMKENDRVYLMRVPDASSLGALPAASLVKPTSLAEVLDASKERLFSSLVPDGSMKALSKYTEMVDNIIRTQAEKLQQASEITRVRLKEMDLPDSILSLEGNITLPLDLKEDVEAVQISGGPAGLEAELQQLRDLSRVNQELLVQTEEMLQKEANEDAQFRTQFGSRWTRPQSSTLTKNIQDRLNLFASNLKTAGDSDSQIERGLKESYPLISILDRRPIESALPSISRPIMSLDGNEDAIVGALKQSLRQLESLGAQRAGLEDMLKEMKRKDDILPKLMAGVGSHDDLFKKEISKYDPVCAEIADNIVAQEQLLLQIQAQNEQFAAVFNLEDYKVARERCYKQIAAAVAKYRDIKKNINEGLNFYVTLQEAIGKIKQQCSDFIMTRNIQCREMIEDVQKKLAGFSFSSSSSQASMQRNTSVPPDQNSPSPPPPSSHAPHAQGPYGVPPGGDSRPGYSQPEQRPAYSQPYPPYGAPPQQPPYGAPSQQPPYGAPHPGHYQQPPHQQPPNHDYGQQAYPGGWRGQYYNPHQPQPQPQPPYPQPPYNAQGSYPPHQSSYYRPQ

SEQ ID NO: 4626 - protein, 490 aa, Unknown
  Petunia x hybrida
MGFESEKNNSVLSKLATNEEHGENSPYFDGWKAYDNDPFHPLKNPNGVIQMGLAENQLCFDLIEDWIKRNPKASICTTEGIKSFRGIANFQDYHGLPEFRRAIAKFMEKTRGGRVSFDPDRVVMAGGATGANETIIFCLADAGDAFLVPSPYYPAFNRDLRWRTGVQLIPIPCESSNSFKITTKAMKEAYENAIKANIRVKGLILTNPSNPLGTTLDRDTLKSLLNFTNERNIHLVCDEIYAATVFNTPQFVSIAEILNDEKSNFNKDLVHIVYSLSKDMGLPGFRIGIVYSYNDAVVNCARKMSSFGLVSTQTQHLLAKMLSDEEFVANFLCESSMRLGKRHKHFTNGLEQVGIKCLKSNSGLFCWMDLRHLLENSTLDSEMSLWRVIINDVRLNVSPGSSFDCQEPGWFRVCFANMDDETVEVALARIRRFVGVGVKENGEETKPVKNKEQWKKSNLRVSFSKRMYDESVLSPLSSPIPHSPLVRART

SEQ ID NO: 4627 - protein, 363 aa, Psychrobacter arcticus
MTSTLFNTVKLGKITLDNRVGVAPMTRTSATPEGLATDQMVDYYAKFARGGFGLIITEGTYSDNTYSQGYFDQPGIINNEQVTAWKKVTEAVHQEGGKVIVQLMHAGALSQGNQFTKETLGPSAVQPKGEQMAFYGGDGAFQVPKEATKDDITEVIKGFVEASKNAKEAGFDGIEIHGANGYILDQFLTDYTNKRTDEYGGSTENRVRLLEKVSRAVREAVGQDYTVGIRISQGKVNDYDHKWANKEKDAEIIFGQLAQAGLDYIHVTDFEAWQPAFGDEGPTFAALAKKYGKLPVIANGSLHDPEKAKEIVEKGGADIITLARGALSNGDWANKVKNGEKPEEFVPEKVLSPDAKIKDFETK

SEQ ID NO: 4628 - protein, 442 aa, Zea mays
MPNGGGKRWLLLLPLSRWVLLLGSLQLPAVGGSGHVVTRMRGFDGPLPFYLETGYVEVDEQQGVQLFYYFVRSERDPYEDPLLLWLSGGPGCSGISGLAYEIGPLKFDARGQGEFPTLLYRPETWTKVSNIIFVDSPVGTGFSYAKSEEGLETGDTKQVKQLVIFLRKWLQDHPRFVMNPLYIAGDSYSGLIIPTLALEIDRSIELGEKIFSGLKGYIAGNPLTGGQFDTDSQIPYFHAMGLVSDELYKCTRDINKQYILDPACPDDDLLSPKTVAETDGTSRLMLESADFLLGSKCAEALYILSYAWGNDDTVQESLGIRKGTIGAWKRYSHALPYNYDIQSVVDYHSRLATKGYRALIYSGDHDAVVPHVGTQAWIRYLNLTIVDDWRPWYVGGQVAGFTRSYASGLTFATVKGAGHVAPLYKTLECQKMFITWISGNPL

SEQ ID NO: 4629 - protein, 228 aa, Brassica napus
MALEALSSPRLASPVPTLFQDSAVGFHGSKGKRSKRSRSEFDRSLTEDEYIALCLMLLARDGNRTRHLPSSSSSPPLLPTLTSTHLHKCSVCDKAFSSYQALGGHKASHRKNSSQTQSSGGDEKSTSSAITIASHGGGGGGSVKSHVCSICNKSFATGQALGGHKRCHYEGKNGSSSEGVGSTSHVSSVSHHHHRGFDLNIPPIPEFSTVNGEEEVMSPMPTKKLRLE

SEQ ID NO: 4630 - protein, 395 aa, Arabidopsis thaliana
MASENLNDKISVFKKLKAKSDNKICFDCNAKNPTWASVTYGIFLCIDCSAVHRSLGVHISFVRSTNLDSWSSEQLKMMIYGGNNRAQVFFKQYGWSDGGKTEAKYTSRAADLYKQILAKEVAKSKAEEELDLPPSPPDSTQVPNGLSSIKTSEALKESNTLKQQEKPDVVPVSPRISRSVKKPLGAKKTGKTGGLGARKLTTKSSGTLYDQKPEESVIIQATSPVSAKSARSSFSSRFDYADNVQNREDYMSPQVVSHVAPPKSSGFFEEELEMNGGRFQKKPITSSSKLQIQETDEARKKFTNAKSISSAQYFGNDNNSADLEAKSSLKKFSGSSAISSADLFGDGDGDFPLDLTAGDLLNRLSLQAQQDISSLKNMAEETKKKLGSVASSLWV

SEQ ID NO: 4631 - protein, 305 aa, Arabidopsis thaliana
  misc_feature (182)..(182): Xaa can be any naturally occurring amino acid
MSLSASEKEENNKKMAADKAEMGRKKRAMWERKWKRLDIVKAFASLFVHFLCLLAPFNFTWPALRVALIVYTVGGLGITVSYHRNLAHRSFKVPKWLEYFFAYCGLLAIQGDPIDWVSTHRYHHQFTDSDRDPHSPNEGFWFSHLLWLFDTGYLVEKCGRRTNVEDLKRQWYYKFLQRTVLXHILTFGFLLYYFGGLSFLTWGMGIGVAMEHHVTCLINSLCHVWGSRTWKTNDTSRNVWWLSVFSFGESWHNNHHAFESSARQGLEWWQIDISWYIVRFLEIIGLATDVKLPSESQRRRMAMVR

SEQ ID NO: 4632 - protein, 373 aa, Oceanobacillus iheyensis
MNANNHDMFSPLTFKNGLELKNRLVMAPMTHYSSNPDGTVSDEEISYYARRSKGVGMVITATTYVTPNGKGFPNQFSAVEDGMIPSLSKLAKGIQNEGAKAILQIFHGGKMCPPSLIPDGDVVSASNIPANSEAAEPRPLKESEIEEIIEAFGETTRRAIEAGYDGVEIHGANGYLLQQFFSPFSNRRDDRFGGSLEKRMAFPLAVIEKVKSVVAEHADASFIVGYRFSPEEPETPGITMDETLQFVDVLADKQLDYLHVSLMDFFSKARRGVEDLNKTRISYLLETIDNRVPLIGVGSIYTAEDARKAFNTGIPLLAIGREIIIDPDWVEKVAEGRDDEIITEINKDKQEELVVPDPLWNVITHAPGWFPGV

SEQ ID NO: 4633 - protein, 464 aa, Edwardsiella tarda
  misc_feature (186)..(186): Xaa can be any naturally occurring amino acid
MKKGTDTRGGYLDSRFGSEAIRTAAEAHHFPQGEMREDIAFQVINDELFLDGNARQNLATFCQTWDDDYVHRLMDISINKNWIDKEEYPQSAAIDLRCVNMVADLWHAPRPADGQAVGTNTIGSSEACMLGGMAMKWRWRAKRLAQGKSVDKPNMVCGPVQVCWHKFARYWDVELREIPMAPGKLXMDPERMIAACDENTIGVVPTFGVTYTGNYEMPDVLHKALDDLQARTGLDIDMHVDAASGGFLAPFCAPDIVWDFRLPRVKSISASGHKFGLAPLGCGWVVWRDAASLPDDLIFKVDYLGGQVGTFAINFSRPAGRVIAQYYEFLRLGREGYTKVHTASYQVAQFLAAEIAKLGPYEFICSGDPQQGIPAVCFRIPAGKALGYSLYDLSERLRLRGWQVPAFALNGEMSDVVVMRIMCRRGFEMDFAQLLMEDFRAALAYLKAHPAVANVAHQNSFKHS

SEQ ID NO: 4634 - protein, 370 aa, Sinorhizobium meliloti
MNAPAIIPSPVFTGTSLKGLDFANRLSVAPMTRISASCAGVPGERMVRYYQRFARGGFSLVMSEGIYTDKAYAQTYSGQPGLTDREQADAWRRAVDAVHAAGGSIFAQLMHGGALSQGNPYRSDTIGPSAIRPKGSQMTGYRGDGPYAMPREISEAEIAAAIEGFAGAARLAIEVAGFDGIEIHGANGYLLDQFFTDYTNHRQDRWGGDIVARFGLSLEVLKAVRAAIGPSVPLGLRLSQGKVNDFRHKWAEREQGAARVFEALAESPADFAHVTEFEAWRPAFEGGEISLVSLARRHAPRLFLIANGSLHELARAEQVMESGADMIALGRGALVNPDWPHLTAARSALRPFELSMLAPISDIKDSELAL

SEQ ID NO: 4635 - protein, 430 aa, Arabidopsis thaliana
MSLTLEFLLLLIVLILSHHAHSGSIVKFLPGFEGPLPFELETGYIGIGEEEEVQLFYYFIKSEKNPEEDPLLLWLSGGPGCSSLTGLLFENGPVALKFEVYNGSVPSLVSTTYSWTKMANIIFLDQPVGSGFSYSRTPLVDKISDTGEVKRIYEFLQKWLSKHQQFFSNPFYVGGDSYSGMIVPPLVQEIGKGNYQINLQGYILGNPITDTESEQNYQIPYAHGMALISDELYKSMERICKGNYVKVDSLNTKCYKLIKDYQKCIHKLNKYHILLPDCDITSPDCFLYRYTLITFWANNKSVREALQVNKGSIGKWVQCNYKNISYNYDIKSSVAYHMKNSIDGYRSLIYNGDHDMMVPFLATQAWIRSLNYSITDDWKPWMINDQIAGYTRSYSNKMTFATIKGSGHTAEYKPKETSIMFKRWISAQPL

SEQ ID NO: 4636 - protein, 552 aa, Edwardsiella tarda
MAGMVIYPIVNIDFLQFLEKTQLNKPSQHATTTEESAMNIVNGINGLIAKKNVLFFLTSLAISPSVLADTLTRDNGAPVGDNQNSQTAGPNGPVMLQDVQLLQKLQRFDRERVPERVVHARGTGAHGVFTPTADISDLTVAKVFTPGSTTPVFVRFSSVVHGTHSPETLRDPRGFATKFYTAEGNWDLVGNNFPTFFIRDAIKFPDMVHAFKPDPRTNLDNDARRFDFFSHLPESTRTLTLLYSNEGTPLSYRNMDGNSVHAYKLINDKGESPLCEVHWKTRQGIKNLDPQQVEQIQGKDYSHMTQDLVTAINRGDYPKWDLYIQVLRPADLKNFDFDPLDATKAWPDVPERKIGEMVLNKNPDNVFQETEQVAMAPSNLIPGIEPSEDKLLQGRLFAYADTQFYRIGANGLSLPINKPHSVVNNGNQDGQLNSGHTLDKGVNYQPSRIYPREELVSSRYSQTPLSGTTQQSKIQREQNFKQAGELYRSYSKKEQNDLINSLGTSLASADTVSKNIMLSYFYKADKDYGTRLTSVANGDLPTVKNLADKLQD

SEQ ID NO: 4637 - protein, 640 aa, Desulfovibrio vulgaris
MTIPCSRPLFIEPFDLYLFGMGRHRHLYRILGAHPAVQDGEAGYRFAVWAPNARSVHLSGDCNGWRHEGCPLFPVGVSGVWAAFVPGVRRGSLYKFVVRGADGRQEQKADPFALWAEMRPGVASVAWDIDNHAWGDGAWMAERARQGLPLERPVSIYEVHLGSWRRRHGDGHPFLTYDELGDQLIPYATGLGFTHLELLPVAEHPLDQSWGYQTGHYYAPTSRFGSPEGFKRFVDRCHQAGLGVILDWVPAHFPRDAWSLGRFDGTALYEHLDPRLGEHPDWGTYIFNYGRNEVRNFLTANALYWLREFHIDGLRMDAVASMLYLDYSREAGQWLPNRHGGRENLDAVDFLREVNTVIHAEFPGAMTLAEESTAWPGVSRPVYTGGLGFSFKWNMGWMHDTLGYLAEDPIHRAYHHGSLTFSMLYAFSENFVLPLSHDEVVHGKGALLSKMPGDMWQQQANLRLLYAYQWAHPGKKLLFMGGEFGQWNEWDESRELDWCLYRFPAHEGIARLVGDLNRLLRSEPAMHRRDHDWSGFRWVDFADYGSSVISFLRLAAGERPLLWIFNFTPVVRRFYRVPCPRGGTWRELCNTDSAYYGGSDVGNAGAVMAREDHWGGGHFIELTLPPLAAMCFAPVTGQGT

SEQ ID NO: 4638 - protein, 163 aa, Zea mays
MDAVMFGLETPLMAALQHLLDVPDGDAGAGDNKTGGGGGATRTYVRDARAMAATPADVKELPGSYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 4639 - protein, 499 aa, Burkholderia fungorum
MTRVRRLNDTFDTGLVWLRRDLRNTDNAALYYALKHCERVWCVFVFDTTILQPLVDAWHARHPDTQPQDRRIEFILAALGELDEALRADGGGLIVLYGNPAELVPKLADELGVDAVFANHDYEPVAIERDGTVRERLAEAGRQWLTFKDQVIFERDEVLTGQSKPFTVFTPYRNAWLRQLSAFDLKPYPVETYAKRLAALPSKFDRQLPTLEQLGFAPSNLGELNLPAGMSGAQRLLDDFMTRIDSYADRRDFPAAKGPSYLSIHLRFGTVSIRTLARLAHEMSLQPDGQGSATWLSELIWRDFYFMILAHHPRLARGASFREEYDRLRWEQGLQADEAFAAWCNGRTGYPLVDAAMLQLNRTGYMHNRLRMVTASFLVKDLGVDWRLGERYFAEQLNDFDFSANNGGWQWAASTGCDAQPYFRIFNPVTQSEKFDAEGRFIKRYLPQLAKLPSKWIHAPWLAGAERLADCGVVLGKDYPAPIVDHAEARARTLARFGK

SEQ ID NO: 4640 - protein, 279 aa, Thermosynechococcus elongatus
MFMTQATVAKPPIAWPTATFIIFVHLGALLAFLPSMFSWQAVLLALVLHWLTAGIGITLGWHRLVSHRSFQVPKWLEYFLVFCGTLSMQGGPIWWVGLHRHHHLYSDQPNDHHDSRKGFWWSHIEWMFHEVPAEAEIPRFTKDIADDPVYRFLDRYFLPIQVVLAIVLYLWGGWPFVVWGIFVRLVTVYHTTWLVNSATHTFGYRTFETTDHSTNCWWVALLTFGEGWHNNHHAYQYSARHGLQWWELDLTWLTIRFLQLLGLAKKVRLVEAPAASCQD

SEQ ID NO: 4641 - protein, 542 aa, Listeria innocua
MAKDIKFSEDARRAMLRGVDQLANAVKVTLGPKGRNVVLEKKFGSPLITNDGVTIAKEIELEDPFENMGAKLVSEVASKTNDVAGDGTTTATVLAQAMIQEGLKNVTAGANPVGVRRGIEKAVATAIEELKAISKPIESKESIAQVAAISSGDEEVGKLIAEAMERVGNDGVITIEESKGFATELDVVEGMQFDRGYTSPYMVTDSDKMEAVLEKPYILITDKKINNIQEILSVLEQVVQQGRPMLIIAEDVEGEAQATLVLNKLRGTFNVVAVKAPGFGDRRKAMLEDIAVLTGGQVITEDLGLELKTATVDQLGTANKVVVTKDDTTIVEGAGDSTQISARVNQIRAQMEETTSEFDREKLQERLAKLAGGVAVVKVGAATETELKERKLRIEDALNSTRAAVEEGIVAGGGTALVSIYNKVAALEAEGDVETGINIVLRSLEEPVRQIAHNAGLEGSVIVERLKHEAVGVGFNAANGEWVNMIDAGIVDPTKVTRSALQNASSVAALLLTTEAVVADQPDENGPAAGPDMGMGGMGGMM

SEQ ID NO: 4642 - protein, 903 aa, Oryza sativa
MDSCALFLSTPRPPPPLVPAHRRRPLASRSGLRRREGCPCSCASSSSSSGRAGSQDRPPRPWQQKQRTQRPGRGEAIDPVGFLAKHGISDRAFAQFLRDRYKALKDRRWELHSRLIDLKEASSGFELMGMHRHRQHRVDFMEWAPGARYCSVVGDFNQWSTTENCAREGHLGHDDFGYWTIILEDKLREGQEPDEYYFQEYNYADDYDKGDNGVDVEELIHRMNEEYWEPGEIKSQKSRLEVVAKLYEQMFGPNGPQTEEELGDIPDAETRYNEWKALQKDDSASSLPCYDIIDNGREFDIFNVATDRVSFEKFQGKSPPLAYWVEMRKGRKAWLEKYVPAISHKDKYRVYFNTPDGGLERIPAWATYVLPDAEGKQSYAVHWDPPPEEIYKWRFERPKVKGSLRIYECHVGISGSEQKISSFQEFTSNVLPHIKDAGYNAIQLIGIVEHKDYSSVGYKVTNYFSVSSRFGSPDDFKKLVDEAHGLGLVVLLDIVHSYASADELVGLSLFDGSNDCYFHSGKRGHHKYWGTRMFKYDDIDVLHFLLSNLNWWVTEYRVDGFQFHSLPSMLYTHNGFSTFTGATEEYYNQYVDEDALIYLIIANEMLHELHPDIITIAEDATFYPGLCEPTTQGGLGFDYWVNLSIPEMWLWHLENVPEQEWSMNKIMRVLVNNNSNMLSYVENHNQSISGRKSFAEIILYEGKCSNSSVDNDLIFRASSLLNIIKLITFTTSGGAYLNFIGNEFAHPKRIEFPMSSNDYSFCLANRQWELLDKGVHKHIFNFDKDIMSLDGKERLISGGSPIVHHCDDTSMIIYFTRGPFLFVFNFNPDASYQLYSVGVDEAGEYQLILNTDETKYGGRGELTSNQYMKRTSDNRVGGCRNSLELTLPSRSAQVFKLVRILRI

SEQ ID NO: 4643 - protein, 368 aa, Pseudomonas fluorescens
MSLLLEPYTLRQLTLLNRIAVSPMCQYSSVDGLANDWHLVHLGSRAVGGAGLIFTEATAVTAEGRITAQDLGLWNDAQIEPLQRITRFITAQGAVAGIQLAHAGRKASTHRPWLGKSGSVKPEDGGWVPVGPSRIAFDPQHTPPTQLDEGQIGEVIQAFVAAAKRALEAGFKVVEVHAAHGYLLHQFLSPLSNQRQDQYGGSFENRIRLVLQVTEAVRAVWPEELPLFVRVSATDWVEDGWNPDETVELARRLKDLGVDLIDVSSGGTAANAEIPTGPGYQTRFAERVRKESGIATGTVGMITEPAQAEHILRTCQADIIFLARELLRDPYWPLHADDDLGGRKAIWPAQYQRATHRDQPIHESDLRD

SEQ ID NO: 4644 - protein, 153 aa, Zea mays
  misc_feature (33)..(33): Xaa can be any naturally occurring amino acid
  misc_feature (108)..(108): Xaa can be any naturally occurring amino acid
  misc_feature (131)..(131): Xaa can be any naturally occurring amino acid
  misc_feature (140)..(140): Xaa can be any naturally occurring amino acid
MGASVTVENLNPKGLKCEYAVRGESGIHAHRLXQQLQTQPGALPFEEILYCDIGNPQSLGQQPVTFFRGGLALCEYPCLLGKEETKSLCSAEAISRAKQILATIAGRXTGAYRHRQGIKGLRDAIAAGICXREGFPANAXDIFITDGARAGGH

SEQ ID NO: 4645 - protein, 293 aa, Nostoc punctiforme
MLSQLGATSHLSPHLTFGTISTRTVYQSTKALAEQLKTQPKAEFSLKAFRDRLRWHDSFTQRLYFHPEIAYTNRYREFDKLYTPETLSGAKQELYQAWQQGMTGFPLVDASMRQLQTMGWMNFRMRAMCATFLTINCGVSWHHGAKHYMNYLVDGDLAIDNWQWQMQAGVTNPLSDTFRIYNPSKNIAEKDPLGEFIYHWIPELRGYSLLEIEQEKYIETSNYPKVILDWSKTRKVNGKIVSDLRKQTKQRLLSQGGDEYDSAIAAKETVDKYWQHKDKEYKEYQQKLTELQE

SEQ ID NO: 4646 - protein, 328 aa, Debaryomyces hansenii
MADHQEADIDSIVDRLLEVRGSRPGKQVTLLEHEIRYLCTKAREIFIQQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLNSMEQIRRVMRPTDIPDVGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPADKKPRYPQSNNISNNRPVTPPRKPRRGSK

SEQ ID NO: 4647 - protein, 467 aa, Vigna radiata
MRLLSTIATCNSHGQDSSYFLGWQEYEKNPYDELHNPKGIIQMGLAENQLSFDLLESWLAKNPDVAGFKRDGKSIFRELALFQDYHGLPSFKKALVDFMSEIRGNKVTFDPNHIVLTAGSTSANETLMFCLAEQGDAFLLPTPYYPGFDRDLKWRTGAEIVPIQCTSSNNFQITEPALKQAYEEARKRNLRVKGVLVTNPSNPLGTTMSRSELNLLVDFIKEKKDTHLISDEIYSGTVFSSPGFVSVMEILKERNDTEEIWNRVHVVYSLSKDLGLPGFRVGAIYSENDTVVAAATKMSSFGLVSSQTQYLLSAMLGDKKFARNYIVENQKRLKRRQRMMVSGLQKAGISCLESNAGLFCWVDMRHLLHSNTFEAEMELWKKIVYQVGLNISPGSSCHCTEPGWFRVCFANMSEETLTLAMKRLKNFVVESTCTQRSALFNGTSKRKSLTKWVFRLSSRDHREQEER

SEQ ID NO: 4648 - protein, 330 aa, Arabidopsis thaliana
MQAISKVSSAASFFRCSRLVSQPCVRPCVRQLHVRKGLVSGVMKLFSSPLRTLRDAGKSVRISRFCSVSNVSSSLQIELVPCLTDNYAYILHDEDTGTVGVVDPSEAVPVMDALQKNSRNLTYILNTHHHYDHTGGNLELKDRYGAKVIGSAADRDRIPGIDVALKDADKWMFAGHEVHIMETPGHTRGHISFYFPGARAIFTGDTLFSLSCGKLFEGTPEQMLASLQRIIALPDDTSVYCGHEYTLSNSKFALSIEPTNEVLQSYAAYVAELRDKKLPTIPTTMKMEKACNPFLRTENTDIRRALGIPETADEAEALGIIRRAKDNFKA

SEQ ID NO: 4649 - protein, 443 aa, Arabidopsis thaliana
MRNLSFIVLFLLTLFFIHHLVDASLLVKSLPGFEGPLPFELETGYVSIGESGDVELFYYFVKSERNPENDPLMIWLTGGPGCSSICGLLFANGPLAFKGDEYNGTVPPLELTSFSWTKVANILYLEAPAGSGYSYAKTRRAFESSDTKQMHQIDQFLRSWFVKHPEFISNPFYVGGDSYSGKIVPGAVQQISLVTHSYIIEQGYVLGNPVTDKNIETNYRVPFAHGMGLISDELFESLERSCGGKFFNVDPSNARCSNNLQAYDHCMSEIYSEHILLRNCKVDYVLADTPNIRTDRRRTYRYFLSAFWANDENVRRALGVKKVPTGKWNRCNSQNIPYTFEIFNAVPYHVNNSLKGFRSLIYSGDHDSMVPFSSTQAWIRALNYSIVDDWRPWMMSSNQVAGYTRTYANKMTFATIKGGGHTAEYTPDQCSLMFRRWIDGEPL

SEQ ID NO: 4650 - protein, 495 aa, Oryza sativa
MEGNARGGGHSEALKNYNLGRTLGIGSFGKVKIAEHKLTGHRVAIKILNRRQMRNMEMEEKAKREIKILRLFIHPHIIRLYEVIYTPTDIYVVMEYCKFGELFDYIVEKGRLQEDEARRIFQQKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVDPMKRITIREIREHQWFQIRLPRYLAVPPPDTAQQAKMIDEDTLQDVVNLGYEKDHVCESLRNRLQNETIFQATVAYYLLLDNRFRATSGYLGADYQESLERNLNRFASSESASSNTRHYLPGSSDPHASGLRPHYPVERKWALGLQSRAQPREIMIEVLKALEDLNVCWKKNGQYNMKCRWSVGYPQATDMLDVNHSFVDDSIIMDNGDVNGRLPAVIKFEIQLYKSRDEKYLLDMQRVTGPQLLFLDFCAAFLTKLRVL

SEQ ID NO: 4651 - protein, 486 aa, Desulfotalea psychrophila
MPINSVLPGGTLSVKTQDDGALITSASNLAKFPDGFCWGLATASYQIEGSPKVDGKGMSIWDTYAHIPGKMKNNDTGDVAIDHYQRYKEDVQIMKEMGATGYRFSIAWSRIFPSGTGLANPKGLDFYNRLVDELLNAGIQPFATLYHWDLPQALQDKGGWQSRETAECFAQYAGYMAEKLSDRVKNFFTLNEFQNIVDMGHRGVDMVVQGKPVHIELAPGLKLDNQALNQVAHHTVLAHGLSVQAIRAMGKKGTKVGPAEVMFCGVPIMDSPEHVKAAELATRRLNARFLDVMLTGKYSDAYLQEAGKDAPKFTEEDLQAIGSPVDFVGINVYIPKMYVMASEDESGYKEVPMSVSHPKMSSPWHTFAPEVLYWAPRLTHSIWKPKAIYITENGCAASDEISADGNIYDTDRVMYLRNAMGQLQRASAEGVPIKGNFVWSAFDNLEWSGGFGTRFGLVHVNFKTQKRTPKLSAKWFKEAAGHNAVL

SEQ ID NO: 4652 - protein, 918 aa, Escherichia coli
MTNYSLRARMMILILAPTVLIGLLLSIFFVVHRYNDLQRQLEDAGASIIEPLAVSTEYGMSLQNRESIGQLISVLHRRHSDIVRAISVYDENNRLFVTSNFHLDPSSMQLGSNVPFPRQLTVTRDGDIMILRTPIISESYSPDESPSSDAKNSQNMLGYIALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELTPTQRDHLNTIERSANNLLAIINDVLDFSKLEAGKLILESIPFPLRSTLDEVVTLLAHSSHDKGLELTLNIKSDVPDNVIGDPLRLQQIITNLVGNAIKFTENGNIDILVEKRALSNTKVQIEVQIRDTGIGIPERDQSRLFQAFRQADASISRRHGGTGLGLVITQKLVNEMGGDISFHSQPNRGSTFWFHINLDLNPNIIIEGPSTQCLAGKRLAYVEPNSAAAQCTLDILSETPLEVVYSPTFSALPPAHYDMMLLGIAVTFREPLTMQHERLAKAVSMTDFLMLALPCHAQVNAEKLKQDGIGACLLKPLTPTRLLPALTEFCHHKQNTLLPVTDESKLAMTVMAVDDNPANLKLIGALLEDMVQHVELCDSGHQAVERAKQMPFDLILMDIQMPDMDGIRACELIHQLPHQQQTPVIAVTAHAMAGQKEKLLGAGMSDYLAKPIEEERLHNLLLRYKPGSGISSRVVTPEVNEIVVNPNATLDWQLALRQAAGKTDLARDMLQMLLDFLPEVRNKVEEQLVGENPEGLVDLIHKLHGSCGYSGVPRMKNLCQLIEQQLRSGTKEEDLEPELLELLDEMDNVAREASKILG

SEQ ID NO: 4653 - protein, 665 aa, Geobacter metallireducens
MCGITGFMDFSLQCGPDAMRANARRMADALMHRGPDDSGAWCDQGAGVGLAHRRLSILDLTPAGHQPMESRSGRFTIVFNGEIYNHQALRKELAAFEPWRGHSDTETLLAGFEAWGIEATLKRTVGMFALAVWDNAERTLTLARDRMGEKPLYYGWNQGVFLFASELKALRAYPGFDAEINRDAIALLMRHSCIPTPHSIYRGIYKLWPGTILTLRNTGRGIAPWDAADPPFKLFQGEGVSLRPYWSLLEAAEQGHARPFEGTESEAIGELERVLTEAVLAQQISDVPLGAFLSGGVDSTAIVALMQAHSSRPVKTFTIGFHEDDCNEAKYAGEIASRLGTDHTELYVSPGDSLAVIPRLPQLYDEPFSDPSHIPTFLVSLLAREHVTVSLSGDGGDELFGGYVRHTLLHRIWNNIGWCPLPMRKALSDKIRFLSPGQLQAVLRNLPFIDRVHAPVYKAYRLAELIRADSPASMYEICISHWQQDDPVVVGGQSPFHASSGRMPRQLDSFSLPEKIMLMDSVTYLPDDILVKIDRAAMGVSLETRVPFLDHRVVEFAWRLPLGLKIRGGQSKWILRQVLNRHIPKELVERPKHGFGIPLGTWLRGPLREWAEELLNESRLLREGFLDPRPVRQKWLEHVSGRRDWEFHLWDVLMFQSWLEQERRP

SEQ ID NO: 4654 - protein, 545 aa, Bacteroides vulgatus
MAKDIKFNIDARDELKKGVDELANAVKVTLGPKGRNVIIEKKFGAPHITKDGVTVAKEVELADAFQNTGAQLVKSVASKTGDDAGDGTTTATVLAQSIVGVGLKNVTAGANPMDLKRGIDKAVAKVVESIKSQAEMVGDNYDKIEQVAAVSANNDPTIGKLIADAMRKVSKDGVITIEEAKGTDTTIGVVEGMQFDRGYLSAYFVTDTEKMECVMEHPYILIYDKKISNLKDFLPILEPAVQSGRPLLVIAEDVDSEALTTLVVNRLRSQLKICAVKAPGFGDRRKAMLEDIAVLTGGIVISEEKGLKLEQATLEMLGTCDKVTVSKDNTTIVNGAGAKENIQERINQIKAEIKNTTSDYDKEKLQERLAKLSGGVAVLYVGAASEVEMKEKKDRVDDALCATRAAIEEGIVPGGGVAYIRASEALEGLKGDNEDETTGIEIIKRAIEEPLRQIVANAGKEGAVVVQKVREGKGDFGYNARTDVYENLHAAGVVDPAKVTRVALENAASIAGMFLTTECVIVEKKEDKPEMPMGAPGMGGMGGMM

SEQ ID NO: 4655 - protein, 679 aa, Magnaporthe grisea
MGSARVIYWFRTDLRLHDSPALQAALDLDPAVLWPIFTWDPHYVYRSRGGLNRWQYLLDCQNDLSASITNLNPRSKLFVLREAPQSLFPKLFKAWKVTHLVFEKDTDAYARQRDEVVKKAAQAAGVKVITRYGRTLWDSDAIVKANGGEPTMSMARLRTVGAKVGSIPRPIPAPKALPDPGEMPLDFNLDLPDVGQDYNAKWRSEGKEKAYGAIAGPNGDFAIETLEELGYPPATTPYKGGESLALRELDAIIENQVYTATFRKPQTSPAAFEPQSTTLLSPAMHFGSLSVRLFYHRVQDTVDAYNQAKKKGASLPPESLTGQLLFRDMYFAAQAAIGPCFSQTAGNAHCRFIPWHLPSHVEDNAVSGQVLRKFEYEVDSEQAESWFRRWEAGQTGFPWIDALMRQLRVEGWIHHLGRHSVACFLTRGGCYVSWERGLDVFEELLLDHEPACNAGNWQWLSCTAFFSQYFRCYSPISFGKKWDPDGTFIRKWVPELASLDKKYIYEPWKAPEAELRRAGVVMVSGHDFGVKTEQGKHKAGAVRVKKEGGVGGGGASGTYFTPMFDFDERRRVCMRLMKQAYDAGLKGDDLRVLNGSWRDLFAEEDKPDIDMLDGDAKHHESDEGEFADDAEPKIKREDSGDGSGPGRATRASKREKKPAKGQSTLDGHFLTKRQKTDQK

SEQ ID NO: 4656 - protein, 408 aa, Chlamydomonas reinhardtii
MQVTMKSSAVSGQRVGGARVATRSVRRAQLQVVASSRKQMGRWRSIDAGVDASDDQQDITRGREMVDDLFQGGFGAGGTHNAVLSSQEYLSQSRASFNNIEDGFYISPAFLDKMTIHIAKNFMDLPKIKVPLILGIWGGKGQGKTFQCALAYKKLGIAPIVMSAGELESGNAGEPAKLIRTRYREASDIIKKGRMCSLFINDLDAGAGRMGDTTQYTVNNQMVNATLMNIADNPTNVQLPGVYKNEEIPRVPIVCTGNDFSTLYAPLIRDGRMEKYYWNPTREDRIGVCMGIFQEDNVQRREVENLVDTFPGQSIDFFGALRARVYDDMVRQWITDTGVDKIGQQLVNARQKVAMPKVSMDLNVLIKYGKSLVDEQENVKRVQLADAYLSGAELAGHGGSSLPEAYSR

SEQ ID NO: 4657 - protein, 581 aa, Cryptococcus neoformans
MNPLRSRAALPRPARLIQNAAVQKRGFASKDVVFGNDARQGMLKGVDVLAKAVAATLGPKGRTVIIGQSFGGPKITKDGVSVAKAITLKDPVENLGARLVQDVASKTNDTAGDGTTTATVLARAIYSEGVKNVAAGCNPMDLRRGAQKAVDKVLEVLAANKKVITTSEEIAQVATISANGDTHVGAIIAQAMEQVGKEGVITVKEGRTIDDEIEITEGMRFDRGFISPYLITDTKNQRVELEKPFILLSEKKISALQDILPSLEIAAQTRRPLLIIAEDIDGEALAAVILNKLRGQLSVAAVKAPGFGDNRKSILGDIAILTGGTVFTDELDVKLEKATPDMFGTTGSVTITKEDTIILNGEGDKSLIQSRCEQIRALINDSSTSDYDRTKLQERLAKLGGGVAVIKVGGSSEVEVGEKKDRYDDALNATRAAVEEGIVPGGGTALLKASTALEDIAVDNFDQKLGISMIRQAIRRPVRTIVENAGEEGSVVVGRLLSEEFAAPEKFNWGYDAQTSQYRDMIAAGILDPLKVVRTALVDASGVASLLTTSEACVVDAEEKTPPSGMGMGGMGGMGGMPGMM

SEQ ID NO: 4658 - protein, 736 aa, Burkholderia fungorum
MSEHDPAAGLQPLDIDALVEARHPDPFSQLGLHHTDAGPVVRALLPNAAHVSVISRADGALLGELEQLRPGLFAGRITSAAPYRLRIDWHGVVQEIEDTYSFGPVLGDEPLGRLAGGDPYAVLECLGARPMEVDGVPGVRFAVWAPNARRVSVVGDFNAWDGRRHPMRLRHQAGVWELFVPRVGPGTRYKYELLSRDGHPLPLKADPCAMQTEKPPGTASIVAHVDEVEQFPWSDHEWIQSRAGKQTARSPISIYEVHAESWLRVAEEGQRGLDWEELAERMIPYVKSMGFTHVEFMPIAEHPFGGSWGYQPLGQFAPSARFGKPEQFARFVDKAHEAGLGVILDWVPAHFPNDAHGLIDFDGTPLYEHADPREGYHQDWNTMIYNLGRNEVSAFLIASGLAWLKRYHVDGLRVDAVASMLYRDYSRAADQWVPNIYGGRENLESIAFLKRLNHEVGYVPGVPGAITIAEESTAWPGVTARVEDGGLGFQFKWNMGWMHDTLHYMEEDPVYRQYHHHNMTFGMVYAYSERFVLPLSHDEVVHGKGSLLGKMPGDRWQKFANLRAYFGFMWTHPGKKLLFMGGEFGQLAEFNHDASPHWHLLDDSNHHGVQMLVRDLNRLYSDEPALYLLDCEPGGFEWLIGDDSGNSVFAYRRTDGAGRELVVVCNMTPVPRLGYRIGMPRGGRWVEVLNTDAGVYGGSNMGNGGLIHTDSQSSHGWPHSAALTLPPLATIVLRAD

SEQ ID NO: 4659 - protein, 368 aa, Pseudomonas syringae
MSLLLEPYTLRQLTLRNRIAVSPMCQYSSVDGLANDWHLVHLGSRAVGGAGLVMSEAMAVTPDGRITPEDLGLWNDEQIEPLQRITRFINAQGAVAGIQLAHAGRKASTWRPWLGKHGSVPLNEGGWTPVGPSAIAFDPQHTAPVQLSETQIKELIEAFVESARRALTAGFKVVEIHAAHGYLLHQFLSPLSNQRTDQYGGSFENRIRLTLQVTEAVHAVWPEELPLFVRVSATDWVEDGWNADETVELARRLKALGTDLIDVSSGGTSANAEIPVGPGYQTRFAERVRKESDIATGTVGMITDPAQAEHILRTGQADIILLARELLRDPYWPLRADEDLGGRLATWPAQYQRATHRDQPIHESDLRD

SEQ ID NO: 4660 - protein, 412 aa, Unknown
  Burkholderia sp. 383
MKPIQKSNKLLNVCYDIRGPVLEHAKRLEEEGHRIIKLNIGNLAPFGFDAPDEIIQDMIRNLPTSSGYSDSKGVFSARKAVMHYTQEKGVVGVGLDDIYIGNGASELIVMATQALLNDGDEVLLPAPDYPLWTAAVSLSGGTPVHYICDEQNAWMPDPDDIRRKITPNTKAIVVINPNNPTGALYSDELLLELLAIAREHGLIVFADEVYDKIVYDGLEHTALGSLSEDVITVTFNSLSKSYRSCGYRAGWMAVSGLGGDNRRRAKDYLEGLGILSSMRLCANVPGQFAIQTALGGYQSINELIVPSGRLYKQRELAYDMLTSIPGVTCVKPQAALYMFPRLDPKLYPIQNDQQFILDLLLEERVLLVQGTGFNWTTPDHFRVVFLPNLDDLTDSINRIARFLDGYRKRHSA

SEQ ID NO: 4661 - protein, 206 aa, Nicotiana tabacum
EAGRMGGTTQYTVNNQMVNATLMNIADNPTNVQLPGMYNKQENARVPIIVTGNDFSTLYAPLIRDGRMEKFYWAPTREDRIGVCTGIFRTDNVPAEDVVKIVDNFPGQSIDFFGALRARVYDDEVRKWVSGTGIEKIGDKLLNSFDGPPTFEQPKMTIEKLLEYGNMLVQEQENVKRVQLADKYLKEAALGDANADAINNGSFFAS

SEQ ID NO: 4662 - protein, 864 aa, Vibrio fischeri
MTLLDHFSIKSRVLVITFVPLILISLFFSKETYDHIKSNNNLHRISANLKLNQLLFSYINTVHMVRMSFLSETNTSSESLDSDILINRMLLKTINIESAKLHKEISKLDSITKRENNTLDTIIQKNESQINSLNNVYRLLINNISTSKFEYINQKLNLLNQLELIHYWALNEDWYTQLYSHLPSQKFEKQIDRFYYQQYLYIADLIQTEEPNSDFQALKTAFDAKQSSQTDTNNYLFQIEKNRNTVLSELEQKVKNRIKNHQLTITGYSILLISLFILITGIGLSLLSRIRSYLKMVSLSMSNIEKNHDYSIKLSENGKDELTVFSSEMNTLIAKRHQNEKKLINEKEEAENANKAKTTFLANMSHEIRTPLNGIIGMSGVLAETKLTPIQLDYLNTIETSSQTLLVLINDILDLSKIEAGNFAIYSQPSNVREVIFDTLSIDIAKATEKNLDLHIHISPDVPNFLTLDEHRVKQILMNLTSNAMKFTHKGFISISVNFSHRVENEGYLTIAVKDSGIGINTNAKENILNPFIQGDSSITRRFGGTGLGLTITNQLIELMGGTLDIESEQEKGSRFSFRIKTNIVNKKLPIPEKLEKLTIILVDDNSGLSRSLTEELHRYHINNIIVKKETDKITIFDSSKAIILYCVTSCLEENCREKLINIHNKNLNTPLILVQKHKSRITTLDSIIDGLVTFPILGHRFIKTLENSLSIHQENQISINDVMNSTPLHSKSQNGKTSLNKEHILIVEDNLVNQKVASLFLGNSGYTFDIANNGQEAVEKFTDSEAYNIILMDCMMPVKDGFTATKEIRKVEKNQKRKKIPIIALTASILDQDISKCYESGMDDFIAKPFKKEILLEKIMTIK

SEQ ID NO: 4663 - protein, 482 aa, Listeria monocytogenes
MSNTKFPDGFMWGGATAANQFEGGYNLGGKGLACADLFTGGTHTEPRRITAQLEESTFYPSHEAVDFYHHYKEDIKLMAEAGFKVFRMSINWTRIFPTGKEAEPNEEGLQFYEDVFKELKKYQIEPLVTIAHFDIPLALTNEVNGWASRDLIDYYLHYCEVIFKRYKHLVKHWLTFNEINTATMEIGNYLSLGIRHAEGDFLHQKDDPTVRYQALHHQFVASAKAVKLGHSINPEFMIGCMIAYMPRYPRTCEPTDVLLAKQTEAMHSHFCGDVHVKGYYPFYAKTFFKDNGIELEFDPEDEQVLREGTVDFYTFSYYLTLCASNDPAYKNSGKSVIGGAENPYLKTNDWGMQTDPVGLRIALNDLYTRYNIPLMVVENGLGAFDKLEDDGTINDPYRIDYFKEHILQMHKAIQDGVDLIGFTIWGCIDLVSASTGEMAKRYGIIYVDKYDDGTGDYSRKKKASYYWYKDVISSNGEIGLRE

SEQ ID NO: 4664 - protein, 571 aa, Striga hermonthica
MCGILAVLGVSENSQAKRSRIIELSRRLRHRGPDWSGLHNHQNCYLAHQRLAIIDPTSGDQPLYNEEKTVFVTVNGEIYNHKELREKLKSHVFRTGSDCEVIAHLYEEYGEEFVNMLDGMFSFVLLDTRDNSFIAARDAIGITPLYIGWGLDGSTWFASEMKALSDDCERFMTFLPGHIYSSKSGGLRRWYNPPWYAEQIPSAPYEPLVLRAAFEKAVIKRLMADVPFGVLLSGGLDSSLVASVASRYLADSPAAQWGTQLHTFCIGLKGSPDLRAAREVADYLGTRHHEFHFTVQEGIDALEEVIYHIETYDVTTIRASTPMFLMSRKIKSLGVKMVLSGEGSDEIFGGYLYFHKAPNKEEFHEETCRKIKALHLYDCLRANKATSAWGLEARVPFLDKEFIDVAMGIDPEWKMIRPDLGRIEKWILRNAFDDEEKPYLPKHILYRQKEQFSDGVGYSWIDGLKDHANQQVTDAMLANANFVYPENTPTTKEAYYYRTVFERFFPKNAARSTVPGGPSVACSTAKAVEWDASWSKNLDPSGRAALGVHVAAYDEAKMAGEGPTANGSPKE

SEQ ID NO: 4665 - protein, 164 aa, Legionella pneumophila
MGSLRKHQPGKTTDLLMSPFLRLQQEVNHAMSDFYNLFAPQRSANLEQFEHISLTPSLDIVEDKDNFKIEVEMPGMGEEDIKVSFCENRLTIEGEKTTSKKDENKNYISREISYGRYERTISLPLSADVDKATASFKKGMLWITIPKKTEARENVKTIKIEKAK

SEQ ID NO: 4666 - protein, 589 aa, Candida albicans
MLELNSITIPRNFTEFQLTALKIYYQLKILFLATYCAQGSFGLNGSVCLARDIFVGYVVYTQLLKLYRVLRGYGIVDSIRRLYLYVSSTVSSQIFSLPFIKSKIDKELQATIGKVEEEIMKNDPQLLQFPELPEQGIDADNVSLELDKLQNLKHSDWINGRVSGAVYHGGENLLSLQVEAYKKYSVANQLHPDVFPGVRKMEAEVVHMVLDIFNAPSDGCGSTTSGGTESLLLAGLSAREYGKKYRGITEPEVIAPVTIHAGIEKACFYFGMKLHKVDLDPVTFQVDVKKVERLINSNTVLICGSAPNYPHGIIDDIESLSKLAVKYNIPLHVDACLGSFIVSFLEKSKVHGDRKLPIFDFRLPGVTSISCDTHKYGFAPKGSSIIMYRSPKLRECQYYIASDWTGGMYGSPTLAGSRPGALVVGCWATLINIGKQGYTKFCYDIVSASMKVKRAIETDPILSKHLQIIGDPIGSVISFQLAPQQSGNLSIYEISDLLTKKGWHFATLQNPSALHFAFTRLTVPVVDELIADLVEATKEAVAIAEEHKKNGVTKAPGDTAALYGIAGSVHTAGLADRLIVAFLDTLYKI

SEQ ID NO: 4667 - protein, 690 aa, Yersinia pestis
MNKFVRLAAIAGLLLAGASYATDTTYRIDQLPQLRQEPEHATVSERVTSRFTRSHYRQFALDDQFSAKIFDRYLNMLDYSHNVLLASDVAQFADKKYSLDKELKSGQLDTPFALFNLAQKRRFERYQYALSVLDRPMVFTGNDTIDIDRAKAPWPSSEAELNALWDAKVKYDQLNLKLAGKTDKEIKETLTKRYQSAIKRLTQSNSEDVFQLIMNAFAREIDPHTNYLSPRNTEQFNTEMSLSLEGIGAVLQMDDDYTLINSMVPGGPAAKSKTIAVGDRVIGVGQAGKPMVDVIGWRLDDVVALIKGPKGSKVRLEILPAGKGTKPRTVTLTRERIRLEDRAVKMSVKTIGKERVGVLDIPGFYVGLTEDVKVQLQKLEKQNVSSIIIDLRSNGGGALTEAVSLSGLFIPSGPVVQVRDNNGKVREDSDTDGVVYYKGPLVVLVDRYSASASEIFAAAMQDYGRALIVGEPTFGKGTVQQYRSLNRIYDQMLRPEWPALGSLQYTIQKFYRVDGGSTQRKGVTPDIVMPTGVDPAETGENFEDNALPWDRINAASYTKTGDLKPWEPELLKNHAERIAANPEFQYIQKDIERYKALKDKRNIVSLNYAQREKENRDDDMTRLTRLNERFIREGKKPLKSLDDLPKDYQEPDPYLDETVNIALDLAHKEKAQPQIASRPVAAATAGATVK

SEQ ID NO: 4668 - protein, 331 aa, Methylobacillus flagellatus
MLKLSEFLVQQERQHAVADNVLTLIQDIAATCQAVAREIRYGALRGNMGSAGRENVQGEEQKALDVISNDIFTAMASKQPHVAAVASEEMAQAQVFAGKQGKYLLVFDPLDGSSNVNLNLSVGSIFSILPAPEGSVDEASFLQAGSRQLAAGYALYGTSTMLVLTMGHGVHGFTLDPDQGEFYLTHPGLTIAASTEEFAINMSNQRFWQPPVQRYIAECIAGSSGPRGKDFNMRWVATMVAEVHRLLVRGGVFLYPLDSRAVGRGGRLRLLYEANPMSLLVEQAGGLATTGHRRILDVEPAGLHQRVAVMMGAREEVERLQDYHSFTDPTA

SEQ ID NO: 4669 - protein, 369 aa, Gibberella zeae
MTRITTPINIGRCALKHRVLMAPLTRLRADNHVPLDVMVDYYSQRASVPGTLLITEATFISEKSRGRDEHAPGIYTREQVDAWKRVTDEVHKKGSFIYMQLWHVGRAAKQDVLDKAGLEMVSSSDVPIGDEYPKPRPLTEDEIWESIKSFATASRNAIEAGFDGVEIHAANGYLIDQFTQDVCNKRTDKWGGSVENRSRFCVEVAKAVSKEIGPDRTGIRLSPFSTFQGMRMEDPEPQFTHLISELKPLGLAYLHLIEPRIAGNVDKVVDDDKESLDFALDAWAKSGPVVLAGGYTAEKANEALETRFKDEAVAFAFGRHFISNPDLAFRLANDVPLTHYNRDTFYKVKSPDGYTDYPYSEAWIEQQRV

SEQ ID NO: 4670 - protein, 110 aa, Zea mays
MVMVAARLRSSYEPLAAAYYFCPQPQLPISTDDPAVSKSRLMRQPRRSSSFVKAEACSAERSDGRVTRTTSLTEDDLEELKGCLDLGFGFAYSEIPELCGTLPALELCYS

SEQ ID NO: 4671 - protein, 469 aa, Methanothermobacter thermautotrophicus
MTAMCAIAGFRGDDAPVKVQEMLDVLRHRGPDATGIYHDSRIVIRTATGEDVKEAPQSAEIAVGHNLLSIVGGPQPVSGDGVLVFNGEIYNQEELNWTGSDSELILDLIEGHGGDLEDALRFTVNKIDGDYAFAYTDGENLASRQDPVGVKPLYHSGEAFASEKKALWRIGLRNVETLPPGHAMINGVKVKLRGLPRAEPSDAEPEELRENLKSALRESVERRVRGLDEAALVFSGGVDSTLLAVLLDEHIDVRLYTVGLPGSSDPQFASRAAADLGMELEVLEVTEDTIREALPHVLGAIEEYNLMKIGVAMPLYLASEAASADGYRVMFSGQGADELFAGYHRYRRLLAEGRLEDALRHDLENIHHVNLERDDAVTMANSVELRVPFLDLQLIGVALTIPADLKIRGPEDELRKRILREAALEMGVPEYIAMRPKKAAQYGSGIDKVLRRKVLPGFDHETFLRRLMF

SEQ ID NO: 4672 - protein, 500 aa, Oryza sativa
MVLTHVEAVEEGSEAAAAVFASRYVQDPVPRYELGERSISKDAAYQIVHDELLLDSSPRLNLASFVTTWMEPECDRLILEAINKNYADMDEYPVTTELQNRCVNIIARLFNAPVGDGEKAVGVGTVGSSEAIMLAGLAFKRRWQNRRKAAGKPHDKPNIVTGANVQVCWEKFARYFEVELKEVKLTEGCYVMDPVKAVDMVDENTICVAAILGSTLTGEFEDVRRLNDLLAAKNKRTGWDTPIHVDAASGGFIAPFIYPELEWDFRLPLVKSINVSGHKYGLVYAGVGWVIWRNKEDLPEELIFHINYLGADQPTFTLNFSKGSSQIIAQYYQFLRLGFEGYKSVMKNCMESARTLREGLEKTGRFTIISKEEGVPLVAFTFKDGAGAQAFRLSSGLRRYGWIVPAYTMPAALEHMTVLRVVVREDFGRPLAERFLSHVRMALDEMDLAARAPVPRVQLTIELGPARTAGEEASIRVVKSEAVPVRKSVPLVAGKTKGVC

SEQ ID NO: 4673 - protein, 447 aa, Eremothecium gossypii
MASQEEFYRTQIFGTVFEITNRYADLNPVGMGAFGLVCSAVDTYTQQPVAIKKIMKPFSTAVLAKRTYRELKLLKHLRHENLICLEDIFLSPLEDIYFVTELQGTDLHRLLQTRPLEKQFLQYFLYQILRGLKYVHSAGVIHRDLKPSNILINENCDLKICDFGLARIQDPQMTGYVSTRYYRAPEIMLTWQKYNVEVDIWSAGCIFAEMIEGKPLFPGKDHVHQFSIITDLLGSPPKDVIDTICSENTLKFVTSLPHRDPVPFTERFKNLKPDAVDLLEKMLVFDPKKRITAGDALTHPYLAPYHDPTDEPVADAKFDWNFNDADLPVDTWRVMMYSEILDFHQVPDSQINPNDTFDDQVAAATAAAEAARQQQQQKQQQQKQQQQRHQGVEHGAQHVQLQHGAKQLSADPLVGDSNGGIPLNVSAANETLNNFANQAAQYATDFE

SEQ ID NO: 4674 - protein, 366 aa, Unknown
  Silicibacter sp. TM1040
MTTLFDPIKVGALSLPSRIAMAPMTRSRTDQPGNLPNDMMAAYYAQRASAGLIITEATQISRQGQGYSFTPGIHSDDQVAGWRVVTQAVHEAGGRIVNQLWHVGRMGHGMFHADGLPVAPSAIAPDASVWVVDPKTNRAGMVECPVPRALKTTEIAEVVADYAAAARNAKVAGFDGVEIHAANGYLIDAFLRSSSNKRQDRYGGSVQNRIRFAIEVVEAVAAEIGADRVGLRISPFITQRGMDDPSAPETILEMAKALARIGIAYIHIAEADWDDAPETPRAFRAALREVFSGSILVAGGYDKERAKVILDAGLADVVAFGRAFVANPDLPHRFAQDLPLSAFDSETLFGGDHQGYTTYGPYAPGA

SEQ ID NO: 4675 - protein, 556 aa, Prosthecochloris aestuarii
MKRWYRQLLLSSVVVLTTASFFFHPLFARQSGMFSIVRSIDLLGDVFREVSLSYVDSIDVGKFMFAGIDGMLETLDPYTVFLDKEESVELGEITSGQYGGIGVTIAGIDNGVYVVSVLDGFSASRAGIKVGDQLISVDGISIRQDSLETVKNLLKGTPGTSLNLVLRRYGAQANRKLTLTRQEIRVNSIRYAGLIGDIGYFEMSSFGNRSAEELSAAISELNAEAEGSGQRMKAVILDLRNNPGGLLDVAVDVTGLFVRQGSEVVSIRGRLPESENRYVTKRDPVAGDLPLSVLINSKSASASEIVAGAIQELDRGVVIGARSFGKGLVQSIIPLPYDCKLKMTSARYYTPSGRLIQKYHAREDGWRSVIHGPGRQDSSRVFYTLNRRKVYGGGGILPDIPVSEPEFDDYEAKLQKKGMFFRYASAYRSLHPKAPGLPMKREGLLKGFNAFLEEERFSFESEPEVLLDQMKLSTAELGRSSRLDSLFNEVEREVSMLTERYRVDDRERIALAVEREILRHYDEDAARRLSLEQDPVVKKALDVLNSPKQYRSVLKP

SEQ ID NO: 4676 - protein, 107 aa, Hordeum vulgare
MAEAAQGGGLRGRGVLLGGVQDAPAGRENDLETIELARFAVAEHNAKANALLEFERLVKVRQQVVAGCMHYFTIEVKEGGAKKLYEAKVWEKAWENFKQLQEFKPAA

SEQ ID NO: 4677 - protein, 624 aa, Burkholderia fungorum
MPFGAQLIGATGAKPRTRFRFWAPSCKHVQVEIENGPAQGAHDMTPAGNGWFEASVDSGAGTLYRFRLDGEHAVPDPTSRFQPQDVHGPSEVIDPRAYRWQQTNWHGRPWEETVLYELHVGALGGYAGVQKRLPELAALGVTAIELMPLNDFPGKHNWGYDGVLPYAPDSAYGRPEDLKALIDAAHGLGLMVFLDVVYNHFGPDGNYLHEYARSFFREGTHTPWGPAIDFERSEVSDFFTDNAVYWINEYRIDGLRFDAVHAIDNHAWLRELSDHIRARVQHGRHVHLVLENEHNSANLLETHFDAQWNDDAHNTLHVLLTGETEGYYHAYEDQPIRRLARVLSEGFAYQGDPSPIHDGKPRGEASAHLPPTSFVMFLQNHDQVGNRAFGERLRKLTSDEALRAATGLLLLSPQIPLLFMGEEYGSTQPFLFFTDYTGDLADAVREGRRREFARFSSFSDEKRRAQIPDPNDVKTFAASSPPAPDETSQHTDAEAKDRLDWMHFYKSALAVRARLITPRLKHSKACGATVLSAANGGDANALIARWKLGDGETLSIALNLSKENVALADLPAGKVIFETPPRVREQVDVKVLPAHAFVAWLTGDVSGYAIRHDARIAGQQERHA

SEQ ID NO: 4678 - protein, 245 aa, Glycine max
MRALTSSSSTFIPKRYSFFFFLSILFALRSSSGGCSEYHHHHAPMATIGGLRDSQGSQNSVQTEALARFAVDEHNKKQNSLLEFSRVVRTQEQVVAGTLHHLTLEAIEAGEKKLYEAKVWVKPWLNFKELQEFKPAGDVPSFTSADLGVKKDGHQPGWQSVPTHDPQVQDAANHAIKTIQQRSNSLVPYELHEVADAKAEVIDDFAKFNLLLKVKRGQKEEKFKVEVHKNNQGGFHLNQMEQDHS

SEQ ID NO: 4679 - protein, 864 aa, Vibrio fischeri
MNNNMSLKKKSILALACYVCFLITVIGSITYCVVEPPIRENLENNLNLRTQLLAREIEDPLNHSLSILHALVGVAASGYSIDVLEDMTYSVFKESDDIIISGGIWPEPNTLEPSKQLASIFYSRDERGKITSVNDYNIPSNTPYQQESWYTSVSHENSSHNISWSEVYIDPFTKQKMITASQPYFENNQFVGVATIDISLKGLIGVIESQAEKHQLGISVYDGNTTIAEYKFAVDESMYVVELFMDDLRWELKVVNSVLTVADETFAQVVNIELGIVPILLACVILAYYFINRSLINPIVLISQQVNERESSEKIDINYGYKDEIADLIYSFNQETEYLEIEKSKAEALAKAKSSFLANMSHEIRTPLNGIIGMSDILTETDLTPVQSEYVETIDTSSQTLLLLINDILDLSKIESGNLVIVPQESNVEEVAYDTLTVILSKATEKGLALQVDIANDLPELVMLDEHRLRQVLMNLMSNAVKFTQDGAVILSINYQQKENGRGLLFFSVKDTGIGISKDKCEQIFEPFTQEDSSITRQFGGTGLGLAICRQLVEMLGGELKVDSEKGFGSKFHFILDVEVIEPTHKGLEEYAQSSCVIVSNHMLYATQLEMECKKLGINSRIVQKFVPQDDLISQSDVVIYCQKSSSEALNHVRLMNEYKHRPAIIICKKHQDEKVDFERTIEGVITYPLLGKRFYKVMKQAFIASQSHQGIVSEVKTSGDSEYGEMIDLPHKRKDNLDIIKTVLVVEDNAINQKVASLLLKKAGFCVEIANNGQEALDMVMSKTSPYSLVLMDCMMPIMDGFAATEAIRKWEENQEQKRLPIIALTASVFIEDIDKCYQSGMDDYVAKPFRKELILEKLEAYT

SEQ ID NO: 4680 - protein, 507 aa, Porphyromonas gingivalis
MKEALRKLETAVYAISSLYVDSVDNNKLTEYAIRGVLSELDPHSVYSDAEETKSELEPLNAGFDGIGVQFNMLTDTVYVVQVIAGGPSEKAGLLAGDRIVSVDDTVIAGIKMKTNDVMKRLRGPRGSKVKLGVWRGNDRLNITVKRGLVPVHSREACYMVDERTGYIRLSRFSRTTYDEFAEGIALLRGRGMQQLVLDLRFNGGGILDQAVEMAGTFLPEGSTVLTVRNNRMPRISERMEATSNNLLPKDLPLVVLVNEFSASASEILAGAIQDWDRGVVIGRRTFGKGLVQRPLPFQDGSMIRLTIARYYTPSGRSIQKPYAKGNFKAYEQELIGRFKHGESIHSDSIRFPDSLRYKTLVTGRTVYGGGGIMPDLFIPTDTALFNKLHRELLNKGIFNRAVLKYVDAHRQKLRQRFPDRQSYATFSIPEELTESLKAFAEAEKITWSTELFAQAEELIKCQLHAYIARDILGENDFFYFFNRMDKEYIKALDLLNDPDEYKRLLGK

SEQ ID NO: 4681 - protein, 439 aa, Nicotiana tabacum
MATSVSTIGAANKAPLSLNNSVAGTSVPSTAFFGKTLKKVYGKGVSSPKVTNRSLRIAAEEKDADPKKQTYSDRWKGLVQDFSDDQQDIARGKGMVDSLFQAPTGTGTHHAVLQSYEYVSQGLRQYNMDNTLDGFYIAPSFMDKLVVHITKNFLKLPNIKVPLILGVWGGKGQGKSFQCELVFRKMGINPIMMSAGELESGNAGEPAKLIRQRYREAAEIIRKGNICCLFINDLDAGAGRMGGTTQYTVNNQMVNATLMNIADNPTNVQLPGMYNKQENARVPIIVTGNDFSTLYAPLIRDGRMEKFYWAPTREDRIGVCKGIFRTDNVPEEAVIKIVDTFPGQSIDFFGALRARVYDDEVRKWVSGTGIEAIGDKLLNSFDGPPTFEQPKMTVEKLLEYGNMLVQEQENVKRVQLAETYLKEAALGDANADAINTGNF

SEQ ID NO: 4682 - protein, 347 aa, Musa acuminata
HVHELEPVEVVADQVAVALSHAAILEESMRARDLLMEQNVALDYARQEAELAIRARNDFLAVMNHEMRTPLHAIITLSSLLLETELNPEQRSMVETVLKSSSLLATLINDILDLSKLEDGSLELEIGIFNLHSVFREVVNFIKPIAAVKKLSVSLTLSPDLPLCAIGDEKRLMQILLNIVGNAVKFTKEGHISLTASVARADYLRDFRASEFYPVSSDGHFYLRVQVKDTGCGISSQDLPHLFTKFAHGRNVASRGFSGSGLGLAICKRYVSLVQGHIWLESEGIGKGCMATFVVKLGICENPDGSQQKIVLLPWTKHGQEDTSSSRGMPKDPKAFIPLKPRYQRSV

SEQ ID NO: 4683 - protein, 232 aa, Nicotiana tabacum
KLISQRYREAAEIIRKGNMCCLFINDLDAGAGRMGGTTQYTVNNQMVNATLMNIADNPTNVQLPGMYNKQENARVPIIVTGNDFSTLYAPLIRDGRMEKFYWAPTREDRIGVCKGIFRTDNVPEEAVVKIVDTFPGQSIDFFGALRARVYDDEVRKWVSGTGIEAIGDKLLNSFDGPPTFEQPKMTVEKLLEYGNMLVQEQENVKRVQLAETYLKEAALGDANADAINTGNF

SEQ ID NO: 4684 - protein, 273 aa, Brassica napus
MVLSQTTTESNEPVSSTFGSRYALTALPKYEIGESSIPKDAAYQIIKDELMLDGNPRLNLASFVTTWMEPECDKLIMDSINKNYVDMDEYPVTTELQNRCVNMIARLFNAPLGDTETAMGVGTVGSSEAIMLAGLAFKRNWQNKRKAEGKTYDKPNIVTGANVQVCWEKFARYFEVELKEIKLSEGYYVMDPEKAVEMVDENTICVAAILGSTLTGEFEDVKRLNHLLVKKNDATGWNTPIHVDAASGGFIAPFIYPELEWDFRLSLVKSINV

SEQ ID NO: 4685 - protein, 251 aa, Bdellovibrio bacteriovorus
MAKKEHVELVPIFDDNYVFILTDDATQKAVAVDPGDAGPVIDFLRANKLDLAAILLTHHHSDHIGGVGELKAAFDCPVYAPQKNQKQIPVADQWLKEGDSVTCGPWDFTVMELPGHTLGHIAYWNQKHKWLFSGDVIFGLGCGRLFEGTFEQGYESLQRIKKLPPQTLIYCTHEYTKSNLEFCRILTNQDNTPITGDSEALELYANELSNRRELNLPSVPLKLSIEESVNPFLLARDVEQFRYLRELRNRQ

SEQ ID NO: 4686 - protein, 493 aa, Zea mays
  misc_feature (372)..(372): Xaa can be any naturally occurring amino acid
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAXHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSM

SEQ ID NO: 4687 - protein, 481 aa, Arabidopsis thaliana
MSLKALDYESLNENVKNCQYAVRGELYLRASELQKECKKIIFTNVGNPHALGQKPLTFPRQVVSLCQAPFLLDDPNVGMIFPADAIARAKHYLSLTSGGLGAYSDSRGLPGVRKEVADFIERRDGYPSDPELIFLTDGASKGVMQILNCVIRGQKDGILVPVPQYPLYSATISLLGGTLVPYYLEESENWGLDVNNLRQSVAQARSQGITVRAMVIINPGNPTGQCLSEANIREILRFCCDERLVLLGDEVYQQNIYQDERPFISSKKVLMDMGAPISKEVQLISFHTVSKGYWGECGQRGGYFEMTNIPPRTVEEIYKVASIALSPNVSAQIFMGLMVSPPKPGDISYDQFVRESKGILESLRRRARMMTDGFNSCKNVVCNFTEGAMYSFPQIKLPSKAIQAAKQAGKVPDVFYCLKLLEATGISTVPGSGFGQKEGVFHLRTTILPAEEEMPEIMDSFKKFNDEFMSQYADNFGYSRM

SEQ ID NO: 4688 - protein, 435 aa, Bdellovibrio bacteriovorus
MSKVTLFWFRRDLRLDDNAGLYHALKERSAVLPLFIFDSEILENLDDPADARVTFIYEQIQDMKQQLNAKKSDLIVRHGKPLEVLKTLSDEMAVEAIYANHDYEPAARKRDEKVAAWAAKAGIEFLTFKDQCLFEKDEILTDARKPYTVYTPYRNKVLANLSEFYLKSYPNDLYESSYAKVKKAEPLLTLKSLGFERSNIEFPPMDLSTKMLKTYHATRDFPADEKGTSHLGLHLRFGTLSVRELAREAKKYSPVWLSELIWRDFFMQILWHFPQVENQSFRPEYDKIAWRKSKADFQKWCEGRTGYPLVDAGMRELNATGYMHNRVRMVVASFLCKHLLIHWYEGERYFAKKLLDYDLSANNGNWQWAAGSGCDAAPYFRIFNPQTQFEKFDPDGKYVQKWVPEYGTDEYPQPMVDHNEARGRCLQAFTKVLKK

SEQ ID NO: 4689 - protein, 165 aa, Pyrococcus abyssi
MVRRRRWDIWDPFDIIREIQEEIDAMFDEFFSRPRLWTYRRWREPEVYEESREVWREPFVDIFDRGDEFVVIAELPGVRKEDIKVRVTEDSVYIEATVRREKELEEEGAVRIERYYSGYRRVIRLPEEVIPEKAKAKYNNGVLEIRIPKKQPTKKEGEGFEVKIE

SEQ ID NO: 4690 - protein, 161 aa, Triticum aestivum
MSLIPRGNAFDPFSLDLWDPFDGFPFGSGGSSSGGSLFPSFPRISSETAAFAGARIDWKETPEAHVFKADVPGLKKEEVKVEVEDGNVLQISGERNKEQEEKTDTWHRVERSSGKFLRKFRLPEDAKADQIKAAMENGVLTVTVPKAEAKKPEVKSIQISG

SEQ ID NO: 4691 - protein, 488 aa, Listeria monocytogenes
MTDRKNLTTNQGVPVGDNQNSMTAGRKGPTLIEDYVLIEKLAHFDRERVPERVVHARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREIRGSSVHAFKWINEEGKTVYVKLRWIPKAGIVNLSTEQASQIQAKEFNHASRDLYEAIENGDYPEWDLYVQVLDPKDLDNFDFNPLDATKDWFEDVFPYEHVGTMTLDRNPDNIFAETESVGFNPGVLVRGMLPSEDRLLQGRLFSYSDTQRHRVGPNYLQLPINSPKAPVANNQRDGHMPFKQQTSSINYEPNSYDTEPKENPAFIEPEQEIRGDISGRLIAEKPNNFGHAKEVWDRYSDAERAALVKNIVDDWSQVRDDIKIRNLRNFYQVDPEFASRVAAGTGVNLEAHVADLK

SEQ ID NO: 4692 - protein, 407 aa, Candida albicans
MTIESTNSFVVPSDTELIDVTPLGSTKLFQPIKVGNNVLPQRIAYVPTTRFRASKDHIPSDLQLNYYNARSQYPGTLIITEATFASERGGIDLHVPGIYNDVQAKSWKKINEAIHGNGSFSSVQLWYLGRVANAKDLKDAGLPLIAPSAVYWDENSEKLAKEAGNELRALTEEEIDHIVEVEYPNAAKHALEAGFDYVEIHGAHGYLLDQFLNLASNKRTDKYGCGSIENRARLLLRVVDKLIEVVGANRLALRLSPWASFQGMEIEGEEIHSYILQQLQQRADNGQQLAYISLVEPRVTGIYDVSLKDQQGRSNEFAYKIWKGNFVRAGNYTYDAPEFKTLINDLKNDRTIIGFSRFFTSNPDLVEKLKLGKPLNYYNREEFYKYYNYGYNSYDESEKQVIGKPLA

SEQ ID NO: 4693 - protein, 681 aa, Arabidopsis thaliana
MSGSVSGCGSGGCSIVWFRRDLRVEDNPALAAAVRAGPVNALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENGIGGGSTTSSYLQNHHEILNWRRLSQTG

SEQ ID NO: 4694 - protein, 273 aa, Solanum tuberosum
MPIEALKSPTAALPPLEEIDDSHNLDSWAKGKRSKRPRIDNPPTRDQYLALCLLMLANDDGTGFGKGKGKGTGSIDVVIEQQQEKKLKPVFIKEKTEQLFKCSECPKVFTSYQALGGHKASHRKINVTATGDDDNNPSTSTSTSGGVNISALNPSGRSHVCSICQKAFPTGQALGGHKRRHYEGKLGGNNRYISGGGCGEGVHSGSVVTTSDGGSGNGGAASTPIARDFDLNMPALPGWQLDLTIDCGGRSQFPIEQEVESPMPAKKPRLFFD

SEQ ID NO: 4695 - protein, 365 aa, Methanosarcina mazei
MIFDPTTVCNMELQNRFVRSATHEFMAEKDGTPTSRLGDLYEELARSEVGLIVTGYSCIHPCGWSDANQQGIYDDRFIEPYRRITERVHKYRSRIVLQIVHGGRQADVSQKNPVPIAPSAVKDGHSATVPKEMTEEEILIVIEAFTQAAVRAKKAGFDGVQLHCAHGFLLSNFISPYTNRRTDRWGGSVENRARIVTEIVRRIKEETGSNFPIFVKMNATDGFQPGTAKAELGLTISQAMETAKLLEKAGVCAIEVSGGISEAGGVTIKTAINSPSKEAYFKEYSKNIKSAVSIPVILVGGIRSLSVMEGLLENGFADLISMSRAFISEPDLILKLKSGEAEKARCVSCNLCFDPEGIRCNFEFD

SEQ ID NO: 4696 - protein, 242 aa, Panax ginseng
MSFYDDQSGNLSPQRKLGRGKIEIKRIENTTNRQVTFCKRRNGLLKKAYELSVLCDAEVALIVFSTRGRLYEYANNSVKGTIERYKKACTDSPNTSSVSEANAQFYQQEASKLRQEISSIQKNNRNMMGESLGSLTVRDLKGLETKLEKGISRIRSKKNELLFAEIEYMQKKEIDLHNNNQYLRAKIAENERAQQHMNLMPGSSDYELAPPQSFDGRNYIQLNGLQPNNHYSRQDQTALQLV

SEQ ID NO: 4697 - protein, 480 aa, Musa acuminata
RSTLDRHTILKTTLVELGRTLDLAECALWMPSRSGLNLQLSHTLHHQMPLGSVVSINLPVVNQVFSSNRAVRIPHTCPLARIRPQTGRYVPPEVVAVRVPLLHLSNFQINDWPELSAKSYAIMVLMLPSDSARKWHIHELELVEVVADQVAVALSHAAILEESMRARDLLMEQNVALDSARREAEMAIRARNDFLAVMNHEMRTPMHAVIALSSLLLETELTPEKRLMIETVLKSSNLLAALINDVLDLSKLEDGSFELEIANFNLHAVFREVINLIKPIAAIKKLSVSVTLAPDLPLCAIGDEKRLMQTILNVAGNAVKFTKEGHISITASVARSDSSRDPRAPEFSPVTSDRHFDLRVQIKDTGCGISPQDLPHIFTKFAHSRNSANKASNGSGLGLAICRRFVSLMEGQIWLESEGIGKGCTATFIVKLGICDPSGNLQQILQTTPSHGDANLPGPRAKFDDENGKFTPMMRYQRSV

SEQ ID NO: 4698 - protein, 175 aa, Zea mays
MSLIRRTNVLDPFSLDLWDPFDGFPFGSGGSGSLVPRTSSDTAAFASARIDWKETPEAHVFKADVPGLKKEEVKVEVEDGNILQISGERSKEQEEKTDTWHRVERSSGKFLRRFRLPENAKAEQVKASMENGVLTVTVPKEEAKKPEVKSIQISGAMRWTAVCRAVVWSFARSSR

SEQ ID NO: 4699 - protein, 365 aa, Aspergillus fumigatus
MAEFVRAQIFGTTFEITSRYNLQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIQTICSENTLRFVKSLPKRERQPLANKFKNADPEAVDLLERMLVFDPKKRIRAGEALAHEYLSPYHDPTDEPEAEEKFDWSFNDADLPVDTWKIMMYSEILDFHNIDQGNDAGQVLMEGGVAQAQQNYA

SEQ ID NO: 4700 - protein, 590 aa, Ajellomyces capsulatus
MQRALSSTSRASVLSSAPTRAPVSRFRSAGLSLQQQRFAHKELKFGVEGRAALLKGIDTLAKAVCTTLGPKGRNVLIESSYGSPKITKDGVTVAKAVTLQDKFENLGARLLQDVASKTNEVAGDGTTTATVLARAIFSETVKNVAAGCNPMDLRRGIQAAVEAVVEYLQANKRDITTTEEIAQVATISANGDTHVGKLISNAMEKVGKEGVITVKDGKTIEDELEVTEGMRFDRGYVSPYFITDTKAQKVEFEKPLIVLSEKKISAVQDIIPALEASTTLRRPLVIIAEDIEGEALAVCILNKLRGQLQVAAVKVPGFGDNRKSILGDIGILTNATVFTDELDMKLEKATADMLGSTGSITITKEDTIILNGDGSKDSIAQRCEQIRGVIADPTTSDYEKEKLQERLAKLSGGVAVIKVGGASEVEVGEKKDRVVDALNATRAAVEEGILPGGGTALLKAAANGLASVKPTSSDQLRRISSLVSAITRPARTIVENAGLEGSVIVGKLTDEHASDFNRGFDSAKGEYVDMIASGIVDPLKVVRTALVDASGVASLLGTTEVAIVEAPEEKGPAGPPGGMGGMGGMGGGMF

SEQ ID NO: 4701 - protein, 338 aa, Yarrowia lipolytica
MEANPEVQTDIITLTRFILQEQNKVGASSAIPTGDFTLLLNSLQFAFKFIAHNIRRSTLVNLIGLSGTANSTGDDQKKLDVIGDEIFINAMKASGKVKLVVSEEQEDLIVFEGDGRYAVVCDPIDGSSNLDAGVSVGTIFGVYKLPEGSSGSIKDVLRPGKEMVAAGYTMYGASANLVLSTGNGCNGFTLDDPLGEFILTHPDLKLPDLRSIYSVNEGNSSLWSDNVKNYFKALKFPEDGSKPYSARYIGSMVADVHRTILYGGMFAYPADSKSKKGKLRLLYEGFPMAYIIEQAGGLAINDNGERILDLVPTEIHERSGVWLGSKGEIEKAKKYPLK

SEQ ID NO: 4702 - protein, 548 aa, Vibrio parahaemolyticus
MAAKDVKFGNDARVKMLEGVNVLADAVKVTLGPKGRNVVLDKSFGAPTITKDGVSVAREIELEDKFQNMGAQMVKEVASKANDAAGDGTTTATVLAQAIVNEGLKAVAAGMNPMDLKRGIDKAVAAAVEQLKELSVECNDTKAIAQVGTISANSDASVGNIIAEAMERVGRDGVITVEEGQALQDELDVVEGMQFDRGYLSPYFINNQEAGSVELENPFILLVDKKISNIRELLPTLEAVAKASRPLLIIAEDVEGEALATLVVNNMRGIVKVAAVKAPGFGDRRKAMLQDIAILTGGTVISEEIGLELEKVTLEDLGQAKRVSITKENSTIIDGAGEEAMIQGRVAQIRQQIEDATSDYDKEKLQERVAKLAGGVAVIKVGAATEVEMKEKKDRVEDALHATRAAVEEGVVAGGGVALIRAASKIVDLEGDNEEQNVGIRVALRAMEAPIRQITKNAGDEDSVVANNVKAGEGSYGYNAATGEYGDMLEMGILDPTKVTRSALQFAASVAGLMITTEAMVTDLPQKESAGMPDMGGMGGMGGMGGMM

SEQ ID NO: 4703 - protein, 250 aa, Arabidopsis thaliana
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYENLQRQQRNLLGEDLGPLNSKELEQLERQLDGSLKQVRCIKTQYMLDQLSDLQGKEHILLDANRALSMKLEDMIGVRHHHVGGGWEGGDQQNIAYGHPQAHSQGLYQSLECDPTLQIGYSHPVCSEQMAVTVQGQSQQGNGYIPGWML

SEQ ID NO: 4704 - protein, 280 aa, Streptococcus pneumoniae
MNTYQLNNGVEIPVLGFGTFKAKDGEEAYRAVLEALKAGYRHIDTAAIYQNEESVGQAIKDSGVPREEMFVTTKLWNSQQTYEQTRQALEKSIEKLGLDYLDLYLIHWPNPKPLRENDAWKTRNAEVWRAMEDLYQEGKIRAIGVSNFLPHHLDALLETATIVPAVNQVRLAPGVYQDQVVAYCREKGILLEAWGPFGQGELFDSKQVQEIAANHGKSVAQIALAWSLAEGFLPLPKSVTTSRIQANLDCFGIELSHEERETLKTIAVQSGAPRVDDVDF

SEQ ID NO: 4705 - protein, 175 aa, Glycine max
  misc_feature (104)..(104): Xaa can be any naturally occurring amino acid
  misc_feature (147)..(147): Xaa can be any naturally occurring amino acid
ELSFPRQVVALCQAPFLLDDPNVGLLFPADAIARAKHYLSLTSGGLGAYSDSRGLPGVRKEVAEFILKRDGYPTDPELIYLTDGASKGVMQILNTIIRGQDDGXPQYPLYSATIALLGGTLVPYYLEETANWGLDVNELRQSVEQAXKGITVKAMVIINPGNPTGQCLSEANLRE

SEQ ID NO: 4706 - protein, 369 aa, Triticum aestivum
MSNAASATPLLAPYKMGKFDLSHRVVLAPLTRQRSFGNVPQPHAILYYQQRATKGGLLIAEATGVSDTAQGYKDTPGIWTKKQVEAWKPIVDGVHVKGGIFFCQIWHVGRVSNHNFQPNGQAPISSTDKPIKPATRADGIGLAKISTPRRLQTDEIQLVIEDFRVAARNAIEAGFDGVEIHGAHGYLIDQFLKDQVNDRTDKYGSLENRCRFALEVVQAVADEIGADKVGIRLSPFASYSDASDSNPEALGLYMAQALNKLGILYCHMVEPRMVNIGEKLETPHSLHAMRDAFKGTFIVAGGYGRDDGDKAIADGYADLVAFGRLFLSNPDLPRRFEIDGPLNKYNRDTFYLSDPVIGYTDYPFLPSDV

SEQ ID NO: 4707 - protein, 451 aa, Candida albicans
MSDTIATKEEASKIFDRLKKDPANQVCFDCSNKNPTWTSIPFGIFLCLQCSAVHRNLGVHISFVKSSNLDSWQRIQLRNFKFGGNQQAKDFFLKNGGSQFVNNKNGVDATAKYTSPCANKYKEKLKQKAAQDAAKHPDIVTLDDVTDVMSLSDSPSESTDDFFSNWNKPVNNSNTASPLSSRAATPNASTDDLTKKKPVVRTTTTSARLKSNNTAVKKSILSGKGNGPRTSRLAAKRINKTEDDIDFDEIEKKAKQEAEEAKKLGYKPTETVEPTVKKQPTSTSLSLKKENEEVKLTPAPIQETTQQFQKLGFGMTQGDNIVGSSTKKYKEVKYTGEVSNKYGTQKGISSDEFFGRGPRFDEQAKTEARTKLQAFNGAQSISSSSYFGEEEGGARGGRSNSGAGGLGDLEASAREFASKFSGNANQDLEVLKDALEDGATKLGSYLRDFLR

SEQ ID NO: 4708 - protein, 716 aa, Arabidopsis thaliana
MEYTEAVRTEDQTMNVVKERGVKPRIVPPPGDGKKIYEIDPMLRTYNNHLDYRYGQYKRLREEIDKYEGGLEAFSRGYEKLGFSRSDAGITYREWAPGAKAASLIGDFNNWNSNADIMTRNEFGVWEIFLPNNTDGSPAIPHGSRVKIRMDTPSGIKDSIPAWIKFSVQAPGEIPFNGIYYDPPEEEKYVFKHPQPKRPKSLRIYEAHVGMSSTEPMVNTYANFRDDVLPRIKKLGYNAVQIMAIQEHSYYASFGYHVTNFFAPSSRCGTPEELKSLIDRAHELGLVVLMDIVHSHASKNTLDGLNMFDGTDAHYFHSGPRGYHWMWDSRLFNYGSWEVLRYLLSNARWWLEEYKFDGFRFDGVTSMMYTHHGLSVGFTGNYTEYFGLETDVDAVNYLMLVNDMIHGLYPEAITVGEDVSGMPTFCIPVQDGGVGFDYRLHMAIADKWIEMLKKRDEDWQMGDIIYTLTNRRWSEKCISYAESHDQALVGDKTIAFWLMDKDMYDFMAVDRPSTPLIDRGIALHKMIRLITMGLGGEGYLNFMGNEFGHPEWIDFPRGEQRLSDGSVIPGNNFSYDKCRRRFDLGDADYLRYRGLQEFDQAMQHLEENYGFMTSEHQFISRKDEADRVIVFERGDLVFVFNFHWTSSYFDYRIGCSKPGKYKIVLDSDDPLFGGFNRLDRKAEYFTYDGLYDERPCSFMVYAPCRTAVVYALANHD

SEQ ID NO: 4709 - protein, 394 aa, Ammophila arenaria
EPASTEDPAVSIAGAVQSQKLAVRAISRLQALPGGDVNLLCDTVVEHVRELTGYDRVMVYKFHDDEHGEVLAESRRADLEPYLGLHYPATDIPQASRFLFRQNRVRMIADCHAAPVRVIQDPAMPQPLCLVGSTLRSPHGCHAQYMANMGSIASLVMAVIISSGGEDEHSMGRGAVPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGITPTEAQIKDIIEWLTVCHGETTGLSTDSLADAGYPGATALGDAVCGVAVAYITPSDYLFWFRSHTAKEIKWGGAKHHPEDKDDGQRMHPRSSFKAFLEVVKSRSLPWENAEMDAIH

SEQ ID NO: 4710 - protein, 394 aa, Anisopogon avenaceus
EPARTEDPALSIAGAVQSQKLAVRAISRLQALPGGDVKLLCDTVVEHVRELTGYDRVMVYKFHDDEHGEVLAESRRADLEPYLGLHYPATDIPRASRFLFRQNRVRMIADCHAAPVRVIQDPAMPQPLCLVGSTLRSPHGCHAQYMTNMGSIASLVMAVIISSGGDQDHNIARGAIPSAMKLWGLVVCHHTAPRCIPFPLRYACEFLMQAFGLQLNMELQLAQHLSQNLILTTQTLLCDMLLRDSPTGIVPQSRSIMDLVKCDGAALYYHGKYYPLGVTPTEAQILDIIEWLTVCHGDSTGLSTDSLADAGYPGAASLGDAVCGMAVAYITPSDHLFWFQSHTAKEIKWGGAKHHPEDKDDGQRMHPRSSFKAFLEVVKSRSLPWENAEMDAIH

SEQ ID NO: 4711 - protein, 1335 aa, Ralstonia metallidurans
MKETLRHAASQCRRWTLSVLILGLSLMQPAMALPAKLTVGMLDNGWPPFTMLNAGRAEGIGMDFLHEALRGHQITYSVKGYPDMTALLAALCKGDVDVVLNVAITPARRRCLSFSEPYFDGDAVVVGRPSAALEEDLLASMQTGRFAIEPGYYMEGILRQRYPKARMVPIKDTTDGLRAIVNGRADYYATVQPVAEYAMVSPEFAGLKVLSRYREPTGAIHFAFRSNATELRDATDAGLAAIDPARRAALLAHWITSQVASPDKPQKFFLTDEERAFLKSLPTLTVGVDAGLAPYTYLDESGRASGIAIDYLSYLGETLGVRFRRQPTTDIQQTVEALHQGKIDLMAVAVPEDPTLRGLPVSRPYSTFPVVVAGRNSALPLAHLRDLTGKRVVVTDSGGVGDFTRHEVPGVKLVIAPNVHAGLDMVAQGKADAYVDDIVSTDIELRRNFAGKLRVIGSGEHMLNSGFAVNPALAGRLLPLINRALSVLPEDRRLDIQNRYAGTSYVLETSWLNALWRASPILIGMMVILLILLRSQRLYRKEASIRREAERELSTQLRFQSTLMDAIPLPIVVSNKDGRYLRLNAFSEWITGRSWADIVGHTTTEVHFWGEANSARVEEASQRAIDTGRLVQLQLQLQDKEGVERHFLLYIKPFVGENNVEGLINTGVDVTEIRQAELEAREAQGRLADVTRYLPIMVFQARQSGHLGRGPIWVSGNTTDLFGVDAETLAVNPPTIEACVHPDDRMSLRRAIARARRELQVLNHEVRLRKLEGFRWTRLQAVPRIEIDGSVLWNGYWRDTQAEHERAAALASAKESAEAASRAKDSFLAMMSHEIRTPMNGVLGLAELLSHTSLTPEQSATVGMMGDSASALLQILDDILDYSKIEAGRIDIESRPLDIRELCDCTIGVLATRAHEKGLHLRLHVGADVAAVVLGDSVRLRQVLFNLLSNAIKFTESGMVSVSAEVVQETETAQTLRWRVTDTGIGIEPQNQSRLFDPFVQADTSTTRRFGGTGLGLAICRRLVQLMGGRITLKSEPGIGTQVEVELSLPVKERRYSKPPLAGIQFGVRLRDCAVGQALTDFLSAAGATNSASQDERDKPQMLFLNDGEYAPPSPVGQASPIVVHVTEKPKLAGYRLTESDVRLSSNPVSWRAINAVTVAAMQGRAHTVATHAQAKPKPAAHAVTREQALASGRLILVAEDHETNRILLQHQLKLLGYACDAVVDGQQALEAAEKTAYAMLITDCHMPNVNGYELARQLRAREAEAKTEAGTDAHRLPIVAITASTEAEEVQRCREAGIDECMFKPTQLNALRACLQRWNPDNQDADGRKGSGKA

SEQ ID NO: 4712 - protein, 394 aa, Anomochloa marantoidea
EPARTEDPALSIAGAVQSQKLAVRAISRLQALPGGDVKLLCDTVVEHVRELTGYDRVMVYKFHDDEHGEVVAESRRADLEPYLGLHYPATDIPQASRFLFRQNRVRMIADCHAAPVRVIQNPSLTQPLCLVGSTLRAPHECHAQYMANMGSIASLAMAVIISSSGDDENNVGRCGISSTMKLWGLVVCHHTSPRCIPFPLRYACEFLMQAFGLQLNMELQLAHQLSEKHILRTQTLLCDMLLRDSPTGIATQSPSIMDLVKCDGAALYYHGKYYPLGVTPTESQIKDIIEWLGMCHGDSTGLSTDSLADAGYPGAASLGDAVSGMAVAYITPNDYLFWFRSHTAKEIKWGGAKHHPDDKDDGQRMHPRSSFKAFLEVVKSRSLPWENAEMDAIH

SEQ ID NO: 4713 - protein, 304 aa, Aristida purpurea
QYMANMGSIASLVMAVIISSGGDDEQLGRGGISSAMKLWGLVVCHHTSPRFIPFPLRYACEFLMQAFGLQLNMELQLAHQLSEKHILRTQTLLCDMLLRDSPTGIVAQSPSIMDLVKCDGAALYYHGKYYPLGVTPTESQIKDIIEWLMLCHGDSTGLSTDSLADAGYHGAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAMVNGQVQLGELELRGINELSSVAREMVRLIET

SEQ ID NO: 4714 - protein, 393 aa, Arundinella hirta
EPARTEDPALSIAGAVQSQKLAVRAISRLQALPGGDVKLLCDTVVEHVRELTGYDRVMVYRFHEDEHGEVVAENRRDNLEPYLGLHYPATDIPQASRFLFRQNRVRMIADCHATPVRVIQDPGLSQQLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAVALGDAVCGMTVAYITPSDYLFWFRSHTAKEIKWGGAKHHPEDKDDGQRMHPRSSFKAFLEVVKSRSLPWENAEMDAIH

SEQ ID NO: 4715 - protein, 430 aa, Caulobacter crescentus
MGRRDGRRAGPYERPINHVGDARGSIANFGARVDRPRLVVATSWLPARSATPRDAPFASGDSVVSTSSLFAPTTVAGLALRNRVVMSPMTRRFSPGGVPNQAVADYYRRRAEAGVGVIITEGVAVDHPAAVDHADIPNFHGPALDQWKTIAASVTSAGAAFIPQLWHIGGHRSLTADPPNASAPSLSPSGVYEPGKPFGTPATEVEIEAVIQAYAKGARDAAAIGASGVEIHGAHGYLIDQFFWAATNQRQDRYGGDMIERLRFATEVIKACREAVGPSFPIFFRYSQFKQVDYKARLCQSPDELAAFLQPLVDAGVDVFDCSQRRFWEPEFEGSPLNLAGWTKTLTGKPTMTVGSVGLDGDVVASLREGVDVIAASSLDKLDVMLDRGDFDLVGVGRALLADPHWVEKVRDGQTDGLAGFTRAALETLV

SEQ ID NO: 4716 - protein, 235 aa, Unknown
  Fragaria x ananassa
MKLRSQSNSSPSFVFFFVLFFSFIALSEMATLGGIRDSPAGSENSLETEALGRFAVDDHNQKQNGMLEFVRVVKAKEQVVAGTLHHLVVEAIDGGKKKLYEAKVWVKPWLNFKQVQEFKHAGEPETVSGTPSFTSSDLGVKQGGHAPGWQDVHPQDPQVQDAANHAVKSLQQKSNSLFPYELQEVVHAKSEVMEEHAKFNMLLKLKRGDKEEKYKVEVHKNNEGAYNLNQMEVEH

SEQ ID NO: 4717 - protein, 918 aa, Salmonella enterica
MTNYSLRARMMILILAPTVLIGLLLSIFFVVHRYNDLQRQLEDAGASIIEPLAVSSEYGMNLQNRESIGQLISVLHRRHSDIVRAISVYDDHNRLFVTSNFHLDPSQMQLPAGAPFPRRLSVDRHGDIMILRTPIISESYSPDESAIADAKNTKNMLGYVALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELNPTQRDHLNTIERSANNLLAIINDVLDFSKLEAGKLILESIPFPLRNTLDEVVTLLAHSSHDKGLELTLNIKNDVPDNVIGDPLRLQQVITNLVGNAIKFTESGNIDILVEKRALSNTKVQIEVQIRDTGIGIPERDQSRLFQAFRQADASISRRHGGTGLGLVITQKLVNEMGGDISFHSQPNRGSTFWFHINLDLNPNVIIDGPSTACLAGKRLAYIEPNATAAQCTLDLLSDTPVEVIYSPTFSALPLAHYDIMILSVPVTFREPLTMQHERLAKAASMTDFLLLALPCHAQINAEKLKQGGAAACLLKPLTSTRLLPALTEYCQLNHHPEPLLMDTSKITMTVMAVDDNPANLKLIGALLEDKVQHVELCDSGHQAVDRAKQMQFDLILMDIQMPDMDGIRACELIHQLPHQQQTPVIAVTAHAMAGQKEKLLSAGMNDYLAKPIEEEKLHNLLLRYKPGANVAARLMAPEPAEFIFNPNATLDWQLALRQAAGKPDLARDMLQMLIDFLPEVRNKIEEQLVGENPNGLVDLVHKLHGSCGYSGVPRMKNLCQLIEQQLRSGVHEEELEPEFLELLDEMDNVAREAKKILG

SEQ ID NO: 4718 - protein, 194 aa, Glycine max
  misc_feature (27)..(27): Xaa can be any naturally occurring amino acid
  misc_feature (55)..(55): Xaa can be any naturally occurring amino acid
  misc_feature (117)..(117): Xaa can be any naturally occurring amino acid
  misc_feature (129)..(129): Xaa can be any naturally occurring amino acid
  misc_feature (166)..(166): Xaa can be any naturally occurring amino acid
DTSFILARDAIGDTYLFIAWRLNGSHXTPSYLNGDYDDCEHYESFPPGHLYSIKXRALLTIAQSLHGFCDAILLSHLMITLALRHAFEMAVVKRMMTDVPSAGSLSQGSYSTLSAVXLYLYLSGSRCSXQRASKLHSLCVCLEGAPDLMASLEVTYYIGTVHHEYXYSVQEGIYTIDDEIYHIYSSWVDTIRAS

SEQ ID NO: 4719 - protein, 634 aa, Glycine max
MGSNRTIVWFRRDLRIEDNPALAAAAKEGSVLPVYIWCPKEEGQFYPGRVSRWWLKQSLAHLDQSLKSLGSRLVLIKTHSTVMALVECVKAIQATKVVFNHLYDPVSLVRDHNIKEKLVEQGISVQSYNGDLLYEPWEVNSESGRAFTTFNAFWKKCLHMQMDIVSVVPPWQLIPAEGKIEECSLEELGLENESEKPSNALLGRAWSPGWRNADKALREFVELHLLHYSKKRLKVGGESTSLLSPYLHFGELSARKVFQVTRMKQILWTNEGNSAGEESVNLFLRAIGLREYSRYLCFNFPFTHEKALLGHLKFFPWNPDADIFKNWRQGRTGFPLVDAGMRELWATGWIHNRIRVIVSSFAVKMLLLPWKWGMKYFWDTLLDADLESDILGWQYISGGLPDGHELERLDNPEIQGAKFDPEGEYVRQWLPELARMPTEWIHHPWDAPLTVLRAAGVELGQNYPKPIIDIDLARERLTEAIFKMWESEAAAKAAGSEPRDEVVVDNSNSLENLDTRKVVVLGKAPCATISANDQKVPALQDSKNEPPTRKRPKHMIEEGQNQDHSQNHNKDTGMSSIDQDICSTADSSSCKKQCASTSSYSFSVPQQCSSSSNLKWPWQDQIDMEQSSSKDGAM

SEQ ID NO: 4720 - protein, 154 aa, Prunus persica
MALSLFGGRRSNVFDPFSLDIWDPLEGLGTLANIPPSARETTAIANTRIDWKETPEAHIFIADLPGLKKEEVKVEVDDGKVLHISGERSREQEEKNDKWHRIERSTGKFSRRFRLPDNAKIDQVKASMENGVLTVTVPKEEEKRPQVKAIDISG

SEQ ID NO: 4721 - protein, 326 aa, Unknown
  Bradyrhizobium sp. BTAi1
MKTRTLVAALAGISLAWPVAAFAQDAPVEQQLVDAMNKVFGVHAGFRANHAKGVVVEGKFKPSAEAASLSRASLFSGGEIPVTVRFSDSTGVPNLPDGSDDANPHGMAVKFHLADGSDMDLVINSLKFFPVSTGAELRDLFLAIADSGPGAAKPTRLEQFIGSHPSVPAALGTIATPDSFANEAYFGVNAFMLVNKAGARQAVRWQMLPEKVVHLDKADAAKRAPDFLMTELPARLKQGPVAFRFMAQLAAAGDDTKDPAKPWPADRKLAALGTLTIDKAVDDSDAAQKKLLFLPGQLTDGIEASDDPMIDIRNGAYAISFSRRNP

SEQ ID NO: 4722 - protein, 191 aa, Glycine max
MVLSKTASETDVSVHSTFASRYVRTSLPRFKMAEESIPKEAAYQIIHDELMLDGNPRLNLASFVTTWMEPECDKLIMAAINKNYVDMDEYPVTTELQNRCVNMIAHLFNAPLEESETAVGVGTVGSSEAIMLAGLAFKRRWQNRRKLEGKPYDNPNIVTGANVQVCWEKFARYFEVELKEVKLRDGYYVMD

SEQ ID NO: 4723 - protein, 184 aa, Arabidopsis thaliana
MRTFSPKLLLLLLLVLRHHAESGSIVKFLPGFEGPLPFELETGYIGIAKYWANDERVREALQIRKGSIGKWIRCNSNIHYDDDIISSIPYHMNNSINGYRSLIYSGDHDMEVPFLATEAWIRSLNYPIIDDWRPWIINNQIAGYTMTYANKMTYATIKASGHTAEYKPAESFIMFQRWISGQPL

SEQ ID NO: 4724 - protein, 493 aa, Chlamydomonas reinhardtii
MDPAKIRPSSAYNTPYWTTNSGAPVWNNNNSMTVGTRGPILLEDYHLVEKLAQFDRERIPERVVHARGAAAKGFFEVTHDISALTAADFLRAPGVQTPVIVRFSTVVHERGSPETLRDPRGFAVKFYTREGNFDMVGNNMPVFFIRDGMKFPDMVHAFKPNPKSHIQEAWRIMDFLSHHPESCHMLTFLLDDAGIPLNYRHMPGFGVHTMKLINKAGRETYVKFHWVPKCGEKYLLDDEAVMVGGANHSHATKDLFDAIAAGDYPEWALMVQTMDPADEDKFDFDPLDVTKTWPESLFPMQPVGRMVLNRNVDNFFNENEQVAFCPAIIVPGIGYSDDKLLQTRIFSYADTQRHRLGPNYLLLPVNAPRAPHHNNHHEGFMNFMHRDEEINYFPSRFDPVRNAERVAAVSSAPLSGRREKMVIAKENNFMQAGAAGRAFDAARQERFVVRVADMLADPRCTQEIRRIWVGYWSQADPQLGARIAAKLQGRGCL

SEQ ID NO: 4725 - protein, 492 aa, Triticum aestivum
MDPYKHRPTSGANSAYWTTNSGAPVWNNNNALTVGHRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSSKTNMQENWRVVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDRFDFDPLDVTKTWPEDIIPLQPVGRMVLNKNIDNFFAENEQLAFCPAVTVPGIHYSDDKLLQTRIFSYADTQRHRLGPNYLMLPVNAPKCAHHNNHHDGLMNFIHRDEEVNYFPSRVDPTRHAEKDPMPPRVLSGCREKCIIDKENNFKQAGERYRSFDPARQDRFLQRWVDALTDARVTHEIQSIWVSYWSQCDASLGQKLASRLKIKPNM

SEQ ID NO: 4726 - protein, 392 aa, Rhynchophora phillipsonii
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCVAPPVKVIQDERLPQPLSLCASTLRSPHGCHAQYMTNMGIVASLVMSVTVNEEDDMVDSDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVSPTEEQIRDIAEWLLEYHSGNTGLSTDSLMEAGYPGAAALGDAVCGMAAVSITSRDFLLWFRSHTAKEIKWGGAKHDPDDKDDGRKMHPRSSFKAFLEVVKWRSMPWEDMEMDAI

SEQ ID NO: 4727 - protein, 190 aa, Platycerium angolense
DEHGEVLAEIRRSDLEPYLGLHYPATDIPQASRFLFMKNRVRMICDCRALPVRAIQDKELRQPLSLAGSTLRAAHGCHSQYMANNGIVASLVMAVVVNDNDEDMSNRPQHPKMRRLWGLAVCHHTTPRCSPFALRSACESLMQVFGLQLNMELELAAQMREKHILRTQTLLCVMLLRDAPIGIVSESPNI

SEQ ID NO: 4728 - protein, 392 aa, Rhynchophora phillipsonii
DLEPVNPADVPVTAAGALKSYKLAAKAISRLQSLPSGNISLLCDVLVKEVRDLTGYDRVMVCKFHEDEHGEVVSECRRSDLESYLGLHYPATDIPQASRFLFMKNKVRMICDCVAPPVKVVQDERLPQPLSLCASTLRSPHGCHAQYMTNMGIVASLVMSVTVNEEDDMVDSDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVSPTEEQIRDIAEWLLEYHSGNTGLSTDSLMDAGYPGASALGDAVCGMAAVSITSRDFLLWFRSHTAKEIKWGGAKHDPDDKDDGRKMHPRSSFKAFLEVVKWRSMPWEDVEMDAI

SEQ ID NO: 4729 - protein, 225 aa, Populus tomentosa
MAREKIKIKKIDNVTARQVTFSKRRRGLFKKAEELSVLCDAEVAVIIFSATGKLFEYSSSSMKGVLARYNLHSNNLDKINQPSLELQLENSNHMRLSKEVSEKSHQLRRMRGEDLQGLNIEELQQLEKALEVGLSRVLETKGERIMNEISTLERKGVQLLEENKQLKQKIATITRGKRPALVDLDTAVQEEGMSSESTTNVCSCSSGPPVEDDSSDTSLKLGLAI

SEQ ID NO: 4730 - protein, 392 aa, Unknown
  Microsteira sp. Davis et al. 38-01
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCVAPPVKVIQDERLPQPLSLCASTLRSPHGCHAQYMTNMGIIASLVMSVTVNEEDDMVDGDQLQMARKLWGLVVCHHTSTRFVPFPLRYACEFLIQVFGVQINKEVELAAQVREKHILQIQTMLCDMLLRDAPVAIITQSPNAMDLVKCDGAALYFKNKTWLLGVTPTEEQIRDIAEWLLEYHSGNTGLSTDSLMEAGYPGASALGDTVCGMAAVSITSRDFLLWFRAHTAKEIKWGGAKHDPDDKDDGRKMHPRSSFKAFLEVVKWRSMPWEDVEMDAI

SEQ ID NO: 4731 - protein, 502 aa, Arabidopsis thaliana
MVLSHAVSESDVSVHSTFASRYVRTSLPRFKMPENSIPKEAAYQIINDELMLDGNPRLNLASFVTTWMEPECDKLIMSSINKNYVDMDEYPVTTELQNRCVNMIAHLFNAPLEEAETAVGVGTVGSSEAIMLAGLAFKRKWQNKRKAEGKPVDKPNIVTGANVQVCWEKFARYFEVELKEVKLSEGYYVMDPQQAVDMVDENTICVADILGSTLNGEFEDVKLLNDLLVEKNKETGWDTPIHVDAASGGFIAPFLYPELEWDFRLPLVKSINVSGHKYGLVYAGIGWVIWRNKEDLPEELIFHINYLGADQPTFTLNFSKGSSQVIAQYYQLIRLGHEGYRNVMENCRENMIVLREGLEKTERFNIVSKDEGVPLVAFSLKDSSCHTEFEISDMLRRYGWIVPAYTMPPNAQHITVLRVVIREDFSRTLAERLVIDIEKVMRELDELPSRVIHKISLGQEKSESNSDNLMVTVKKSDIDKQRDIITGWKKFVADRKKTSGIC

SEQ ID NO: 4732 - protein, 465 aa, Bacillus licheniformis
MKQQLKLFLAVLITAVAASALTLYLVGKGSGGSVYSASDSEKFEKLMAAYDKIKSDYYQNADDEKLTDGAIKGMLGALDDPYSTYMDKKEAKSFEESITSSFEGIGAQVEEKNGQILIVAPIKGSPAEKAGLKPHDEIQKVDGKSVKGKTVNEATAMIRGKKGTNVKLVLNREGVGQIDVTIKRDTIPIETVYSKMIDGNIGEIQITSFSENTAKELTKAIDDLSEKGAERFVLDLRGNPGGLMDQAIMMSNMFVDKGKTIMQVESKNGKKEVYKAEKERKVNKPTVVLVNGGTASAAEIMAAALHQSSGIPIVGENTFGKGTVQNAESFSDGSTVKLTIAKWLTPNGDWIHEKGIKPQYKAELPSYAKLPYLDSKKEYKAGSTGDEVKAAQQMLQALGYKLNATGAFDAQTEAAVKAFQKDQKLKTTGILTGETTISLTSKLQDKLSDNDTQLDKAIEILKKEK

SEQ ID NO: 4733 - protein, 392 aa, Mascagnia sepium
DLEPVNPADVPVTAAGALKSYKLAAKAISRLQSLPSGNISLLCDVLVKEVRDLTGYDRVMVYKFHEDEHGEVVSECRGSDLESYLGLHYPATDIPQASRFLFMKNKVRMICDCLAPPVKVIQDERLPQPLSLCGSTLRSPHGCHAQYMTNMGTIASLVMSVTVNEDDDMVDGDQPQMTRKLWGLVVCHHTSPRFVPFPLRYACEFLIQVFGVQINKEVELAAQVGEKHILQIQTMLCDMLLRDAPVAIITQSPNVMDLVKCDGAALYFKNKTWLLGVTPTEEQIRDIAEWLLEYHSGNTGLSTDSLMEAGYPGASALGDAVCGMAAVSITSGDFLFWFRSHTAKEIKWGGAKHDPDDKDDGRKMHPRSSFKAFLEVVKWRSMSWEDIEMDAI

SEQ ID NO: 4734 - protein, 185 aa, Burkholderia fungorum
MNIELSKWNPFKFLRKAQNGREKPSSNPPTTKNWLTEWPDASRLFSSDPWRVMRELLHDPFAGGALERWFGDFSSSWFQPRIDVVDDGDVLRITAELPGMDRGDLQTSIEEGVLVLRGEKKQDTRSEENGCYRLERSYGAFTRTIPLPDGVDVDKVDAKFDKGVLTVRLPKTDSARPTIRKVEIK

SEQ ID NO: 4735 - protein, 286 aa, Zea mays
MHIREEEATPSTVTGIMSTLTSAGQQKLKEPISPGGGSASVAGSAAERNNGGRGKGKTEIKRIENTTNRQVTFCKRRNGLLKKAYELSVLCDAEVALIVFSSRGRLYEYANNSVKGTIERYKKATSDNSSAAGTIAEVTIQHYKQESARLRQQIVNLQNSNRALIGDSITTMSHKELKHLETRLDKALGKIRAKKNDVLCSEVEYMQRREMELQNDNLYLRSRVDENERAQQTANMMGAPSTSEYQQHGFTPYDPIRSFLQFNIVQQPQFYSQQEDRKDFNDQGGR

SEQ ID NO: 4736 - protein, 111 aa, Hypocrea jecorina
MADAPYDPYVPKAGADQSGGQSRTQALQGEIDATVQVMRKNIENVAQRGDRLDVLQDKTDNLAESAQGFRRGANRVRKQMWWKDMKMRVCIVVGIILLLVVIIVPSVVATR

SEQ ID NO: 4737 - protein, 644 aa, Escherichia coli
MNMFFRLTALAGLLAIAGQTFAVEDITRADQIPVLKEETQHATVSERVTSRFTRSHYRQFDLDQAFSAKIFDRYLNLLDYSHNVLLASDVEQFAKKKTELGDELRSGKLDVFYDLYNLAQKRRFERYQYALSVLEKPMDFTGNDTYNLDRSKAPWPKNEAELNALWDSKVKFDELSLKLTGKTDKEIRETLTRRYKFAIRRLAQTNSEDVFSLAMTAFAREIDPHTNYLSPRNTEQFNTEMSLSLEGIGAVLQMDDDYTVINSMVAGGPAAKSKAISVGDKIVGVGQTGKPMVDVIGWRLDDVVALIKGPKGSKVRLEILPAGKGTKTRTVTLTRERIRLEDRAVKMSVKTVGKEKVGVLDIPGFYVGLTDDVKVQLQKLEKQNVSSVIIDLRSNGGGALTEAVSLSGLFIPAGPIVQVRDNNGKVREDSDTDGQVFYKGPLVVLVDRFSASASEIFAAAMQDYGRALVVGEPTFGKGTVQQYRSLNRIYDQMLRPEWPALGSVQYTIQKFYRVNGGSTQRKGVTPDIIMPTGNEETETGEKFEDNALPWDSIDAATYVKSGDLTAFEPELLKEHNARIAKDPEFQNIMKDIARFNAMKDKRNIVSLNYAVREKENNEDDATRLARLNERFKREGKPELKKLDD

SEQ ID NO: 4738 - protein, 838 aa, Nostoc punctiforme
MATVTVQFTYFTGFRRAIFNNPRLIGSWDENGRYSQQWRSQQMQPIIAEDGCPGFQTTVELDDSQIGWLFRWGVMLDSPAGNNLWGIPTEINDRNSSDRYRSFTLQSPNNNQPQQERYYLVYSRRLGAQLYHFPGQSQPGLRFAVWAPNARNVEVVFGNRSSGYIADDVFREDPDFGMDPNLGPFPMSRTEEGIWQTDVTVSSELADFSRFDHIPYMFRIVNEGGRVVYRTDLYSRCQIGKGNINPDGKPFSNRYSDTQDRPFSGNYQDLDGTKSCSVVINPDTVTRHFQEPVWPELEFIPEEEFWSNEFSLERPVPQRVEDLVIYELHVGALGYGQNRPGNFEDAIALLPYLVQLGVNAVELLPMSEFRDEVNWGYETSHYFALEYSAGGRDQLKHFIRECHCYGIAVILDVVYNHFNPDGERAEWAYDSDLPEHNIYYWYEGNSGDYFYPDGRRFPEGGYLDNVSTGFAPRFYEEMVRKMFISSAVTLMEEFHVDGFRVDQTTSIHSYNALHLDGRPMGNANIFGAKFLREWTRTMKLIQPNAILIAEDHSDWEPVTESPDVGGLGFDAAWYANFYHHLIGDARQGTEYAKLIPTAGYGTNEPLAMDYFAGALGWSGHHKVVYHESHDEAGNAYFEEGGHRVESRRTIAEAVNSAPLIGETRRYAEARCRFAVGVSILSAGTPMFLMGEEIGAQKPYRYSDFIDNREDLIGDRQTNGQRLFRFYQDLIQLRHNYSGLRSHLIDILYVHNANRVIAFKRWDVSGEFLIVASLNNHPFRSGYTINNSRIGDGQWREIFNSDASLYGGDSIGNYGINISATNGYINPIVPANGFVVFQG

SEQ ID NO: 4739 - protein, 394 aa, Brachypodium pinnatum
EPARTEDPALSIAGAVQSQKLAVRAISRLQALPGGDVKLLCDTVVEHVRELTGYDRVMVYKFHDDEHGEVLAESRRTDLEPYLGLHYPATDIPQASRFLFRQNRVRMIADCHAAPVRVIQDPAMPQPLCLVGSTLRSPHGCHAQYMANMGSIASLVMAVIISSGGEDEHNMGRGAIPSAMKLWGLVVCHHTSPRCIPFPLRYACEFLMQAFGLQLNMELQLAYQLSEKHILRTQTLLCDMLLRDSPTGIVTQSPSIMDLVKCDGAALYYHGKYYPLGVTPTEVQIKDIIEWLTVSHGDSTGLSTDSLADAGYSGATALGDAVCGMAVAYITPSDYLFWFRSHTAKEIKWGGAKHHPEDKDDGQRMHPRSSFKAFLEVVKSRSLPWENAEMDAIH

SEQ ID NO: 4740 - protein, 394 aa, Buergersiochloa bambusoides
EPARTEDPALSIAGAVQSQKLAVRAISRLQALPGGDVKLLCDTVVEHVRELTGYDRVMVYRFHDDEHGEVVAESRRADLEPYLGLHYPATDIPQASRFLFRQNRVRMIADCHAAPVRVIQDSALPQPLCLVGSTLRGPHGCHAQYMANMGSIASLVMAVIISSGGDDEHNSAQGGIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYLLDVTPTEAQIKDIIEWLTLCHGDSTGLSTDSLADAGYPGAAALGDAVCGMAVAYITPSDYLFWFRSHTAKEIKWGGAKHHPEDKDDGQRMHPRSSFKAFLEVVKSRSLPWENAEMDAIH

SEQ ID NO: 4741 - protein, 393 aa, Capillipedium parviflorum
EPARTEDPALSIAGAVQSQKLAVRAISRLQALPGGDVKLLCDTVVEHVRELTGYDRVMVYRFHEGEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIH

SEQ ID NO: 4742 - protein, 386 aa, Chasmanthium latifolium
PALSIAGAVQSQKLAVRAISRLQALPGGDVKLLCDTVVEHVRELTGYDRVMVYRFHEEEHGEVVAESRRDGLEPYLGLHYPATDIPQASRFLFRQNRVRMIADCHATAVRVIQDPGLSQPLCLVGSTLRAPHGCHAQYMANMGSIASLVMAVIISSGGDDEQTSRGGMSSAMKLWGLVVCHHTSPRFIPFPLRYACEFLMQAFGLQLNMELQLAHQLSEKHILRTQTLLCDMLLRDSPTGIVTQSPSIMDLVKCEGAALYYHGKYYPLGVTPTESQIKDIIEWLMLCHRDSTGLSTDSLADAGYVSAAALGDAVCGMAVAYITPSDYLFWFRSHTAKEIKWGGAKHHPEDKDDGQRMHPRSSFKASLEVVKSRSLPWENAEMDAIH

SEQ ID NO: 4743 - protein, 393 aa, Chusquea oxylepis
EPARTEDPALPIAGAVQSQKLAVRAISRLQALPGGDVKLLCDTVVEHVRELTGYDRVMVYRFHDDEHGEVVAESRRADLEPYLGLHYPATDIPQAPRFLFKQNRVRMIADCHAASVRVIQGPALPQPLCLVGSTLRAPHGCHAQYMANMGSIASLVMAVIISSGGDDEHNMTRGGIPSAMKLWGLVVRHHTSARCIPFPLRYACEFLMQAFGLQLNMELQLAHQLSEKHILRTQTLLCDMLLRDSPAGIITQSPSIMDLVKCDGAALYYHGKYYPLGVTPTEAQIKDIIEWLTLCHGDSTGLSTDSLADAGYPGAALGDAVCGMAVAYITPSDYLFWFRSHTAKEIKWGGAKHHPEDKDDGQRMHPRSSFKAFLEVAKSRSLPWENAEMDAIH

SEQ ID NO: 4744 - protein, 365 aa, Prunus persica
QMGLAENQLSFDLIEDWIRKNPKASICTPEGVEELKNVAIFQDYHGFPEFRKAVAMFMSKARGGRVTFDPNRVVMNGGATGANELVMFCLADPGDAFLVPSPYYQHFTRDLGWRTGVQIVPVDCDSSNNFQITKEALAAAYEKAQKNNISVKGLIITNPSNPLGTTLGRDTLESLVEFISQKNIHLVCDEIYAATVFSSPTFTCISEVIQNTDCNPNLIHIVYSLSKDMGLPGLRVGIVYSYNDDVVNIGRKMSSFGLVSSQTQHVLASMLLDEEFVARFLETSSKRLAKRHGVFTKGLEEVGINCLRSNAGLFCWMDLRRLLKDLTFDGEMVLWRVIVNEVRLPVSPGSSFKCVEPGWFRVCFA

SEQ ID NO: 4745 - protein, 393 aa, Danthoniopsis dinteri
EPASTEDPALSIAGAVQSQKLAVRAISRLQALPGGDVKLLCDTVVEHVRELTGYDRVMVYRFHEDEHGEVVAESRRDDLEPYIGLHYPATDIPQASRFLFRQNRVRMIADCHATPVKVIQDTGLSQPLCLVGSTLRAPHGCHAQYMANMGSIASLVMAVIISSGGDDEQTARGGISSAMKLLGLVVCHHTSPRFIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTLCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIH

SEQ ID NO: 4746 - protein, 394 aa, Diarrhena obovata
EPARTEDPALSIAGAVQSQKLAVRAISRLQALPGGDVKLLCDTVVEHVRELTGYDRVMVYKFHDDEHGEVLAESRRADLEPYLGLHYPATDIPQASRFLFWQNRVRVIADCHAAPVRVIQDPAMPQPLCLVGSTLRSPHGCHAQYMANMGSIASLVMAVIISSGGEDEHNMARGAIPSAMKLWGLVVCHHTSPRCIPFPLRYACEFLMQAFGLQLNMELQLAHQLSEKHILRTQTLLCDMLLRDSPAGIVMQSPSIMDLVKCDGAALYYHGKYYPLGVTPTEAQIKDIIEWLTVCHGDSTGLSTDSLADAGYSGATALGDEVCGMAVAYITPSDYLFWFRSHTAKEIKWGGAKHHPEDKDDGQRMHPRSSFKAFLEVVKSRSLPWENAEMDAIH

SEQ ID NO: 4747 - protein, 534 aa, Oryza sativa
MGNSCQNGTYGNNYQNSNRFQNDRFASRYVDGNDTEDCYSGSSRASLAGALRQGLNLKSPVLGYKTPNVRELYTLGRELGQGQFGKTYLCTEISTGCQYACKTILKSNLRCVSDIEDVRREIQIMHHLSGQKNIVTIKDTYEDEQAVHIVMELCAGGELFSKIQKRGHYSERKAAELIKIIVGIIETCHSHGVMHRDLKPENFLLLDADDEFSVKAIDFGLSVFFRPGQVFREVVGSPYYIAPEVLEKRYGPEADIWTAGVILYVLLTGVPPFWADTQSGIYEKVLDGRIDFKSNRWPRISDSAKDLIKKMLCPYPLERLKAHEVLKHPWICDNGVATNRALDPSVLPRLKQFSAMNRLKKLSLQIIAERLSEEEIVGLREMFKAMDTKNRSVVTFGELKGLKRYSSVFKDTEINDLMEAADDTTSTINWEEFIAAAVSLNKIEREKHLMAAFTYFDKDGSGFITVDKLQKACMERNMEDTFLEEMILEVDQNNDGQIDYAEFVTMMQSNNFGLGWQTVESSLNVALREAPQVY

SEQ ID NO: 4748 - protein, 394 aa, Ehrharta erecta
EPARTEDPALSIAGAVQSQKLAVRAISRLQALPGGDVKLLCDTVVEHVRELTGYDRVMVYRFHEDEHGEVVAESRRNDLEPYLGLHYPATDIPQASRFLFRQNRVRMIADCHAAPVRVIQDPGLPQQLCLVGSTLRSPHGCHAQYMANMGSIASLVMAVIISSAGDDENNMARGGIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYPGSAALGDAVSGMAVAYITPSDYLFWFRSHTAKEIKWGGAKHHPEDKDDGQRMHPRSSFKAFLEVVKSRSLPWENAEMDAIH

SEQ ID NO: 4749 - protein, 394 aa, Unknown
  Elymus sp. Kellogg s.n.
EPARTEDPALSIAGAVQSQKLAVRAISRLQALPGGDVKLLCDTVVEHVRELTGYDRVMVYKFHDDEHGEVLSESRRGDLEPYLGLHYPATDIPQASRFLFLQNRVRMIADCHAAAVRVIQDPAMPQPLCLVGSTLRSPHGCHAQYMANMGSIASLVMAVIISSGGEDEHNMTRGVIPSAMKLWGLVVCHHTSPRCIPFPLRYACEFLMQAFGLQLNMELQLAHQLSEKHILRTQTLLCDMLLRDSPTGIVTQTPSIMDLVKCDGAALFYHGKYYPLGVTPTESQIKDIIEWLTVCHGDSTGLSTDSLADAGYPGATALGDAVCGMAVAYITPSDYLFWFRSHTAKEIKWGGAKHHPEDKDDGQRMHPRSSFKAFLEVVKSRSLPWENAEMDAIT

SEQ ID NO: 4750 - protein, 410 aa, Bacteroides fragilis
MNTHSASKLFTPVTIGPLTLRNRTIRSAAFEGMCPGNAPSPMLLDYHRSVAAGGVGMTTIAYASVTRSGLSFPRQLWLRPEIIPGLREVTAAIHAEGAAASIQIGHCGNMSHKSICGVTPISASSGFNIYSPTWVRGMKREELPEMAKAYGRAVCLAREAGFDAVEVHTGHGYLISQFLSPYTNHRKDEYGGSLENRMRFMTMVMNEVMKAAGKDLAVFVKMNMRDGFRGGMEIEETLEVARRLESLGAHALVLSGGFVSKAPMYVMRGAMPIKTLTHYMDCWWLKFGVKLAGRMMIPTVPFKEAYFLEDALKFRSEIKIPLIYVGGLVSREKIDEVLNEGFEAVQMARALLNEPGFVNRMRREEKARCNCGHSNYCIGRMYTIEMACHQHLTEELPLCLKKEIEQLENK

SEQ ID NO: 4751 - protein, 520 aa, Kluyveromyces lactis
MNEYDAVDRHTFKVFNQDFTVDKRFQLIKEIGHGSYGIVCSARFTEAADETTVAIKKVTNVFSKTLLCKRSLRELKLLRHFRGHKNITCLYDMDIVFQPDGMFNGLYLYEELMECDMHQIVKSGQPLTDAHYQSFIYQILCGLKYIHSADVLHRDLKPGNLLVNADCQLKICDFGLARGYSENPVENNQFLTEYVATRWYRAPEIMLSYQGYTKAIDVWSCGCILAELLGGKPIFKGKDYVDQLNRILQVLGTPPEETLKRIGSKNVQDYIHQLGYIPKIPFSTLYPNANPDALNLLEGMLSFDPQLRITVDDALQHPYLSIWHDPADEPICTEKFDFSFESVNEIEQLKQMVIDEVTDFRQYVRLPLLHEQQQQQGKTDGGFDDQIREDQRTFQAQLEEQVNNGRTASNVPSFDEPFSSQMMGSASQQDPLVGIHSDNLPSHELDFPPRPSENVLDSPMGLSHQQTHNGSPECQDINDLLGLERELEFGLDRQFNETVWYIASSTLFVEHKLLLRFCYT

SEQ ID NO: 4752 - protein, 144 aa, Rubrobacter xylanophilus
MLSPFRGFRDLQSEMDRLFGEAFGRPPRADAEGGWTPAVDVLTRGDDLIIRAELPGVRREDVEVTVSNGVLTLAGERREEEERERAGYLIRERRQGSFRRSMTLPEGVNEDEIKATFRDGVLEVSVPGASAAVEAPPRRIEIEG

SEQ ID NO: 4753 - protein, 361 aa, Triticum aestivum
  misc_feature (226)..(226): Xaa can be any naturally occurring amino acid
  misc_feature (229)..(230): Xaa can be any naturally occurring amino acid
AYLGDTLEQVCTKKQAGTGPEFPGYRRPTRPGFSTFTGAIEEYCNQYVDKDALIYLILANEMLHELHPDIITIAEDATYYPGLCEPTTQGGLGFDYWANLSIPEMWLWHLENVPEREWSMNKIMKVLISSNHHMLSYVENHNQSISGRKSFAEIILNTGMYSSGSVDDDLIFKASSLLKIIKLITFTTSGGAYLNFMGNEFAHPKRIEFPMSSNGYSFHLACRQWXTIXXKGVHKHIFNFDKDIMSLDENERVTSRGSLNVHHCDDTNMVISFTRGPFLFVFNFNPEVPYQLYRVGVDEAGEYQLILNTDETKYGGRGELKSSQYMKKTSDRRADGCRNSLELALASRSAQVYKLVRILRI

SEQ ID NO: 4754 - protein, 410 aa, Unknown
  Silicibacter sp. TM1040
MATQEPQIGPATRAEALLRMEAFTPRMGLNYATFRNHDYGPQRQSAVSMLSPYLRRRLLTEPEVIAAALAAHGPQEADKFVQEVLWRGYFKGWMERRPEVWANYITGRDADFVALEEDPGLAIRVNAAETGETGLAYFDTWAKELVRTGYLHNHARMWFASLWIFTLKLPWRLGADFFLRHLLDGDPASNTCSWRWVAGLHTRGKPYVAQASNIARFSGGRFAPQESELATEVTGLMDEEPEGLPHVNPLRSVLSPEEAKPTAVLLTEEDCMPASADLASLDIRGAARLYCSHLRSPRRVAAAVSTFEEDALADTVARIGLDAQPWAASEPEALADWVQSIGAQQIFMPYATVGPLGDWIARALPLLRARGVAVAEWQRDWDGLVWPHATAGFFKVKKRLPDILTKAGLT

SEQ ID NO: 4755 - protein, 468 aa, Streptococcus mutans
MSKTLPKDFIFGGATAAYQAEGATHADGKGPVAWDKYLEDNYWYTAEPASDFYHQYPVDLKLAEEFGVNGIRISIAWSRIFPKGYGAVNPKGLAFYHNLFAECHKRHVEPFVTLHHFDTPEALHSNGDFLNRENIEHFVNYAEFCFKEFSEVNYWTTFNEIGPIGDGQYLVGKFPPGIQYDLAKVFQSHHNMMVAHSKAVKLFKDGGYSGEIGVVHALPTKYPYDPNNPADIRAAELEDIIHNKFILDATYLGKYSEKTMEGVNHILAVNGGQLDLREEDFAALEAAKDLNDFLGINYYISDWMRAFDGETEITHNAKGEKGSSKYQIKGVGRREAPVNVPKTDWDWIIYPQGLYDQIMRVKQDYPNYKKIYITENGLGYKDEFVNHTVYDDARIDYVKKHLEVLSDAIADGANVKGYFIWSLMDVFSWSNGYEKRYGLFYVDFDTQERYPKKSAYWYKKLAETQIID

SEQ ID NO: 4756 - protein, 190 aa, Psilotum nudum
DEHGEVVAEIRRSDLDPYLGLHYPATDIPQASRFLFLKNRVRMICDCSAPVIRIIQDKELKQPLSLAGSTLRAPHGCHAYYMRNMGSIGSLVMAVIVNDNDAEPSGRGNQPKNRRLWGMVVCHHTTPRAVPFSLRSACEFLMQVFGLQLNMEIELAAQMREKHILRTQTLLCDMLLRDAPIGIVTQSPNI

SEQ ID NO: 4757 - protein, 479 aa, Botryotinia fuckeliana
MAQTNGVLQEPAITTMNGAPVLKPASTQRIGNQLRATLLLQDINLLELIQHITHERIPERVVHARGTSAHGYFEVTDDISDVTSAAFLNRVGKQTDIFCRFSTVAGRAESAETVRDTRGFAFKMFTEEGNLDWLFLSTPVFPIRDGAKFPSFTHATKKNPRSGLPDHKAFWDYFTHNQEGIHFLMFLFSDRATPVDFQHADIFSINTYKFTKSDGSFTYVKIHLKTNQGVKNFTQDEANQKAGVDPDFQTRSLYEDIENQKYPTWDVFAQIIDPVKAENYHINIFDATKTFPFSEFPLRKFGKITLNRNVDNFFAEQEQSAFSPTNLVPGWALTPDPIIQTRALAYADTQRYRLGANFVQLPVNAPYKKPFTPLIRDGAATVNGNLGGTPNYFPSSFYNVGAATQYAQPDEEQFQGTVVNFESEVVDADYVQPRIFWEKTLAEEPGQQDNLISNVAGHLSAVTGDKGLGSSTSGLCNVR

SEQ ID NO: 4758 - protein, 188 aa, Podocarpus neriifolius
DEHGEVVAEIRRADLEPYLGLHYPSTDIPQASRFLFMQNRVRMICDCSATPVKVIQSEELRQPLCLVGSTLRAPHGCHAQYMANMGSIASLVMAVVINGNDEEGEEQVPKSMKLWGLVVCHHTSSRAVSFPLRYACEFLMQAFGLQLNMELQLAAQLTEKHILRTQTLLCDMLLRDAPIGIVTQSPSI

SEQ ID NO: 4759 - protein, 729 aa, Saccharophagus degradans
MLSITPEIIKEIVQGEYHDVFAVLGPHAQKNGYVIRAFFPAAKTLQVKSKLDGSVLAEAVMRNEEGFFEANCNCSEKPSYYFTVGYGDKEFDVEDMYRFGSTIPEGDLYLFGEGTYEQAYRLFGAHPTEVDGVPGCRFTVWAPNAKTVAVVGDFNFWQGRAHVMRKHIPSGIWELFIPYLGEGALYKYEIRNHSGDCLPHKADPYGFAAQKPPEQASVVSVLDRYEWNDAEWFAKANNWTQRDRPISIYEVHLGSWKRVVEEDNRYLSYKELAADLIPYVKSMGFTHIQLMPISEFPFDGSWGYQPVGLYAPTSRFGSPEDFKYFVDCCHQNDLAVLIDWVPGHFPTDSHGLGLFDGTPLYEHADSRQGFHPDWNTYIYNYGRHEVKSFLMANALFWLEQYHIDGLRVDAVASMLYLDYSRKDGEWLPNSYGGRENLEAIDFLRLVNERVYKRFPHAMMVAEESTAWPGVSSPTSCGGLGFGYKWNMGWMNDSLQYISKEPIHRQYHHHDMTFSLHYAFSENFVLPLSHDEVVHGKRSLLGRMPGDAWQQFANLRAYYAFMWTHPGKKLLFMGGEFAQGMEWNHDTSLSWHQLEIDYHSGIQTLVKSLNRLYTDVPALYKEDCMSSGFEWVEADDRHNSIFAFLRKAKDEKPVLVVANFTPVAREGYRVGVNQPGYYRELLNTDSELFGGSNLGNEGGVHSEEIAWHQRPQSVSINIPALAAVVFQLDS

SEQ ID NO: 4760 - protein, 394 aa, Unknown
  Eremitis sp. Clark and Zhang 1343
EPARTEDPALSIAGSVQSQKLAVRAISRLQALPGGDVKLLCDTVVENIRELTGYDRVMGYRFHDDEHGEVVAESRRADLEPYLGLHYPATDIPQASRFLFRQNRVRMIADCHTAPVRVIQDPVLPQPLCLVGSTLRAPHGCHAQYMANMGSIASLVMAVIISSGGDDSHNSSRGGIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEAQIKDIIEWLTLCHGDSTGLSTDSLADAGYPGAAALGDAVCGMAVAYITPSDYLFWFRSHTAKEIKWGGAKHHPEDKDDGQRMHPRSSFKAFLEVVKSRSLPWESAEMDAIH

SEQ ID NO: 4761 - protein, 177 aa, Triticum aestivum
RRRPPPYANFSKGSSQIIAQYYQLIRLGFEGYKDIMQNCRDNATVLREGVEKMGYFHLVSKDSGVPLVAFSLKDSSKYTVFEVVESLRRFGWIVPAYTMPADAEHIAVMRVVIREDFSRGLAERLITDLKKVMVEMDAHAKKHGHHEHVKKTAHQIEKEVTTYWRTFVARKKHSLVC

SEQ ID NO: 4762 - protein, 394 aa, Glyceria grandis
EPARTEDPALSIAGAVQSQKLAVRAISRLQALPGGDVKLLCETVVEHVRELTGYDRVMVYKFHDDEHGEVLAESRRPDLEPYLGLHYPATDIPQASRFLFRQNRVRMIADCHAAPVRVIQDPAMPQPLCLVGSTLRSPHGCHAQYMANMGSIASLVMAVIISSGGDDEHHMARGNIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEAQIKDIIEWLTACHGDSTGLSTDSLADAGYSGATVLGDAVCGMAVACITPSDYLFWFRSHTAKEIKWGGAKHHPEDKDDGQRMHPRSSFKAFLEVVKSRSLPWENAEMDAIH

SEQ ID NO: 4763 - protein, 393 aa, Hakonechloa macra
EPARTEDPALSIAGAVQSQKLAVRAISRLQALPGGDVKLLCDTVVEHVRELTGYDRVMVYRFHEDEHGEVVAESRRADLETYLGLHYPATDIPQASRFLFRQNRVRMIADCHATPVRVIQDPGLPQPLCLVGSTLRAPHGCHAQYMANMGSIASLVMAVIISSGGDDEQTARGGISSTMKLWGLVVCHHTSPRFIPFPLRYACEFLMQAFGLQLNMELQLAHQLSEKHILRTQTLLCDMLLRESPTGIVTQSPSIMDLVKCDGAALYYHGKYYPLCVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIH

SEQ ID NO: 4764 - protein, 392 aa, Lithachne pauciflora
EPARTEDPALSIAGAVHSQKLAVRAISRLQALPGGDVKLLCDTVVEHVRELTGYDRVMVYRFHEDEHGEVVAESRRADLEPYLGLHYPATDIPQASRFLFRQNRVRMIADCHAAPVRVIQDPALQQPLCLVGSTLRAPHGCHAQYMANMGSIASLVMAVIISSGGDDEHNITRGGIPSAMKLWGLVVCHHTSPRCIPFPLRYACEFLMQAFGLQLSMELQLAHQLSEKHILRTQTLLCDMLLRDSPTGIVTQSPSIMDLVKCDGAALYYHGKYYPLGVTPTEAQIKDIIEWLTLCHGDSTGLSTDNFADAGYPGAAALGDAVCGMAVAYITPSDYLFWFRSHTAKEIKWGGAKHHPEDKDDGQRMHPRSSFKAFLEVVKSRSLPWENAEMDA

SEQ ID NO: 4765 - protein, 392 aa, Lolium perenne
TGYDRVMVYKFHDDEHGEVLAESRRADLEPYLGLHYPATDIPQASRFLFRQNRVRMIADCHAAPVRVIQDPAMPQPLCLVGSTLRSPHGCHAQYMANMGSIASLVMAVIISSGGEDEHNMGRGAVPSAMKLWGLVVCHHTSPRCIPFPLRYACEFLMQAFGLQLNMELQLAHQMSEKHILRTQTLLCDMLLRDSPTGIVTQSPSTMDLVKCDGAALYYHGKYYPLGITPTEAQIKDIIKWLTVCHGDSTGLSTDSLADAGYPGATELGDAVCGMAVAYITPSDYLFWFRSHTAKEIKWGGAKHHPEDKDDGQRMHPRSSFKAFLEVVKSRSLPWENAEMDAIHSLQLILRDSFRDAGEGTSNSKAIVNGHVQLGELELRGIDELSSVAREMV

SEQ ID NO: 4766 - protein, 394 aa, Lygeum spartum
EPARTEDPALSIAGAVQSQKLAVRAISRLQALPGGDVKLLCDTVVEHVRELTGYDRVMVYKFHDDEHGEVLAESRRTDLEPYLGLHYPATDIPQASRFLFRQNRVRMIADCHAAPVKVFQDPAMPQPLCLVGSTLRSPHGCHAQYMANMGSIASLVMAVIISSGGDDEHNMSRGVIPSAMKLWGLVVCHHTSPRCIPFPLRYACEFFMQAFGLQLNMELQLAHQLSEKHILRTQTILCDMLLRDSPTGIVTQSPSIMDLVKCDGAALYYHGKYYPLGVTPTESQIKDIIDWLTVCHGDSTGLSTDSLADAGYPGAAALGDAVCGMAVAYITPSDYLFWFRSHTAKEIKWGGAKHHPEDKDDGQRMHPRSSFKAFLEVVRSRSLPWENAEMDAIH

SEQ ID NO: 4767 - protein, 532 aa, Daucus carota
MGGCFSKKEYQADGNGYRSAPTAYHTVTDQSYEKSSQRSQPQAQPQPQVQQTGPSLKPRQVHRPESNTILGKPFEDIRGKYTLGKELGRGQFGCVYQCTENSSGQLYACKSILKRKLVSKNDKEDIKREIQILQHLSGQPNIVEFKGVFEDRQSVHLVMELCAGGELFDRIIAQGHYSERAAATICRQIVNVVHVCHFMGVMHRDLKPENFLLSSKDKDAMLKATDFGLSVFIEEGKVYRNIVGSAYYVAPEVLRRSYGKEIDIWSAGVILYILLSGVPPFWAENEKGIFDAILEGVIDFESEPWPSVSNSAKDLVRKMLTQDPRRRITSAQVLDHPWMREGGEASDKPIDSAVLSRMKQFRAMNKLKQLALKVIAESLSEEEIKGLKSMFANMDTDKSGTITYEELKSGLARLGSKLSEVEVQQLMDAADVDGNGTIDYLEFITATMHRHKLESYEHQAFQYFDKDNSGFITKDELESAMKEYGMGDEATIKDIISEVDSDNDGRINYDEFCAMMRRARNRRKLFSVSLTS

SEQ ID NO: 4768 - protein, 480 aa, Streptococcus pyogenes
MLAFPKEFWWGGATSGPQSEGRFAKQHRNLFDYWYEEEPDLFYDYVGPDTASDAYHQIESDLALLASLGHNSYRTSIQWTRLIDDFEQATINPDGLAYYNRVINACLANGIRPVINLHHFDLPIALYQAYGGWESKHVVDIFVAFSKVCFEQFGDRVKDWFVHNEPMVVVEGSYLMQFHYPAIVDGKKAVQVAYNLALATAKVIQAYRRGPAELSNGRIGTILNLTPAYPASQSEADMAAAHFTELWNNDLFMEAAVHGKFPEELVAVLKKDGVLWQSTPEELALIAENRVDYLGLNFYHPKRVKAPDVIPVISPSWSPEWYYDPYLMPGRRMNVDKGWEIYPEAVYDIAIKMRDHYDNIPWFLSENGVGISGEERYRDETGQIQDDYRIQFLKEHLTYLHKGIEAGSNCFGYHVWTPIDGWSWLNAYKNRYGLVENNIHTQVRRPKASAYWFKKVATHNRLISLEVMEEFGGSASHLSD

SEQ ID NO: 4769 - protein, 394 aa, Melica cupanii
EPARTEDPALSIAGAVQSQKLAVRAISRLQALPGGDVKLLCDTVVEHVRELTGYDRVMVYKFHDDEHGEVLAESRRADLEPYLGLHYPATDIPQASRFLFRQNRVRMIADCGAAPVTVIQDPAMPQPLCLVGSTLRSPHGCHAQYMANMGSIASLVMAVIISSGGDDDHNMVRGSIPSAMKLWGLVVCHHTSPRCIPFPLRYACEFLMQAFGLELNMELQLAHQMSEKHILRTQTLLCDMLLRDSPTGIVTQSPSIMDLVKCDGAALFYHGKYYPLGVTPTEAQIKDIIEWLTVCHGDSTGLSTDSLADAGYSGATALGDAVCGMAVAYITPSDYLFWFRSHTAKEIKWGGAKHHPEDKDDGQRMHPRPSFKAFLEVVKSRSIPWENAEMDAIH

SEQ ID NO: 4770 - protein, 393 aa, Miscanthus sinensis
EPARTEDPALSMAGAVQSQKLAVRAISCLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRASHGCHAQYMANMGSIASLVMAVIISSGGDDEQTGRGGISSAMKLWGLVVCHHTSPRCIPLPLRYACEFLMQAFGLQLNMELQLAHQVSEKHILRTQTLLCDMLLRDSPTGIVTQSPSIMDLVKCDGAALYYHGKYYPLGVTPTESQIKDIIEWLTVCHGDSTGLSTDSLADAGYLGAAALWDAVCGMAVAYITPSDYLFWFRSHTAKEIKWGGAKHHPKDKDDGQRMHPRSSFKAFLEVVKSRSLPWENAEMDAIH

SEQ ID NO: 4771 - protein, 388 aa, Molinia caerulea
EDPALSIAGAVQSQKLAVRAISRLQALPGGDVKLLCDTVVENVRELTGYDRVMVYRFHEDEHGEVVAESRRADLEPYLGLHYPATDIPQASRFLFRQNRVRMIADCHATPVRVIQDPGLSQPLCLVGSTLRAPHGCHAQYMANMGSIASLVMAVIIIIGGDDEQTARGSISSAMKLWGLVVCHHTSPRFIHFPLRYACEFLMQAFGLQLNMELQLAHQLSEKHILRTQTLLCDMLLRDSPSGIVMQSPSIMDLVKCDGAALYYHGKYYPLGVTPTESQIMDIIEWLTMCHGGSTGLSTDSLADAGYLGAAALGDAVCGMAVAYITSSDYLFWFRSHTAKEIKWGGAKHHPEDKDDGQRMHPRSSFKAFLEVIKSRSLPWENAEMDAIH

SEQ ID NO: 4772 - protein, 387 aa, Nardus stricta
PALSIAGAVQSQKLAVRAISRLQALPGGDVKLLCDTVVEHVRELTGYDRVIVYKFHDDEHGEVLAESRRTDLEPYLGLHYPATDIPQASRFLFRQNFVRMIADCHAAPVRVIQDPAMPQPLCLVGSTLRSPHGCHAQYMANMGSIASLVMAVIISSGGDDEHNMARGVVPSAMKLWGLVVCHHTSPRCIPFPLRYACEFLMQAFGLQPNMELQLAHQMSEKHILRTQTLLCDMLLRDSPTGIVTQSPSIMDLVKCDGAALYYHGKYYPLGVTPTESQIKDIIEWLTVCHGDSTGLSTDSLADAGYPGAAALGDAVCGMAVAYITQSDYLFRFRSHTAKEIKWGGAKHHPEDKDDGQRMHPRSSFKAFLAVVKSRSLPWENAEMDAIH

SEQ ID NO: 4773 - protein, 428 aa, Phaseolus vulgaris
PERVVHARGASAKGFFEVTHDISHLTCADFLRAPGVQTPLIVRFSTVIHERGSPETLRDPRGFAVKFYTREGNFDLVGNNFPVFFVRDGLKFPDMVHALKPNPKSHIQENWRILDFFSHHPESLHMFSFLFDDVGIPQDYRHMDGFGVNTYTLISKAGKPHYVKFHWKATCGEKCLLDEEAVRVGGFNHSHATQDLHDSIAAGNYPEWKLYIQTLDPEQEDKFDFDPLDVTRICPEDVLPLQPVGRMVLNKNIDNFFAENEQLAFCPAIIVPGVYYSDDKLLQTRIFSYADSQRHRLGPNYLQIPANAPKCAHHNNHHEGFMNFMHRDEEVNYFPSRYDPVRHAERIPVPPRILDGKREKCMIEKENNFKQPGERYRSWASDRQERFLRRWVDALSEPRVTHEIRSIWISYWSQADRSLGQKIASHLN

SEQ ID NO: 4774 - protein, 488 aa, Oceanobacillus iheyensis
MKLSKKQIVLILVGALLLGFAGAYGGFQLAQDNNQQSSQSSVENSSTNEDDSNGQSELTGDLSKVSQAYDIIKENYLEDVEDKQLVEGAIEGMLATLEDQHTSYLDVEMMQQFNEQIESSFEGIGAEVSMVNGNVTIVSPMKGSPAEESGLRPNDQVLKVDGESLEGLNLNEAVAQIRGEKGSEVVLEIQRSGVTEPFEVTIVRDTIPVETVYSETKEVDGKLTGIIEITNFSEKTGDEFDQQLTELENQGIEGLVIDVRGNPGGLLNVAEDILKHLVPKDLPILQIEDGEGQVEEVYSDLEEKKEYPISVMIDEGSASASEILAVAMKDLGYDIVGETSYGKGTVQQAVPMGDGSSIKLTTLKWLSPKGEWINEEGVEPTIEEKQPEYYYSIPIQVEEPFSLDETSEEIANMQVMLTGLGYDTGRTDGYFDEQTAEAVKDFQADNDLEATGEVDSETGGLIETQLVEKIRNGEDDQQLDTSLEELYQ

SEQ ID NO: 4775 - protein, 252 aa, Brassica juncea
MAYQTELGGESSSQRKAGRGKIEIKRIENTTNRQVTFCKRRNGLLKKAYELSVLCYAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKREVDLHNDNQLLRAKIAENERNNPSMSLMPGGSNYEQIMPPPQTQPQPFDSRNYFQVAALQPNNHHYSSAGREDQTALQLV

SEQ ID NO: 4776 - protein, 365 aa, Ipomoea batatas
MVGGGDFLAVQTHGGQYVQYDIFGNLFEVTSKYAPPITPIGRGAYGIVCSALNAETNEMVAIKKIADAFDNYMDAKRTLREIKLLRHLEHENVIAIKDVIPPPLRREFNDVYIATELMDTDLHQIIRSNQGLSEEHCQYFLYQILRGLKYIHSANVIHRDLKPSNLLLNSNCDLKICDFGLARTNLDNEFMTEYVVTRWYRAPELLLNSSDYTAAIDVWSVGCIFMELMNRKPLFQGKDHVHQMRLITELLGTPTDSDLGSIQNENARRYIRQLPLRPRQQLANGFPHVHPLAIDLMDKMLTFNPSKRITVEEALAHPYLAQLHDKSDEPICPVPFTDFEKQAYGEEQIKDMIYQEALAMNPGYA

SEQ ID NO: 4777 - protein, 135 aa, Zea mays
MRKHRIVSLVAALLVLLALAAVSSTRNAQEESAADNAGMLAGGIKDVPANENDLQLQELARFAVNEHNQKANALLGFEKLVKAKTQVVAGTMYYLTIEVKDGEVKKLYEAKVWEKPWENFKELQEFKPVEEGASA

SEQ ID NO: 4778 - protein, 668 aa, Moorella thermoacetica
MVVAYTRLFEPIKIGKVEIKNKIAMAPMGVLGLATQDGCFSKRVVDYYVERAKGGTGLIITSVTKVDNEIERFKAGAVPVATANPLHFIATAGELTERVHAYGTKIFLQLGMGFGRVAAPILLESHPVAPSALPNFWDPSITCRELTTAEVETLVQRASEAAEIAVEAGFDGVEIHAMHEGYLLDQFTIALFNRRGDKYGGALEDRLTFPIEIVRAIKDRVGKDFPVVLRFSIKNYIKDWRQGGLPGENFQEKGRDVEEALAAAKILEGAGYDGFDADAGSYDAWYWAHPPVYQKHGCYLPLTQRLKEVVKVPVIVAGRLEIPELAEEALVKGQADMIAIGRGLLTDPYWVNKVMTGRSKNIRPCIGCHDGCLGRGFLGRPLSCTVNPACGREEEYAIDRAPEAKQVMVIGGGVAGMEAARVAALRGHRVSLYEKSDRLGGHVVEAAVPDFKADDGRLLEWYKTELGELQVEIHLNQEVTPEFVEEKNPDVVVVATGSTPAIPDIPGVNKDKVTTVSDLLLGKKQAGDRVVIIGGGLAGCETALWLAQQGKDVTIIEILDDLMRAGIPVPYMNRMMLLDLLKMNGVKWLTETSVLEVTDDGVTLIGKTYQRSPLPADTVILAVGFAADQRLYNALRDKIPNLYLIGDSREPRNILAAIWEGYEVGRGI

SEQ ID NO: 4779 - protein, 134 aa, Burkholderia fungorum
MEDFVHDPFAARGALERWFGDFSSSRFQPRIDVVDEGKILRVTIELPGMEREDLSVSVEDGALVLRGEKKQDVHSEEDGCYRLERAYGVFTRTIPMPDNADPDHALAKFDKGVLTLTVPKREQLRSASRTIDIG

SEQ ID NO: 4780 - protein, 571 aa, Sorghum bicolor
MAPLLLHASAISHSAHPGLRSHIGPNNEHISRHLSSSSQNTKRRCNISLRSRAQRISSQLGGQKLEHWEIPKRDWFPPSFTFGAATSAFQIEGGWNEDGKGPSTWDHFCHTYPDFIADKSNGDVAADSYHLYEEDVKLLKEMGMDAYRFSISWPRILPNGTLSDINEKGIAYYNNLINLLIDNGIEPYVTIFHWDTPQALVDDYGGFLDKRIIKDYTDFAGLCFERFGDRVNNWLTFNEPHTFTCLSYGTGILAPGRCSPGMKCPDPTGDSIREPYLVGHNFLLAHAETVDLYNKFHRGEKGRIGLALNVMGTVPYGSTFLDEQAHERCMDYNLGWYLEPVVRGDYPHSMRSSVRDRLPHFTEKEQQKLVGSYDMIGINYYSSRFAKHVDITENFSPELNTHDCCATEEITGPNGNTIGPATGNAWVYMYPKGLKDILMIMKKRYGNPPVYITENGMGDIDNGDLSMEAALDDHIRLDYLQRHISVLKDSIDSGANVRGHFTWSLLDNFEWSSGYTERFGIVYVDRENGCKRTLKRSARWLKEFNGAAKRPGNLIKPNFSEINKIKVVTPA

SEQ ID NO: 4781 - protein, 389 aa, Unknown
  Azoarcus sp. EbN1
MLAGLIDLPWWGYILVALGLTHVTIASVTIFLHRHQAHRALELHPIASHFFRAWLWLTTGMVTKEWAAVHRKHHAKCETADDPHSPQVLGIRKVLFEGAELYRAEAGNKETLARYGHGTPDDWLERHIYRHSIVGISIMLITDLVLFGPLGLTIWAVQMMWIPIWAAGVVNGLGHYIGYRNFDCSDAATNLVPWGILIGGEELHNNHHSFATSAKLSAKWYEFDIGWMYIRMLALLGLAKVRKVIPSPKFGEAKNVPDLDTLQAIITHRYDVMTRYVASLKRLCGDEIERLAATHGRSFNPRALRRWVLSGEDRNLAPDDRRTLELVIVDSAALSTIASMRRDLVAIWGRSTASREQLLKQLHDWIARAEQSGIAQLQEFSFRLRQYTA

SEQ ID NO: 4782 - protein, 197 aa, Solibacter usitatus
MATKQDTADDRQNAQRQENTQIARKSPGWMFRNEPGILGSRGSFFTNPYQLMRRMTEEMDRTFGFGGSGEVGPWSPATEVVERDGKYIVRSELAGLKPEEVKVEVTDGELIIQGERKSEHEETQGRYRRSEHRYGQFYRSIALPEGVDPAQVHARFENGMLEVTIPAPPQQQSQRRQIPIEGTSGGRNPNPSPEPHG

SEQ ID NO: 4783 - protein, 510 aa, Glycine max
MDGRASSSVGGEASPAPAPVPITNANAPPPFLSKTYEMVEDPSTDSIVSWSPTNNSFVVWNPPEFARDLLPKHFKHNNFSSFVRQLNTYGFRKVDPDRWEFANEGFLRGQKHLLKTITRRKPAHGHNQQAQQAHGQSSSVGACVEVGKFGLEEEVEILKRDKNVLMQELVRLRQQQQATDNQLQSMVQRLQGMEQRQQQMMSFLAKAVQSPGFLAQFVQQQNESSRRITEANKKRRLKQEGIGEMEHTAASDGQIVKYQPLINEAAKAMLRQMMKLDTSRLESFSNNADNYLIGDHSSSSGATDRGNSLSRTSGVTLQVVPLTTIQSSHIPSATGIGDDPSTGKSEILSTPQVVACDEVTKAQYSNVNVSVGESNAPAIPATQTDEIMRDLSTIPDIVAGNILDIPQENYMAPETGGEGYMDPTSFGVNVSLPIDFDSISPEADIDDLLNNPHFWDDILRTPVSEEIDTNDAEVFKENEVQPMENGLDESQNMDQLTEQMGLLSSDAKRI

SEQ ID NO: 4784 - protein, 232 aa, Zea mays
MYRAKRAALSPKVKRRVGKYELGRTIGEGTFAKVRFAKNTENGEPVAIKILDKEKVKRHRLVEQIKREICIMKLVRHPNVVRLFEVMGSKARIFIVLEYVTGGELFEIIATNGRLKEDEARKYFQQLINAVDYCHSRGVYHRDLKLENLLLDAAGNLKVSDFGLSALTEQVKADGLLHTTCGTPNYVAPEVIEDGGYDGATADIWSCGVILFVLLAGYLPFEDDNIIALYKK

SEQ ID NO: 4785 - protein, 190 aa, Salvinia natans
DEHGEVVAEIRRSDLEPYLGLHYPATDIPQASRFLFMKNRVRMICDCRALNVRIIQDRELKQPISLAGSTLRAPHGCHSQYMGNMGSIASLVMAVIVNDNDEEGSSHAHQPKLRKLWGLVVCHHTSPRAVPFPLRSACEFLMQVFGLQLNMEVELAAQMREKHILHTQSLLCDMLLRDAPIGIVSESPNI

SEQ ID NO: 4786 - protein, 635 aa, Oryza sativa
MDGSCDCIEPLWQADDLLVKYQYISDFFIALAYFSIPLELIYFVKKSAFFPYRWVLIQFGAFIVLCGATHLINLWTFAIYTKTIAVVLTVAKAATAVVSCITALMLVHIIPDLLNVKLRERFLKDKADELDREMGIIRTQEETGRHVHMLTHEIRSTLDRHTILRTTLVELGRTLVLAECALWMPTRSGSALQLSHTIYNSAAIGSVVPINLPIVSKVFNSNRVVKIPHTSPLASITADKSRYVPPEVVAIRVPLLHLTNFQINDWPELSAKSFAVMVLMLPPDSAREWRPHERELVEVVADQVAVALSHAAILEESMRARDLLMEQNIALDAARREAEMAICARNDFLAVMNHEMRTPMRAIVSLSSLLLETNLSAEQRLMVETILKSSDLLATLTNDVLDVSKLENGSLELEIAPFNLHSTFTDVVNLIKPVAACKRLSVMVTLAPELPLHAIGDQKRLMQIILNVAGNSIKFTKEGHVSITASMARPDALRGPHEPDYHPVVSDGFFYLAVQVKDTGCGISPQDMPHTFRKFAHPENAGKWNSGSGLGLALSRRFVSLMEGNIWLESEGVGKGCTAMFFVKLGMPEKPNANLRRMAPHPLQPNQGAGGPDALSISIMDSNPRVPRVRYQSSV

SEQ ID NO: 4787 - protein, 494 aa, Secale cereale
MDPCKFRPSSSFDTKTTTTNAGQPVWNDNEALTVGPRGPILLEDYHLLEKIAHFARERIPERVVHARGASAKGFFECTHDVTGLTCADFLRAPGARTPVIVRFSTVIHERGSPETIRDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVTRAGKSHYIKVHWRPTCGVSCLMDDEATLVGGKNHSHATQDLFDSIDAGNFPEWKLFVQVIDPEEEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRQAEPASFPVPTRPVVGKREKTRIKKENDFVQPGERYRSWAPDRQDRFVRRFADALAHPKVSHELRVIWIDFLSKCDKSCGMKVANRLNVKPSM

SEQ ID NO: 4788 - protein, 253 aa, Zea mays
MDASLAGVVLRRGHMISIGHRKIRSIHYLHRPHPPVRGYSSHHYKERIVTHREFVMDQDDYLSLCLAAALVAASQQAAGDAPPLRARAAASELRPLHFRCPICGKAFASYQALGGHKASHRKPAAAAAAYDGKAPSSPSSSGQHQKGAVAAGIGGASAGGRHVCTVCHRYFATGQALGGHKRFHYLHGPSVPASSLPPSTAGAAAGVGWLDLNLTPLAPDVSFAGVRRRRGEDDEVQSPLPLPAKKHRASTSA

SEQ ID NO: 4789 - protein, 191 aa, Salvinia natans
DEHGEVVAEIRRSDLEPYLGLHYPATDIPQASRFLFMKNRVRMICDCRAPSVRIIQDKELPQPLSLVGSTLRAPHGCHAQYMANMGTIASLVMAVVVNDNDEETRCKTPHYSKARRLWGLVVCHHTTPRVVPFALRSACEFLVQVFGLQLNMELELAAQMREKHILRTQTLLCDMLLRDAPIGIVSESPNI

SEQ ID NO: 4790 - protein, 394 aa, Nassella viridula
EPARTEIPALSIAGAVQSQKLAVRAISRLQALPGGDVKLLCDTVVEHVRELTGYDRVMVYKFHDDEHGEVLAESRRADLEPYLGLHYPATDIPQASRFLFRQNRVRMIADCHAAPVRVIQDPAMQQPLCLVGSTLRSPHGCHAQYMANMGSIASLVMAVIISSGGDDEHNMGRGTIPSAMKLWGLVVCHHTSPRCIPFPLRYACEFLMQAFGLQLNMELQLAHQLSEKHILRTQTLLCDMLLRDSPTGIVMQSPSIMDLVKCDGAALYYHGKYYPLGVTPIEAQIKDIIEWLTVCHGDSTGLSTDSLADAGYSGATALGDAVCGMAVAYITPSDYLFWFRSHTAKEIKWGGAKHHPEDKDDGQRMHPRSSFKAFLEVVKSRSLPWENAEMDAIH

SEQ ID NO: 4791 - protein, 644 aa, Unknown
  Streptomyces sp. 139
MCGIAGTYRWPDGKAVTDRLTETLAHRGPDGSGGYSHALGDGEVHLGHRRLAILDLSENGAQPMVSGGLALTYNGELYNAPELRAELEGAGVRFRGTSDTEVLLEAWRRWGTDCLPRLRGMFAFAVFDERTGDLVLVRDQLGIKPLFLLRRGKGLVFASELKALAAVTGGSLEVDPAALVASLLYYWVPDSRCAFRGAEKLPPGTWLRCRADGSVSAAGSGTCARSPPRAGAGTVRYLPDLAAVVEESTRRHLLSDVPVATFLSGGLDSSYLTALAARDRPGIPAYTIGFRAEDARFEAMPDDLRYARRVAERFGVDLREIEIAPDVLDLLPRMTYHLDEPVGDPAAINTFLICSAAREAGVKVMLSGMGADELFAGYRKHLANLIAVRYRHVPGPVRRGVASAVDRLPVATSRRGLRSVRFAKRFLSFAGLPEETAFRRSYTLYDRQELAGLLDPDLAPAVDDVLAEHADVYQDNELDDFVNRMCLADARMFLPGLNLAYTDRSSMAASTEVRVPYVDVEVVRAAFAVPGARKIAGRQGKAVLKEAATTVLPREIVYRPKGLFSAPLRAWMSRDLAPLVREVVNDGLLVRSGFLRREALARMVAEDAAGQRDFSKHLWHVLTLEYWYRDATSRAGRNSPTSTA

SEQ ID NO: 4792 - protein, 942 aa, Yersinia pseudotuberculosis
MTKYSLRARMMILILAPTLLLGLLLSTSFMVNRYNELQNQIVSAGTNIIEPLAVASEYGMSFRNRDTVRQLINLLHRRHSNIVRSISVFDVDNKLFVTSNYNYNSSQLRLPPGEPVPDSLMLSYRGDSLILRMPIVSESNLSSEQASGQGESDQILGYIAIDLDLQSVRLKQYKEIFISTLLLLFCMCVAILFAYRLMRDVTGPIRNMVNTVDRIRRGQLDSRVEGHMLGELNILKNGINSMAMSLAAYHEEMQQNIDQATSDLRETLEQMEIQNVELGLAKKRAQEASRIKSEFLANMSHELRTPLNGVIGFTRQTLKTSLTPTQTDYLQTIQRSANNLLCIINDVLDFSKLEADKLILEHIPFSLRGTLDEVIILLAHTAHEKGLELTLHINNDVPDQVLGDAMRLQQIVTNLLGNAIKFTEEGNIDILVVVKAIASQQVTLMVEIHDTGIGISESQQAQLFQAFRQADASTSRRHGGTGLGLVITERLVKEMGGNISFQSQMSCGSIFRFHLTLELNESIPYRQPDMAHLEGKQLAYIERNSTAARATINILNTTPLQVTHRQSLAQLPEQHYDFLLVGVPIPFRNNMAIHQDKLLTALKIADHVILALPSQSQVEAEQLKQIGAKGCLLKPISSIRLIPLLLAEDTHSKVPSEEQPRKQPKLPFRVMAVDDNPANLKLIGTLLEEQIEETVLCDSGAMAITYAREHTLDIILMDIQMPEIDGIRASEIIHQIPHHQETPIIAVTAHAVKGQQEQLLRLGMADYLAKPIDEARLLQVLSRYQSDNPPLSTASTASTASTASTASTASTASTASTAESLPLPVPKGAGVIDWAQAVRQAANKEDLARDLLTMLLEFMPQITARVQAILAGADDGDILNLVHKFHGSCACSGVPRLRQLCMTIELQLRQQVNLQDLEPEWLELLDEIENVSEAAKTYLRTE

SEQ ID NO: 4793 - protein, 394 aa, Olyra latifolia
EPARTEDPALSIAGAVQSQKLAVRAISRLQALPGGDVKLLCDTVVEHVRELTGYDRVMVYRFHEDEHGEVVAESRRADLEPYLGLHYPATDIPQASRFLFRQNRVRMIADCHAAPVKVIQDSALQQPLCLVGSMLRAPHGCHAQYMANMGSIASLVMAVIISSGGDDEHNITRGGIPSAMKLWGLVVCHHTSPRCIPFPLRYACEFLMQAFGLRLNMELQLAHQLSEKHILRTQTLLCDMLLRDSPTGIVTQSPSIMDLVKCDGDALYYHGKYYPLGVTPTEVQIKDIIEWLTVCHGDSTGLSTDSLADAGYPGAAALGDAVCGMAVAYITPSDYMFWFRSHTAKEIKWGGAKHHPEDKDDGQRMHPRSSFKAFLEVVKSRSLPWENAEMDAIH

SEQ ID NO: 4794 - protein, 393 aa, Panicum capillare
EPARTEAPALSIAGAVQSQKLAVRAISRLQALPGGDVKLLCDTVVEHVRELTGYDRVMVYRFHEDEHGEVVAECRRDNLEPYLGLHYPATDIPQASRFLFRQNRVRMIADCHATPVRVIQDPGLSQPLCLVGSTLRAPHGCHAQYMANMGSIASLVMAVIISSGGDDEQTARGGISSAMKLWGLVVCHHTSPRFIPFSLRYACEFLMQAFGLQLNMELQLAHQLSEKHILRTQSLLCDMLVRDSPTGIVTQSRSIMDLVKCDGAALYYHGKYYPLGVTPTESQIKDIIEWLTVCHGDSTGLSTDSLADAGYHGAAALGDAVCGMAVAYITPSDYLFWFRSHTAKEIKWGGAKHHPEDKDDGQRMHPRSSFKAFLEVVKSRSLPWENAEMDAIH

SEQ ID NO: 4795 - protein, 355 aa, Unknown
  Halobacterium sp. NRC-1
MTRGEARRPPQEFDRVLSSMCTTPHPAAREAAQAFLATNPGDPETYPAVAERERDAVALLGEIVGLSSPHGYIAAGGTEANLQAVRAARNRADADAVNVVAPASAHFSFQKAADVLGVELRLAPTDGDHRADVAAVADLVDGDTAVVVGVAGTTEYGRVDPIPALADIAAGVDANLHVDAAWGGFVLPFTDHDWSFADAPVNTMAIDPHKMGQAPVPAGGFLARDPETLDALAIETPYLESDTQPTLGGTRSGAGVAGALASLRALWPDGYREQYERTQGNAEYLAAELAARGYDVVDPELPLVAADMPDAEFQALREEGWRISRTASDALRVVCMPHVTREMLAAFLDDVDALA

SEQ ID NO: 4796 - protein, 394 aa, Pariana radiciflora
EPARTEDPAISIAGSVQSQKLAVRAISRLQALPGGDVKLLCDTVVEDIRELTGYDRVMVYRFHEDEHGEVVAESRRADLEPYLGLHYPATDIPQASRFLFRQNRVRMIADCHTAPVRVIQDPALPQPLCLVGSTLRAPHGCHAQYMANMGSIASLVMAVIISSGGDDSHNSSRGGIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEAQIKDIIEWLTLCHGDSTGLSTDSLADAGYPGAAALGDAVCGMAVAYITPSDYLFWFRSHTGKEIKWGGAKHHPEDKDDGQRMHPRSSFKAFLEVVKSRSLPWENAEMDAIH

SEQ ID NO: 4797 - protein, 372 aa, Methanopyrus kandleri
MILQRDSDYSDGTVLGSMCTEPHPVAAEAFVAGLHVNLGDPYLFPNAYRAERECIGWLAETLLDHPAPEEAEGSIVSGGTEANILAAYAAREVTGGREIIVPATRHFSFEKAARMLRMKLVEAPLRSDYTVDVDAVQDLISRDTALIVGIVGTTETGSVDDIEALSDVAEDHGVPLHVDAAFGGFTAPFLREEYPLPRFGFDLEAVVSVTVDPHKMGLVPPPAGGIVFRDDEFPKAIEVYAPYLSGGGASQYTITGTRPGAPVLALYANILELGEEGYRRIAFRCYEETLKVAEKARELGLELAVDPPHLNLVNIRLPDRGTAERLLRESEREGWKISVSTKPLGVRIVMMPHLDAETVSRFLELVARVLGG

SEQ ID NO: 4798 - protein, 353 aa, Pennisetum alopecuroides
TGYDRVMVYRFHEDQHGEVVAECRRDNLEPYLGLHYPATDIPQASRFLFRQNRVRMIADCHATPVRVIQYPGLSQPLCLVGSTLRAPHECHAQYMANMGSIASLVMAVIISSGGDDEQTTRGGISSAMKLWGLVVCHHTSPRFIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYHGAAALGDAVCGMAVAYITPSDCLFWFRSHTAKEIKWGGAKHHPEDKDDGQRMHPRSSFKAFLEVVKSRSLPWENAEMDAIHSLQLILRDSFR

SEQ ID NO: 4799 - protein, 467 aa, Lycopersicon esculentum
MKLLSKKAMCNSHGQDSSYFLGWEEYQKNPYDEIRNPKGIIQMGLAENQLSFDLLESWLTLNPDASAFKRNGHSIFRELSLFQDYHGLPAFKDALVQFMSEIRGNKVSFDSNKLVLTAGATSANETLMFCLADPGHAFLLPTPYYPGFDRDLKWRTGAEIVPIQCTSSNGFRITESALEEAYTEAERRNLRVKGVLVTNPSNPLGTTLTKKELQLLLTFVSTKQIHLISDEIYSGTVFNSPKFVSVMEVLIENNYMYTDVWDRVHIVYSLSKDLGLPGFRVGAIYSNDDRVVSAATKMSSFGLISSQTQYLLSALLSDKKFTKNYVSENQKRLKKRHEMLVGGLKQIGIRCLESNAGLFCWVDMRHLLSSNTFDGEMELWKKIVYEVGLNISAGSSCHCTEPGWFRACFANMSEDTLNIAIQRLKAFVDSRVNNKDDIQNQQQCSNKKKSFSKWVFRLSFNERQRER

SEQ ID NO: 4800 - protein, 1177 aa, Methylococcus capsulatus
MSEDLTSPPAMRQRFLRSLGSICLIVILAEVIVMTLLGAFHRGGLELVRWQESALDGLLLGLFSAPLLWIMALRPLAQQIARESQRNKELLDALDAHALVSITDLQGRILYANDNFCAVSRYGREELVGQDHRIVNSGYHGKAYIRDMWRTISRGNIWQGEFCNRRKDGTRYWVDSTIVPLMDNAGKPRQYISIRRDITAQKEAEAQLARLKQAMDANSEMILLTDRAGRIIYANPALCRFSGMAEGELLGQSPSILDSPLADQETLAAMQEALQAGQPWSGRLLNRRRTGPAPHDAEDYWAEISTTPIHTDGNGLVGYVQIQHDVSARVERERALAMEQEDTAARLRITETLQQSAPLDERCRQVLRILFELGTFGLQRKGGIFLKAEHGNCLKLFVLEGKFCDEFVRREQTIPMGACLCGRSAVSGEILVSDDCFQDHRHEHRFEDMESHGHYIVPIASGGDLLGVLFLYTDPNPTRSEARMVMLRQVGEMLALAILEDRAKASLKAAHDAAVDAAQAKSAFLANMSHEIRTPMNGVLGMLELLKDTDMSREQWDLVETASNSAESLLEIINSILDFSKLEAGKVEIERTEFNLPDLVEEVCALLAGRAHDKGLELNCFLPADLPRMWIGDPTRIRQILTNLLGNSVKFTERGEVSVKVMQGEAGAKRTDLSFEIRDTGIGIAPDVQARLFQPFTQADGSTSRRFGGTGLGLSICRNLVELMGGTIGLESAPGRGSRFWFTLPLEPLPGASAPALPDFSHRRVLVVDDNATNRVILSHYLTHWGLEVDEAERGDTALNRLRTALHESRPYDIVLLDLHMPYMDGHELARAMNAEPGLKDTPRLLLSSGGLTGEAELRALGIARSLLKPVRQSLLFNAIAEVLAAKATVQRRPAAKTETVLPAYEGRRVLVVEDNRVNQKVIVAMLGKFGIVPDVADNGQAALELLARSSYDLVLMDCQMPVLGGYEATGELRAREMSAGGRRTPVVALTAHAATGEREKCLAAGMDDYLSKPISRDRLAEALERWLGHPAAPASAETGQGAVNDDGGDRPAGLSWNREETLARLDHDEALLAEMIALCIEELPRHLAALQEAGAANDIAALADAAHAIKGMAGHFCAGSVRDLAARLEDQARKAGSMPDAASIGALETAAARLLEDLHGGSPAGDPAKGTNDAAQ

SEQ ID NO: 4801 - protein, 800 aa, Saccharomyces cerevisiae
MASVPKRHTYGGNVVTDRDRHSLQRNNEILHPIHKNQRKHATFGPYIIGSTLGEGEFGKVKLGWTKASSSNEVPKQVAIKLIRRDTIKKDADKEIKIYREINALKHLTHPNIIYLEEVLQNSKYIGIVLEFVSGGEFYKYIQRKRRLKESSACRLFAQLISGVNYMHYKGLVHRDLKLENLLLDKHENLVITDFGFVNEFFEDNELMKTSCGSPCYAAPELVVSTKAYEARKADVWSCGVILYAMLAGYLPWDDDHENPTGDDIARLYKYITQTPLKFPEYITPIPRDLLRRILVPNPRRRINLQTIKRHVWLKPHEAFLSIQPNYWDEHLQKERPKPPNKGDVGRHSTYSSSASSYSKSRDRNSLIIESTLEQHRMSPQLATSRPASPTFSTGSKVVLNDTKNDMKESNINGERTSASCRYTRDSKGNGQTQIEQVSARHSSRGNKHTSVAGLVTIPGSPTTARTRNAPSSKLTEHVKDSSQTSFTQEEFHRIGNYHVPRSRPRPTSYYPGLSRNTADNSLADIPVNKLGSNGRLTDAKDPVPLNAIHDTNKATISNNSIMLLSEGPAAKTSPVDYHYAIGDLNHGDKPITEVIDKINKDLTHKAAENGFPRESIDPESTSTILVTKEPTNSTDEDHVESQLENVGHSSNKSDASSDKDSKKIYEKKRFSFMSLYSSLNGSRSTVESRTSKGNAPPVSSRNPSGQSNRSNIKITQQQPRNLSDRVPNPDKKINDNRIRDNAPSYAESENPGRSVRASVMVSTLREENRSELSNEGNNVEAQTSTARKVLNFFKRRSMRV

SEQ ID NO: 4802 - protein, 395 aa, Peridictyon sanctum
EPARTEDPALSIAGAVQSQKLAVRAISRLQALPGGDVKLLCDTVVEHVRELTGYDRVMVYKFHDDEHGEVLAESRRVDLEPYLGLHYPATDIPQASRFLFRQNRVRMIADCHAAPVRVIQDPAMPQPLCLVGSTLRSPHGCHAQYMANMGSIASLVMAVIISSGGEDEHNMTRGVIPSAMKLWGLVVCHHTSPRCIPFPLRYACEFLMQAFGLQLSMELQLAHQLSEKHILRTQTLLCDMLLRDSPTGIVTQSPSIMDLVKCDGAALFYHGKYYPLGVVTPTEAQIKDIIEWLTVCHGDSTGLSTDSLADAGYPGATALGDAVCGMAVAYITPSDYLFWFRSHTAKEIKWGGAKHHPEDKDDGQRMHPRSSFKAFLEVVKSRSLPWENAEMDAIE

SEQ ID NO: 4803 - protein, 394 aa, Phalaris arundinacea
EPASTEDPALSIAGAVHSQKLAVRAISRLQALPGGDVKLLCGTVVEHVRELTSYDRVMVYKFHDDEHGEVLAESRRADLEPYLGLHYPATDIPQASRFLFRQNRVRMIADCHAAPVRVIQDPAMPQPLCLVGSTLRSPHGCHAQYMANMGSIASLVMAVIISSGGEDEHSMGRGAVPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKCYPLGITPTEAQIKDIIEWLTVCHGETTGLSTDSLADAGYPGATALGDAVCGMTVAYITPSDYLFWFRSHTAKEIKWGGAKHHPEDRDDGQRMHPRSSFKAFLEVVKSRSLPWENAEMDAIH

SEQ ID NO: 4804 - protein, 555 aa, Glycine max
MEGIISGVWNVLLQYFRSYKVAKTAVLNYITPFTDKFDLVDILLVWTVIVVIGTVIYRNVNYARKHGFRKTVTAWFFRRLKRISFITNKIDGEISKLASSLEADIQKHRDASKTTHIPTTGLSEEALVKKLAQWQKIDHKIYGEKKITGCIYYNEGEKLQTIVKDVAKEYFYINPLHFDLFPTANQMEGEVIYMVKNLYNGDDKSCGILSSGGTESIMIAMLAYREQGRINGIFEPEIVAPITAHVAFENAAFYYGMRMKWVPVDIKTGVVSPHDIKKAISKDTVCVIGSYPNYPYGTCDPIEQLAAIAKKKKVGFHTDCCLGGFVAPFAEKFGAMSEVFDFRVPGVTSISVDPHKYGLAPKGVSVVLFRDRKLRGGSFFSCTTWPGGIYSTPTHAGSRGHAPVAGAWVALQYTGYNGYMDKAGKIIEATRRVAKKISEIPELQVVGNPQLGSVAFVTKTNKLSIYDLVDKIGQRGWKLAALQLPPAVHLSITNYNIGQIEDFIASVKWGVTELLKAGPPKVQGELAQIYGSNAKLPESIMQDGAKVILEGLLKP

SEQ ID NO: 4805 - protein, 394 aa, Pharus lappulaceus
EPARTEDPALSIAGAVQSQKLAVRAISRLQALPGGDVKLLCDTAVEHVRELTGYDRVMVYRFHDDKHGEVVAESRRDDLEPYLGLHYPETDIPQASRFLFRQNRVRMIADCHAAPVRVIQDPALPQPLCLVGSTLRAPHGCHAQYMANMGSIASLVMAVIISSGGDDEHNVARGAISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEAQIKDIIEWLTLCHGDSTGLSTDSLADAGYPGAAALGDAVCGMAVAYITPSDYLFWFRSHTAKEIKWGGAKHHPEDKDDGQRMHPRSSFKAFLEVVKSRSLPWENAEMDAIH

SEQ ID NO: 4806 - protein, 388 aa, Phragmites australis
EDPALSIAGAVQSQKLAVRAISRLQALPGGDVKLLCDTVVEHVRELTGYDRVMVYRFHEDEHGEVVAESRRADLETYLGLHYPATDIPQASRFLFRQNRVRMIADCHATPVRVIQDPGLPQPLCLVGSTLRAPHGCHAQYMANMGSIASLVMAVIISSGGDDEQTARGSISSTMKLWGLVVCHHTSPRFIPFPLRYACEFLMQAFGLQLNMELQLAHQLSEKHILRTQTLLCDMLLRDSPTGIVTQSPSIIDLLKCDGAALYYHGKYYPLGVTPTEFQIKDIIEWWTVCHGDSTGLSTDSVADAGYLGASALGDAVCGMAVAYITSSDYLFWFRSHTAKEIKWGGAKHHPEDKDDGQRMHPRSSFKAFLEVVKSRSLPWENAEMDAIH

SEQ ID NO: 4807 - protein, 179 aa, Unknown
  Mortierella sp. M10
HRLWSHRSYNAGPAMSFVLALLGAGAVEGSIKWWSRGHRAHHRWTDTEKDPYSAHRGLFFSHLGWMLIKRPGWKIGHADVDDLNKNKLVQWQHKNYLALIFLMGVVFPTAVAGLGWGDWRGGYFYAAILRLVFVHHATFCVNSLAHWLGEGPFDDRHSPRDHFITAFMTLGEVYHNFHH

SEQ ID NO: 4808 - protein, 394 aa, Pseudosasa japonica
EPARTEDPALSIAGAVQSQKLAVRAISRLQALPGGDVKLLCDTVVEHVRELTGYDRVMVYRFHDDEHGEVVAESRRADLEPYLGLHYPATDIPQASRFLFGQNRVRMIADCRAAPVGVIQDPVLPQPLCLVGSTLRAPHGCHAQYMANMGSIASLVMAVIISSGGDDENNITRGGIPSAMKLWGLVVCHHTSPRCIPFPLRYACEFLMQAFGLQLNMELQLAHQLSEKHILRTQTLLCDMLLRDSPTGMVTQSPSIMDLVKCDGAALYYHGKYFLLDVTPTEAQIKDIIEWLTMCHGDSTGLSTDSLADAGYPGAAALGDAVYGMAVAYITPTDYLFWFRSHTAKEIKWGGAKHHPDDKDDGQRMHPRSSFKAFLEVVKSRSLPWENAEMDAIH

SEQ ID NO: 4809 - protein, 547 aa, Xylella fastidiosa
MAAKEIIFSEKARSRMVYGVNLLANAVKATLGPKGRNVVLDKNFGSPIITKDGVSVAKEIELADKFENMGAQMLKEVASKTNDHAGDGTTTATVLAQALIREGCKAVAAGMNPMDLKRGIDKAVIAAVTELKKISKPTSDDKAIAQVATISANSDESIGNIIAEAMKKVGKEGVITIEEGTTLENELDVVEGMQFDRGYSSPYFINNQQSQIVELDNPYILLHDKKISNVRDLLTVLDAVAKESKQLLIVAEEVEGEALATLVVNNIRGIIKVCAVKAPGFGDRRKAMLEDMAVLTGGTVISEEVGLSLEKATTSHLGKAKKVRVSKENTTIIDGMGDNDAINGRVKQIKTQIEETTSDYDREKLQERVAKLAGGVAVIKVGAATEVEMKEKKARVDDALLATRAAVEEGVIPGGGVALIRVITAISNLKGANEDQTHGIQIALRAMEAPLREIVANAGEEPSVILNKVKEGKGNFGYNAATGEFGDMVNFGILDPTKVTRSALQNAASIAGLMITTEAMIAEAPKKDEPTPPAAGGGMGGMGGMDF

SEQ ID NO: 4810 - protein, 693 aa, Aspergillus nidulans
MCGISAVLSLSEGSICPQALASQMNESLQLIKHRGPDARGQWLSSDYRVGLGHARLSVIDLNPAGNQPFHDPEGTVHAVVNGEIYDHKKYRAKLAHQYEFRSNSDCEIVTALYRHYGISFLNKLRGEFALVLWDAKRKLFLAARDRYGIKSLYYTVVNNRLLVATEIKSFLPFGWQPEWSIENLLRKGWLWDTEMYFKGVHRLEPGQYMVSQNYKFPVVKTYWDMDYPDKRTPFPQTEEQIVLELRKRMLESVRLRLRADVGVGFYLSGGLDSSAIAGMAKYLIQQGEPLGNDSSGDISKMSCYTIRFGEGSGVDESGIKDTFVPEVSDRRLTKSELYPVTLTEEDIASRFEDTVWYTETPIPDVNGMGRVAVGELAHSHGKKVILTGEGSDEHFGGYPDMLSKMFVEPDLSWHPPPFKMPNSSKVFEAGREAVPAAVESLASTKRMLNNSSIFARVDSFYMFPLASATVESEEPDPETAFAESLGAQTLSNISENWHPLNSASYQWTKSILANYILRYIGDGADMVYQIETRPPFLDHHVTEYANRIPPSLKIRYDPVKNDLREKYILREAMRPFITDEVMNRTKRAYLGPSNYREDGPLHRVVKSLLTEDNVNKLGFVDWDRLQEHIVKGFRDGDPRYFRSSLFVAQLVVLSQRFGVKVATTTDALPVTSEILDRTQNNDNMTTVQDRSRL

SEQ ID NO: 4811 - protein, 446 aa, Glycine max
MVIINLGKKKSEREGMRLGKYELGRTLGEGNFGKVKFARNTDSGQAFAVKIIEKNKIVDLNITNQIKREIATLKLLRHPNVVRLYEVLASKTKIYMVLEYVNGGELFDIIASKGKLTEGECRKLFQQLIDGVSYCHTKGVFHRDLKLENVLVDNKGNIKVTDFGLSALPQHLREDGLLHTTCGSPYYVAPEVLANKGYDGATSDTWSCGVILYVSLTGYLPFDDRNLVVLYQKIFKGDAQIPKWLSPGAQNMIRRILDPNPETRITMAGIKEDPWFKKGYIPANPEDEDVHVDNEAFSSHEEPNEAEQRNSGSPTLINAFQLIGMSSCLDLSGFFEKEDVSERKIRFASILSVKDLIDRIEDTVTEMEFRVEKKNGKLKVMRENKVHKTLGCLSVVVEVFEISPSLYVVELRKSYGDGSVYKQLCKKLLNDLGVPPKQGLVRSAAN

SEQ ID NO: 4812 - protein, 235 aa, Haemophilus ducreyi
MLKITAIPALQDNYIWAIQQGQEVMIVDPAQADPVFHFLAKNKLNLTTILITHYHQDHIGGIAGLQATYPDLTIYGSHEVAQYVNHIVQAGDHLHLLNSDVEVINSAGHTAQHISFLFAQQYLFCGDALFSAGCGRVFTGDYQAQFNTLQRFKTLPESTLVFPAHEYTLTNLKFAASVLPNNNDIREAQARAETLRAQQQPTLPSTIKQELRINPFLQADNLAEFITLRQQKDQY

SEQ ID NO: 4813 - protein, 511 aa, Kluyveromyces lactis
MGHPTNTADVRKDRVVTNSQGAPINEPFATQRVGQHGPLLLQDFNLLDSLAHFNRERIPERNPHAHGSGAFGYLEITDDITDVCGSAMFDTVGKRTRCLVRFSTVGGEKGSADTARDPRGFAIKFYSEEGNVDWVNNNTPVFFIRDPSKFPHFIHTQKRNPETNMKDADMFWDFLTTEENQVAIHQVMILFSDRGTPASYRNMNSYSGHTYKWSNKQGEWRYVQVHLKTDQGIKNLNNEEATKLAGENPDYCQKDLFENIAKGNYPSWTLYIQTMTEEEAEKLPFSVFDLTKVWPHKQFPLRRVGKMVLNENPENYFAQVEQAAFSPSHTVPYQEASADPVLQARLFSYPDAHRYRLGPNYSQIPVNCPYASKVFNPAIRDGPMNVNGNLGKEPNYLSTSKKYQFIQQSKPIQQHQEVWSGPAMPVHWATSPGDIDFVQARDLYNKVLSKQPGQQKALAHNVAVHVASACPEIQDRVFAMFARVDRGLSENIKKEALSLSPRKAAALNAKL

SEQ ID NO: 4814 - protein, 929 aa, Pseudomonas syringae
YRRTDTCCRRKSVLTKLGIKGRVLLLTILPASLMAAMLGGYFTWMQLSELQSQLLQRGEMIAQDLAPLAANALGRKDKVLLSRIATQTLEQTDVRAVSFLDTDRTVLAHAGPTMISPSPIGSGSQLLSSTGTDATRYLLPVFGSQRHLTSPIIPAEADTLLGWVELEISHNGTLLRGYRSLFASLLLILTGLAFTATLAVRMSRTINGPMSQIKQAVSQLKDGNLETRLPPLGSRELDELASGINRMAATLQNAQEELQLSIDQATEDVRQNLETIEIQNIELDLARKEALEASRIKSEFLANMSHEIRTPLNGILGFTHLLQKSELTPRQFDYLGTIEKSADNLLSIINEILDFSKIEAGKLVLDNIPFNLRDLLQDTLTILAPAAHAKQLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNIPLGGLRAAVLEHHDLARQALEHQLEDCGLQTIVFNNLENLLNGVTAAHETPAAIDLAVLGVTALEISPERLRQHIWDLENLNCKVMVLCPTTEHALFQLAVHDVYTQLQAKPACTRKLQKALSELIAPRAVRADIGPPLSSRAPRVLCVDDNPANLLLVQTLLEDMGAEVVAVEGGYAAVNAVQQEAFDLVLMDVQMPGMDGRQATEAIRAWEAERNQSSLPIVALTAHAMANEKRSLLQSGMDDYLTKPISERQLAQVVLKWTGLALRNPAPERQNEALEVHVGPLVLDHEEGLRLAAGKADLAADMLAMLLASLDADREAIRVARANQDVHALIERIHRLHGATRYCGVPQLRSACQRAETLLKQNAPHTEEALNDLDKAIIRLEAEARVMA

SEQ ID NO: 4815 - protein, 452 aa, Amylomyces rouxii
MSNIATLTSTARTKTESMKPPLPKTKMPPLFDQPVTSKNWTKFVNWPQAILLCVTPLIALYGIFTTELTKKTLIWSWIYYFITGLGITAGYHRMWSHRAYRGTDLLRWFMSFAGAGAVEGSIYWWSRGHRAHHRWTDTDKDPYSAHRGFFFSHFGWMLVQRPKNRIGYADVADLKADHVVAFQHKYYPYFALGMGFIFPTLVAGLGWGDFRGGYFYAGVLRLCFVHHATFCVNSLAHYLGESTFDDHNTPRDSWVTALVTMGEGYHNFHHQFPQDYRNAIKFGQYDPTKWKIIVLSWFGLAYELKQFPTNEVTKGRLFMEEKRIQAQKAKLSYGTPLKDLPIYTWEEYQSLVLNDNKKWVLIEGVLYDVEEFMKEHPGGMKYLSTAVGKDMTTAFNGGIYNHSNGTRNLLTSLRVGVLRNGMQVMTEADATASLYDDSLEFDSKAALFNKSK

SEQ ID NO: 4816 - protein, 492 aa, Chlamydomonas reinhardtii
MDPAKIRPSSAYNTPYWTTNSGAPVWNNNNSMTVGTRGPILLEDYHLVEKLAQFDRERIPERVVHARGAAAKGFFEVTHDISALTAADFLPAPGVQTPVIVRFSTVVHERGSPETLRDPRGFAVKFYTREGNFDMVGNNMPVFFIRDGMKFPDMVHAFKPNPKSHIQEAWRIMDFLSHHPESCHMLTFLLDDAGIPLNYRHMPGFGVHTMKLINKAGRETYVKFHWVPKCGEKYLLDDEAVMVGRSNHSHATKDLFDAIAAGDYPEWALMVQTMDPADEDKFDFDPLDVTKTWPESLFPMQPVGRMVLNRNVDNFFNENEQVAFCPAIIVPGIGYSDDKLLQTRIFSYADTQRHRLVPNYLLLPVNAPRAPHHNNHHEGFMNFMHRDEEINYFPSRFDPVRNAEGWLPCRVPLSGRREKMVIAKENNFMQAGARWRAFDAARQERFVVRVADMLADPRCTQEIRRIWVGYWSQADPQLGAGIAAKLQGRGCL

SEQ ID NO: 4817 - protein, 731 aa, Corynebacterium efficiens
MTPASANDLLIPEEDLNRLRHCHHHNPHGFYGWHATDDGSVIRTRQIGAEKVELVLGDTQIVMNPIGDDIFAIKLGNREAFDYRLRVTWPGQDPVVTADPYIFLPTLGEMDTYLISEGRHERLWDVLGANVKTYETTLGQVRGTAFAVWAPNAIGVAVIGGFNGWNASQHAMRSLGGSGIWELFIPNIGPGEVYKFAIQTREGHRRDKADPMARLAELPPATGSIVVESDYQWQDSEWMDKRAEIDTATTPMSVYEVHLGSWRWGRSYAELATELVDYVADLGYTHVEFMPVAEHPFGGSWGYQVSGYYAPTSRWGSPDELRKLIDAFHARGIGVIIDWVPAHFPKDDWALARFDGQALYEHPDWRRGEQKDWGTYVFNFGRSEVRNFLVANALYWLEEFHVDGLRVDAVASMLYLDYSREHGEWEPNVYGGRENLEAVQFLQEMNATVQRVHPGALTIAEESTSWPGVTAPTWDGGLGFSLKWNMGWMNDTLEYFSKDPIHRSFHHNELTFSLVYAFSERFVLPISHDEVVHGKGSLWNRMPGDTWNKAAGMRTLLAYMWAHPGKKLLFMGQEIGQRDEWSEAHELPWGVVEGWQGEYHEGISDLVRELNSTYKEVTALHQRDFSGEGFTWNKADDASNNILVFTRHGDDGSQALCVFNLSGTSQPEYQIGVSGGGSWRLVLNTDDEQYHGANNPLPETIEAEKIDRDGFPYTTTLHSPAMSAQFYVWEG

SEQ ID NO: 4818 - protein, 540 aa, Burkholderia fungorum
MSAKDVKFHDSARSRIVKGVNVLADAVKVTLGPKGRNVLIERSFGAPTITKDGVSVAKEIELKDRFENMGAQVVKQVASKTADVAGDGTTTATVLAQSIVQEGMKHVAAGMNPMDLKRGIDKAVAAVLDELHRLSKPIKTSREIAQVGAISANADEAIGKIIADAMDKVGKEGVITVEDGKSLENELEVVEGMQFDRGYLSPYFINDPDKQVAHLDDPLILLHDKKISSIRDLLPVLEAAAKAGKPLLIIAEDVEGEALTTLVVNSMRGVLKVAAVKAPGFGDRRKALLEDIAILTGATVISEETGKQLEKATLEELGRAKRVEVQKENTIIIDGAGDQTRIDARVKAIRAQIEEATSDYDREKLQERVAKLAGGVAVIKVGAATEVEMKEKKDRVDDALHATRAAVEEGIVPGGGVALLRARSAISSLTGANADQDAGIRIVLRALEAPLRVIAANAGDEPSVVVAKVLSGKGNYGYNAATGEYGDLVETGVVDPTKVTRTALQNAASIAGLILTTDATVAEAPKEEKAVPAPAPELEY

SEQ ID NO: 4819 - protein, 360 aa, Pseudomonas syringae
MPTLFDPLTLGDLQSPNRVLMAPLTRGRATREHVPTELMIEYYTQRASAGLIITEATGITQEGLGWPYAPGIWSDEQVEAWKPVTQAVHEAGGRIILQLWHMGRTVHSSFLGGAKPVSSSATRAPGQAHTYEGKQDYDEARPLSADEIPRLLNDYEHAAKNAMAAGFDGVQIHAANGYLIDQFLRDNSNVRGDAYGGSIENRIRLLVEVTRRVAETVGAEKTGVRLSPNGDSQGVNDSNPEPLFSAAAKALDEIGIAHLELREPGYEGTFGKADRPPVHPVIRQAFSRTLILNSDYTLETAQAALATGEADAITFGRPFLANPDLPHRFAERLPLNKDVMETWYSQGPEGYVDYPTADQK

SEQ ID NO: 4820 - protein, 471 aa, Lycopersicon esculentum
MKLLSDMASCNSHGQDSSYFLGWQEYEKNPYDEIQNPKGIIQMGLAENQLSFDLLESWLAQNPDAAGFKRNGESIFRELALFQDYHGLPDFKNALVQFMSEIRGNKVTFNPNKLVLTAGATSANETLMFCLANPGDAFLLPTPYYPGFDRDLKWRTGAEIVPIQCTSSNGFRITQSALEESYKLAKTRNLRVKGILVTNPSNPLGTTLTRNELELLVSFVAEKGIHLISDEIYSGTVFNSPKFVSVMEVLIENNYMYTEVWDRVHIVYSLSKDLGLPGFRIGAIYSNDAVIVSAATKMSSFGLISSQTQYLLSAMLTDKKFTKKYISENQKRLKKRHAMLVKGLESSGISCLESNAGLFCWVDMRHLLKTNTFEAEIELWKKIVYEVRLNISPGSSCHCTEPGWFRACFANMSEDTLNLAIQRIKSFVDSSDVIGINVDQSNQTNQNTSTSPKKKLFAKWGFRLSFNDRER

SEQ ID NO: 4821 - protein, 219 aa, Lilium longiflorum
VEQFSPVPYLATLLNCMLWVVYGLPLVHPHSTLVLTINGLGLIIELTYVLLFLLYSNGRARIRVLAMLLTEIVFVGLITVIVLSTAHTLVTRSLIIGVLCVFFGTMMYAAPLSVMKLVIQTKSVEYMPLFLSVASFLNGICWTTYALIRFDLFITIPNALGTMFAVAQLILHAMYYKSTKIQMEAQKRKLEMGFEEVMAPVENTEKIRGASQTGKYPPV

SEQ ID NO: 4822 - protein, 392 aa, Asarum canadense
DLEPVNPSDVPVTAAGALKSYKLAAKAISKLQSLPSGNISLLCDVVVREVSDLTGYDRVMAYKFHEDEHGEVIAECKISDLEPYHGLHFPATDIPQASRFLFMKNKVRMICDCSAPPVKVIQDKRLAQPISLGGSTLRAPHGCHAQYMANMGSIASLVLSVTISEDDDETCDKQKGRKLWGLVVCHHTSPRFIPFPLRYACEFLIQVFGIQLNKEVELAAQMRETHILRTQIMLCDMLLRDAPMTIVTQSPNVMDLVRCDGAALYYRKESWLLGVTPTKAQIQDLAEWLLKYHNGTTGLSTDSLVEAGYPRAHNLGDMVCGMAAVRITSQDFLFWFRSHTGKEVKWGGAKHDPADKDDDRGKMHPRSSFKAFMEVMKRRSLPWEDMEMDAIQ

SEQ ID NO: 4823 - protein, 252 aa, Vibrio vulnificus
MLEIKSIPAFNDNYIWLIQNSDQRCAVVDPGDAKPVLHYIEQHQLTLEAILITHHHNDHIGGVADLVRAFPNVNVVGPKAEPIPTLTHPVEDGDRLELFDETFLVLGLGGHTLGHIGYVGDGKLFCGDVLFSAGCGRIFEGTAQQMFDSLNKLLALPEETEVFCAHEYTASNVAFALAVEPDNELLHQYRDTVNRLRAQNLPTIPTTLRQEKWINPFLRYLQPSVIHSVSSRTKNSDPLSVFTALREWKNEF

SEQ ID NO: 4824 - protein, 255 aa, Bradyrhizobium japonicum
MAAEIRTFSCLNDNFGYLIHDVETKATASIDAPEAGPILKALEREGWQLTDILITHHHGDHVGGVAELKHKYNCRVVAPHDKTTAIANVDLRVANADVVKVGNLLARVVETPGHTLDHISYVFDTEKTVFAADTLFSIGCGRVFEGTYPMMWDSLLKLRALPDDFKLYCGHEYTASNVKFALTVDPDNAALQARAAEVAKLRAENKPTIPSLLGDEKRANVFLRADDPSVAARLHMKGADAAAVFGELRERKNKS

SEQ ID NO: 4825 - protein, 481 aa, Halobacterium salinarum
MQLFWHRRDLRTTDNRGLAAAAPGVTAVDGGHDQGPVAAVFCFDDEVLAHAAPPRVAFMLDALAALRERYRDLGSDLIVRHGDPAAVLPAVANDLDATRVVWNHDYSGLATDRDAGVRDALDAAGVAHAQFHDAVHHRPGEIRTNAGDPYSVYTYFWRKWQDREKNPPAPEPEPADLAADTALADTSPLPSVQELGFAEPEAAVPDAGTAAARSLLDAFRESGDIYRYEDRRDYPHEEPTSRLSPHLKFGTIGIRTVYEAARAAKSDADTDDERENVAAFIGQLAWREFYAQVLYFNQNVVSENFKAYEHPIEWRDDPAALQAWKDGETGYPIVDAGMRQLRAEAYMHNRVRMIVAAFLTKDLLVDWRAGYDWFREKLADHDTANDNGGWQWAASTGTDAQPYFRVFNPMTQGERYDPDADYITEFVPELRDVPADAIHSWHELSLSERRRHAPEYPDPIVDHSQRREDAIAMFERARGDE

SEQ ID NO: 4826 - protein, 509 aa, Unknown
  Halomonas sp. SK1
MSDDTKKCPVTHMTTDFGAPVVTNRDSLTAGPRGPLLAQDVWLNEKLAGFVREVIPERRMHAKGSGAFGTFTVTHDITKYTRAKIFSEVGKKTEMFARFTTVAGERGAADAERDIRGFALKFYTEEGNWDMVGNNTPVFFIRDPRQFPDLNKAVKRDPRTNLRTATNNWDYWTLLPEALHQVTVVMSDRGIPASYRHMHGYSSHTYSLWNQAGERFWVKMHFRTQQGIKNLTDAEAGELVAQDRESHQRDLYEAIERGEYPKWTMFIQVMPEADAEKYALHPFDLTKVWYKGDYPLIEVGEFELNKNSENFFADVEQVAFSPSNLVPGIGVSPDRMLQRRLFNYADAQRYRLGVNYHQIPVNQARCPVHSNHRDGQGRVDGNYGALPHYEPNSFGQWQGQPQFSEPPLKLTGNAAHWSYDKDDHNYFEQPGKLFRLMNDGQKEALFGNTGRAMGDAPEFIKFRHIRNCHAADPAYGAGVAKALGINLEKALASKKDDPMYGNPLVALPA

SEQ ID NO: 4827 - protein, 565 aa, Sorghum bicolor
MALLLASAINHTAHPAGLRSHPNNESFSRHHLCSSPQNISKRRSNLSFRPRAQTISSESAGIHRLSPWEIPRRDWFPPSFLFGAATSAYQIEGAWNEDGKGPSTWDHFCHNFPEWIVDRSNGDVAADSYHMYAEDVRLLKEMGMDAYRFSISWPRILPKGTLAGGINEKGVEYYNKLIDLLLENGIEPYITIFHWDTPQALVDAYGGFLDEEDYKDYTDFAKVCFEKFGKTVKNWLTFNEPETFCSVSYGTGVLAPGRCSPGVSCAVPTGNSLSEPYIVAHNLLRAHAETVDIYNKYHKGADGRIGLALNVFGRVPYTNTFLDQQAQERSMDKCLGWFLEPVVRGDYPFSMRVSARDRVPYFKEKEQEKLVGSYDMIGINYYTSTFSKHIDLSPNNSPVLNTDDAYASQETKGPDGNAIGPPTGNAWINMYPKGLHDILMTMKNKYGNPPMYITENGMGDIDKGDLPKPVALEDHTRLDYIQRHLSVLKQSIDLGADVRGYFAWSLLDNFEWSSGYTERFGIVYVDRENGCERTMKRSARWLQEFNGAAKKVENNKILTPAGQLN

SEQ ID NO: 4828 - protein, 508 aa, Oryza sativa; identical to SEQ ID NO: 102

SEQ ID NO: 4829 - protein, 392 aa, Buxus sempervirens
DLEPVNPLDPPVTATGALKSYKLAAKAISRLQSLPNGNISLLCDVLVREVSELTGYDRVMVYKFHEDEHGEVVAETHRTNLEPYLGLHFPATDIPQASRFLFMKNKVRMICDCLAPPVRVVQDKRLERPLSLCSSTLRAPHGCHAQYMKNMGSIASLVMSVTINEDDDEMDSDQQKGRKLWGLVVCHHTSPRFVPFPLRYACEFLIQVFSIQLNKEVELAAQVREKHILRNQSMLCGMLLRESPVGIITQSPNVMDLVKCDGAALYYKDKFWLLGVTPTEAQISDIAGWLLEYHNGSTGLSADSLLEAGYPGASVLGDAVCGMAAIKLTSKDFLFWFRSRTGKEIKWGGAKHEPFDKDEGRKMHPRSSFKAFLEVVKWRSLPWEDIEMDAIQ

SEQ ID NO: 4830 - protein, 190 aa, Tmesipteris tannensis
DQHGEVVAEIRRSDLDPYLGLHYPATDIPQASRFLFMKNRVRMICDCCAPAVRIIQDKELKQPLSLAGSTLRAPHGCHAYYMRNMGSIGSLVMAVIVNDNDAEASSSGHQPKNRKLWGMVVCHHTTPRAVPFSLRSACEFLMQVFGLQLNMEIELGAQMREKHILCTQTPLCDMLLRDAPIGIVSQSPNI

SEQ ID NO: 4831 - protein, 394 aa, Carludovica palmata
ELEPVNPADVPVSAAGALKSYKLAAKAISRLQSMPSGNTSLLCDVLVKEVSELTGYDRVMAYKFHEDQSGEVISECRRPELEPYLGLHYPATDIPQASRFLFMKNKVRMICDCSAPPVKVIQDKRLAQPLSLCGSTLRAPHGCHAQYMANMGSIASLVMSVTINEDDDETGRDQQQKGRKLWGLVVCHHTSPRFVPFPLRYACEFLMQVFGIQLNKEVELAAQAKAKHILRTQTLLCDMLLRDAPIGIFTRSPNVMDLVKCDGAALFYRNQFWLLGTTPTEAQIRDIVAWLQEYHDGTTGLSTDSLAEAGYPGASELGDAVCGMAAINVTNKDFILWFRSHMAKEIKWGGAKRDSFNRNDEGRQMHPRSSFKAFLEVVKRRSLPWEDMEMDAIQ

SEQ ID NO: 4832 - protein, 929 aa, Pseudomonas syringae
MRWLRIAIASTVGLLTLLFMLSAQAEHGAGWSTLLDEKARLSLDEIRSARYQNQFSPIELERVAAAERDSAVWLHYRLHPNQHEQLVRIFAPDLASADMYVMDGDQQIDHLRTGNAVPTEDQRLPSNDFLLPIPQSAASLDIYLRLVSSQKMRPSITLEPAIQSAADETEPFLFGLLFGALAMLIVQNLTRYAHTRSRSNLWLAACESMLGLSALLLLNLLRPIDPWHIAQTPSAHVALLLAAVAGLIYTYCFFVHRNARTLDRLLLGNAVLMGIGALLVVFDATLPINALTFVLVSLTTLSILAVSMWHWQKGYRSARLFVLGMITFNIGYMVVLPGLLWLSLVPPQWLILALLCVFCISGLLMSLALSERYRSITEDRFSVSRDQAASTAEINAKAEFLAKISHEIRTPMNGVLGMTELLLGTPLSVKQRDYVQTIHSAGNELLTLINEILDITKLESGQIELDDVQFDISALVEDCLNIFRAKAEQQQVELISQIQPQVPRVISGDPTRLRQTLLSLLENALKKTDEGEILLGVALESSKSGQPRLRISVQDSGESLSDEERDELLHAELHSRNFLASSRLGGHLGLVIARQLIILMDGEFGIQNSGTPGNTLWLNLPLDAKLLEQPTIDLDSPLKDARVLVVDDNDTCRKVLVQQCSAWGLNVSAVASGKEALALLRTKAHLRDYFDVVLLDQNMPGMTGMQLAAKIKEDPSLNHDILLIMLTGISNAPTKIIARNCGIKRILAKPVAGYTLKTTLADELTQLNKGVVLAKPGPAMPPPVSVPGDFRILVAEDNSISTKVIRGMLGKLNLNPDTASNGEEALRAMKAQRYDLVLMDCEMPILDGFSATEQLRAWEVGNQRVRTPVVALTAHILTEHKDRARQAGMDGHMAKPIELSQLRELVEHWVAHRDKARGLTADGEHYRQN

SEQ ID NO: 4833 - protein, 191 aa, Vittaria lineata
DEHGEVVAEIRKSDLEPYLGLHYPATDIPQASRFLFMKNRVRMICDCRADAVKVTQDREVRQPLSLAASTLRAPHGCHSQYMANMGSAASLVMAVAVNSNEEDTSSSKPHQLKPRKLWGLVVCHHTSPRAVAFPLRSACEFLVQVFGLQLNMEVELAVQMREKHILRTQTLLCDMLLRDAPIGVVSESPNI

SEQ ID NO: 4834 - protein, 460 aa, Euptelea polyandra
SGKPFYAIIHRIDVGLVIDLEPVSPAEVPVAAAGILKSYKLSAKAISRLQSLPSGNISLLCDVLVQEVSDLTGYDRVMVYKFHEDEHGEVVAECLRSNLEPYLGFHYPATDIPQASRFLFMRNKVRMICDCSARPVKVIQDKSLAQPLSLCGSTLRAPHGCHAQYMANMGSIASLVMSVTIDENDDEIQTDQQKGRVLWGLVVCHHTSPRFVPYPLRHACEFLIQVFGIQLNKEVELATQLREKHILQTQTVLCDMLLRDAPVGIVTQSPNVMDLVRCDGAALYYKNQFWLLGLTPTEAQIRDIAGWILEHHDGSTGVSIDSLMEAGYPGSSVLGDVVSGMAAIKITSKDFLFWFRSHTAKEIKWGGAKHDHVDKDDGRKMHPRSSFKAFLEVVKRRCLPWEDVEMDAIHSLQLILRGSLKDETVNDSKTIVNALMVDARIQGVDELCNVTNEMVRLMEK

SEQ ID NO: 4835 - protein, 395 aa, Joinvillea ascendens
DLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICECSAPPVKVVQDDRLAQPLSLCGSTLRAPHGCHAQYMANMGSIASLVMSVTINEDDDDDTGSEQQQKGRKLWGLVVCHHTSPRFVPFPLRYACEFLLQVFGIQLNKEVELAAQAKERHILCTQTLLCDMLLRDAPVGIFNQSPNVMDLVKCDGAALYYQNHFWLLGSTPSEAQIKNIAEWLLEYHDGSTGLSTDSLTEAGYPGAAALGEVVCGMAAIKISSKDFIFWFRSHTAKEITWGGAKHEPVDRDDGGRKMHPRSSFKAFLEVVRWRSVPWEDIEMDAIQ

SEQ ID NO: 4836 - protein, 110 aa, Zea mays
MAEVHNERPVGMVGGVRDAPVGRENDLEAIELARFAVAEHNSKTNAMLEFERLVKVRHQVVAGTLHHFTVEVKEAGGGEKKLYEAKVWEKAWENFKQLQSFELVGDAAVA

SEQ ID NO: 4837 - protein, 392 aa, Knema latericia
DLEPVNPSDVPITAAGALKSYKLAAKAISRLQSLPSGNISLLCDVLIREVSELTGYDRVMAYKFHEDDHGEVIAECRRSDLEPYLGLHYPATDIPQASRFLFMKNKVRMICDCFAQPVKVIQDERLEQPLSLCGSTLRAPHGCHAQYMANMGSIASLAMSVTINEDGDDASGQQQQRGKKLWGLVVCHHTSSRFVPFPLRYACEFLIQVFGIQLNKEVELAAQRREKHILQTQTVLCDMLLRDTPVGIVTQSPNVMDLVKCNGAALYYRNQFWLLGTTPTETQIRDIAGWLLEYHDATTGLSTDSLTEAGYPGAPDLGDDVCGMAAIKITSKDFLFWFRSHTAKEIKWGGAKHDPVDKDDDGRKMHPRSSFKAFLEVVKQRSLPWEDVEMDA

SEQ ID NO: 4838 - protein, 481 aa, Pseudomonas fluorescens
MQLIWLRSDLRLHDNTALSAAAQRGAAVAVYLLSPEQWLAHDDAPCKIDFWLRNLQSLSTALGRLNIPLLIRSAATWEQAPQVLLELCRQLQVQMLHFNQEYGIHESRRDAAVTRALQHAGISVQGHLDQLLFQPGSVLTKSGGYFQVFSQFRKVCYSRLHTALPALVKAPGAQLPLSINADPLPQRVEGFPSPTQALRELWPAGDDEAQRRLEKFSDEQIHYYQSERDFPAKPGTSQLSPYLAAGVISPRQCLHAALRGNQGEFESGSPGAVTWINELLWREFYKHILVGYPRVSRHRAFRPETEAVKWRHAPEELAAWQEARTGLPIIDAAMRQLLETGWMHNRLRMVVAMFLTKNLLIDWREGERFFMRHLIDGDLAANNGGWQWSSSTGTDSAPYFRIFNPISQSQKFDSEGRFIKHWLPQLAGLNKKDIHNPAAMGGLFGVPGYPAPIVDLSRSRERALAAFKALPARMDAGVSHE

SEQ ID NO: 4839 - protein, 156 aa, Desulfotalea psychrophila
MTIFPRSRRNIMSLVKWNPWREIEDVFDRNIKRVPSRLSDLGFATSEDWTPKVDISETDKEFIIKAELPEVKREDVKVTVDKGVLTICGERKQEREEEGKTFHRVERYYGSFTRSFTLPENVDESKVDASYKDGMLNLKIEKTEEAKPTSIEVEIK

SEQ ID NO: 4840 - protein, 458 aa, Streptomyces coelicolor
MATSVVLFTRDLRLHDHPPLRAALDRSDAVVPLFVRDRAVDAAGFAAPNRLALLADCLRDLDSGLRDRGGRLVVRSGDLVEEVCAVAGEAEADEVHLAADVSAHAHRREELLRSALSARGCRLHVHDAVTTVLAPGSVTPASSDHFAVFTPYFRRWSERAVREPLAAPRRVRVPDGVGSEPLPARGDLTGLSPGLPTGGERDARKRLTAWLRGGIADYADHHDDLAGDATSRLSPDLHLGALSPVELVHRARRAGGPGAEAFVRQLAWRDFHHQVLAARPHASAADYRTRHDRWRTGAAAEADAAAWRDGRTGYPVVDAAMRQLRHEGWMHNRGRLLVASFLTKTLYVDWRVGAWHFLELLVDGDVANNQLNWQWAAGTGTDTRPHRVLNPTTQARRFDPGGTYVRRWVPELAGLAGRSVHEPWRLARAARAAYDAYPDPIVDLSEGLDRFRRARGRD

SEQ ID NO: 4841 - protein, 462 aa, Mesembryanthemum crystallinum
MGEQELLLQQQIKEDRNVSRETEMKHPALQGKYELGRVLGQGTFARVYHARNLVTGNSLAIKVVAKDKVIKVGMMEQMKREISVMKRVKHPNIVQLHEVMASKSKIYLAMDLVRGGELFSKVSKGGKLDEDVARSYFKQLISAVDFCHSRGVYHRDLKPENLLLDEHGNLKITDFGLSASFENEDHHQTLLRTSCGTPHYVAPEVISRKGQQGYHGAKSDIWSCGIILFVLLAGFLPFHDDNIIRMYRKVFKGDFTCPSWLSSQARDLITRLLDINPATRITVSEIMQSDWYCMDTSSMTAVTTDEFDLDHNNNNNNNSNYNNIHHHKKEPEMLNAFHIISLSQGFDLSPLFEEKHREERQDMRFATTKSASTVVSRLEEVAAKAGKFIVKKFCGDSVVRLQGQERGRKGKLAIAAEIMSVSPSLLVVEVKKDNGDTLEYNQFCTKQLRPALKDIVWTCPSS

SEQ ID NO: 4842 - protein, 344 aa, Magnaporthe grisea
MADSNNGPETEKVNTNIVTLTRFLTEEQAKHKEATGDFTLLCHALQFSFKAIAYYIRRATLVNLTGLAGSSNTTGDDQKKLDVIGNDLFIEAMRSSGKCALLVSEEEEEIIFFTNGNGSARYAVACDPIDGSSNLDAGVSVGTIFGIHKLAEGSTGSKEDILKPGSELLAAGFTMYGASAQLVLTMKNGGVNGFTLDNAFGEFILTHPDMRMPKSRAIYSVNEGNSLYWEDHVKEYFSSLKHPQEKSGKPYSARYIGSMVADAYRTLLYGGIFAYPADKKSPKGKLRILYECAPMAMVFENAGGQAIDSNMKRMLDVVPEHIHDRSGIFMGSWDEVEKVKAYHK

SEQ ID NO: 4843 - protein, 452 aa, Arabidopsis thaliana
MNRPKVQRRVGKYEVGKTLGQGTFAKVRCAVNTETGERVALKILDKEKVLKHKMAEQIRREICTMKLINHPNVVRLYEVLASKTKIYIVLEFGTGGELFDKIVHDGRLKEENARKYFQQLINAVDYCHSRGVYHRDLKPENLLLDAQGNLKVSDFGLSALSRQVRGDGLLHTACGTPNYAAPEVLNDQGYDGATADLWSCGVILFVLLAGYLPFEDSNLMTLYKKIIAGEYHCPPWLSPGAKNLIVRILDPNPMTRITIPEVLGDAWFKKNYKPAVFEEKEEANLDDVDAVFKDSEEHHVTEKKEEQPTSMNAFELISMSRALDLGNLFEEEESIPFNLQGFKRETRFAAKGAANDLVQKIEEASKPLGFDIQKKNYKRYLCTQMRLENVTAGRKGNLRVATEIFQVSPSLHMIEVRKTKGDTLEFHKFYKKLSTSLNDVVWKSGESSGLSK

SEQ ID NO: 4844 - protein, 490 aa, Nicotiana attenuata
MGFENEKNNSILSKLATNEEHGENSPYFDGWKAYDNDPFHPLKNPNGVIQMGLAENQLCFDLIEEWIKRNPNASICTTEGIKSFRAIANFQDYHGLPEFRRAIAKFMEKTRGERVTFDPERVVMAGGATGANETIIFCLADAGDAFLVPSPYYPAFNRDLRWRTGVQLIPIPCDSSNNFQITTKAVNEAYENAQKSNIKVKGLILTNPSNPLGTTLDRDTLKNFLTFTNQHNIHLVCDEIYAATVFNTPQFVSIAEILNDEMSHCNKDLVHIVYSLSKDMGLPGFRVGIVYSFNDAVVNCARKMSSFGLVSTQTQYLLAEMLSDEKFVSNFLAESSKRLAKRHKHFTNGLEEVGIKCLRSNAGLFCWMDLRPLLKQSNFDAEMSLWKVIINDVKLNVSPGSSFDCQEPGFFRVCFANMDDETVDIALARIRRFVGVKESGDETTAMEKKQQWKKNNLRLSFPKRMYDESVNNLSPLSSPIPHSPLVRARN

SEQ ID NO: 4845 - protein, 258 aa, Unknown
  Exiguobacterium sp. 255-15
MTKKSIQDYAFFGNIKKVKTCIARGDDLNTLDEEGSSALHWAVEEGYDEIVTLLLDHGADINQRDKDGLTPLHLALYEKQGEIAIQLIDRGAALDFDGDGFTALHFIAACSGNKRVLRRLLEDRTRVDWQTDSGEGHTPLHYAAQEGKTKKIRMLAEAGADVNRMGMNGFAPLHLAAGEGHVKAVEALLAAGADMEIENPLNENNTPLMLASQYGLTEITKLLLENGADRQHPDTEGRTALDFAVKHRYPEIVALLQT

SEQ ID NO: 4846 - protein, 483 aa, Nicotiana attenuata
MGFISNIENELLSKVATNNGHGENSAYFDGWKAYEIDPFHLTQNFDGVIQMGLAENQLCFDLIQEWVVNNPKASICTAEGSEDFKDIAIYQDYHGLPEFRSAVARFMEKVRGDRITFEAERIVMSGGATGAHELLAFCLADPAEAFLVPTPYYPGFDRDLRWRTGVQLFPVVCESSNNFKVTRTALETAYQKAQESNITVKGLLLNNPSNPLGTILDRETLKDTVRFINEKNIHLVCDEIYAATIFNKPDFISISEVILDEDVECDRDLIHIVYSLSKDLGFPGFRVGIIYSYNDVVTNCARKMSSFGLVSTQTQFLISNMLSDEKFVTKFIGESSERLAKRHDMFTKGLAQVGINTLKSNAGLFIWMDLRRLLKELTFESELELWRIIINEVKLNVSPGCSFHCSEPGWFRVCFANMDDETMRVALRRINNFVIQRKGIEGGVKKLQCRRSKLEISLSFRKLDDFINSPHSPMSSPLVQART

SEQ ID NO: 4847 - protein, 484 aa, Nicotiana attenuata
MVFISGNVQKQQLLSKIATNDGHGENSAYFDGWKAYENDPFHLTNNPNGVIQMGLAENQLCFDLIQEWVVNNPKASICTTEGAEDFRDIAIFQDYHGLPEFRQAVARFMEKVRGDKVTFDPNRIVMSGGATGAHETLAFCLANPGDAFLVPTPYYPGFDRDLRWRTGVQLFPVVCDSSNDFKVTKKALESAYEKAQESNINIKGLLINNPSNPLGTILDSDTLKDIVTFINSKNIHLICDEIYAATVFDQPKFISVSEIVEEHVGCNKDLIHIVYSLSKDLGFPGFRVGIVYSYNDTVVNIARKMSSFGLVSTQTQHLIASMLSDETFIEKFIAESSERLGKRHEMFTKGLAQVGISTLKSNAGLFFWMDLRRLLKELTFESELELWRIIINEVKLNVSPGCSFHCSEPGWFRVCFANMDDETMRIALRRIRNFVLQTKGLNSKSAVKKQCSRSKLQISLSFRRMDDFMNSPVHSPMNSPLVRT

SEQ ID NO: 4848 - protein, 394 aa, Liriodendron tulipifera
DLEPVNPADVPVTAAGALKSYKLAAKAISRLQSLPSGNISLLCDVLVREVSELTGYDRVMAYKFHEVEHGEVIAECRRSELEPYLGLHYPATDIPQASRFLFMKNKVRMICDCLALPVRVIQDKKLAQPLSLCGSTLRAPHGCHSQYMASMGSIASLVMSVTINEDDDDTSSEQQQKGRKLWGLVVCHHTSPRFVPFPLRYACEFLVQVFGIQLNKEVELAAQMRERHILRMQTVLCDMLLRDAPVGIITQSPNVMDLVKCDGAALYYRNQFWLLGTTPMEAQIRDIAGWLLEYHDSTTGLSTDSLTEAGYPGAADLGDDVCGMAAIKITSKDFLFWFRSHTAKEIKWGGAKHDPVDKDDDGRKMHPRASFKAFLEVVKRRSLPWEDVEMDAIQ

SEQ ID NO: 4849 - protein, 485 aa, Nicotiana attenuata
  misc_feature (118)..(118): Xaa can be any naturally occurring amino acid
MVFISSNNQKQQLLSKIATNDGHGENSAYFDGWKAYENDPFHLSNNPNGVIQMGLAENQLCFDLIQEWVVNNPKASICTTEGAEDFKDIAIFQDYHGLPEFRQAVARFMERVRGDKVXFDPNRIVMSGGATGAHEMLAFCLADPGDAFLVPTPYYPGFDRDLRWRTGVQLFPVVCDSSNDFKVTREALESAYEKAQESNIKIKGLLINNPSNPLGTLLDRDTLKDIVSFVNSKNIHLVCDEIYAATVFNKPNFISISEILEENLGLCNQDLIHIVYSLSKDLGFPGFRVGIVYSYNDTVVNIARKMSSFGLVSTQTQHLIASMLSDEIFVEKFIVESSERLGIRQGMFSKGLAQVGISTLKSNAGLFFWMDLRRLLKESTFEAELELWRIIINEVKLNVSPGCSFHCSEPGWFRVCFANMDDETMRIAIRRIRNFVLQTKGITNKVAAFKKQCSRSKLQISLSFRRLDDFNSPVHSPMNSPLVRT

SEQ ID NO: 4850 - protein, 396 aa, Meliosma squamulata
ELEPVNPDDVPVTAAGALKSYKLAAKAISRLQSLPSGNITLLCEVLVREVRDLTGYDRVMVYKFHEDEHGEVIAECRRSDLEPYLGLHYPATDIPQASRFLFMKNKIRMICDCSSQPVKIIQDKRLAQPLSLGGSTLRAPHGCHAQYMANMGSIASLVMSVTINDDDDDDDDTSESDKKKGRKLWGFVVCHHTSPRFVPFPLRYACEFLSQVFGIQLNKEVELAAQLKEKHILKTQTMLCDMLLRDAPMGIITQSPNVMDLVKCNGATLYYNNKFWLLGITPTEEQIRDIIGWLFENHDQSTGLSTDSLVEAGYPGALFLGNAVCGMAAIKITSKDFLFWFRSHTAKEIKWGGAKHDPIDKDDGRKMHPRSSFRAFLEVVKWRSIPWEDIEMDAIQ

SEQ ID NO: 4851 - protein, 317 aa, Pichia guilliermondii
MSIKLNSGYDMPSVGFGCWKVDNATCADTIYNAIKVGYRLFDGAEDYGNEKEVGDGINRALDEGLVARDELFVVSKLWNSFHDPKNVEKALDKTLSDLKVDYLDLFLIHFPIAFKFVPFEEKYPPGFYCGDGDKFHYEDVPLIDTWRALEKLVEKGKIRSIGISNFSGALIQDLLRSAKIKPAVLQIEHHPYLQQPRLVEYVQSQGIAITAYSSFGPQSFVELDHPRVKDVKPLFEHDVIKSVAGKVKKTPAQVLLRWATQRGLAVIPKSNNPDRLLSNLKVNDFDLSQEDFQEISKLDIELRFNNPWDWDKIPTFI

SEQ ID NO: 4852 - protein, 318 aa, Unknown
  Mortierella sp. M10
HRAHHRWTDTEKDPYSAHRGLFFSHIGWMLIKRPGWKIGHADVDDLNKNKLVQWQHKHYLPLVLFMGVIFPTIVAGLGWGDWRGGYFYAAILRLVFVHHATFCVNSLAHWLGEGPFDDRHSPRDHLITAFMTLGEVYHNFHHQFPQDYRNAISLLPVRPHQSGSSPSAPFFGLASHLKTFPENEVRKGQLQMIEKKVLEKKTKLQWGTPIADLPVLSFEDYQHACKNDGKKWILLEGVVYDVAEFMNEHPGGEKYIKMGVGKDMTAAFNGGMYDHSNAARNLLSLMRVAIVEFGGEVEAQKKNPSVPVYGDDHHSKSE

SEQ ID NO: 4853 - protein, 155 aa, Lilium longiflorum
MGSKLTREEYDTLLAAFHKLTVRLEVASVPKDATPADIKNLPDAYLYFIDMPGVRTGEIKVEVEDDSALVIIGERKREEEEKYQMMERWTGKRMRKFELPENADTKAVSAVWKNGVLAVTVRKLPAWEVAGISFNIERLPVPLPTKTKSIEVKIA

SEQ ID NO: 4854 - protein, 389 aa, Platanus occidentalis
DLEPVNPDDVPVTAAGALKSYKLAAKAISKLQSLPSRNISLLCDVMVREVSDLTGYDRIMVYKSHEDEHGEVVAECRRPDLEPYLGLHYPATDIPQLSRFIFLKNKVRMICDCSAPPVKVVQDKKLAQPLSLGGSTLRAPHGCHAQYMANMGSIASLVMSVTINEDDDEGDQQNGRKLWGLVVCHHTSPRFVPFPLRYACEFLIQVFGIQLNKEVELAAQSREKHILRIQTMLCDMLLRDAPVGIVTQSPNVMDLVKCDGAALYYRNKFWLLGITPTEAQIKDIAGWFLEYHDQSTGLSTDSLMEAGYPGALVLGDAVCGMAAIKITSKDFLFWFRSHTAKEIKWGGAKHDPVDKDDGRKMNPRSSFKAFLEVVKRRSLPWEDVEMDAI

SEQ ID NO: 4855 - protein, 203 aa, Lilium longiflorum
QSSQSMESAMITLDLPVIAAYRQLMEIPGETSNSLGDPSQSYALDAPTLTYALDAPTRSYVLDAPTLSYAHDAPTLTYALGAPASTYALDAGAMASTAADVKDLPAAYVFVVDMPGVGSGDLKVKVEGDNVLLISGERKREEEGVYLCIERRVGKLTKMFVLPENANTEAVSAVCKDGVLTVTVEKRPPQEPKKPKVIEVKVA

SEQ ID NO: 4856 - protein, 393 aa, Sabia swinhoei
DLEPVNPDDVPVTAAGALKSYKLAAKAISRLQSLPSGNISLLCDVLVREVSDLTGYDRVMVYKFHEDEHGEVIAECRRSDLEPYLGLHYPATDIPQASRFLFMKNKVRMICDCSARPVKVVQDKRLARPLSLCGSTLRAPHGCHAQYMANMGSIASLVMSVTINEDDDDEMESDQKKGRKLWGFVVCHHTSPRFVPFPLRYACEFLIQVFGIQVNKESELAAQLREKHILQTQTMLCDMLLRDAPVGIVSQSPNVMDLVKCSGAALYYKNKFWLLGVTPTEEQIRDIIGWFVENHGQSTGLSTDSLMEAGYPGASVLGDAVCGMAAIKITSKDFLFWFRSHTAKEIKWGGAKHDPVDKDDGRKMHPRSSFKAFLEVVKRRSLPWEDIEMDAIQ

SEQ ID NO: 4857 - protein, 394 aa, Tofieldia calyculata
DLEPVNPADVPVTAAGALKSYKLAAKAISKLQSLPSGDISLLCDVLVREVSDLTGYDRVMVYKFHEDEHGEVLAEFKRSDLEPYLGLHYPATDIPQASRFLFMKNKVRMICDCAAIPVKVIQDERLAQCLSLCGSTLRAPHGCHAQYMANMGSIASLVMSVTISEDDNETDSDQQEKGRKLWGLVVCHHTNPRFVPFPLRYACEFLIQVFGIQLNKEVELAAQTREKHILQTQAVLCDMLLRDFPIGIFTQSPNVMDLVKCDGAALYYRNQFWLLGITPTEKQIRDIAGWLLEYHGCSTGLSTDSLLEAGYPGASVLGDAVCGMTASRINSKEFVFWFRSHTAKEIKWGGAKHDPVDKGDDGRKMHPRSSFEAFLEVVKRRSLPWEDVEMDAIQ

SEQ ID NO: 4858 - protein, 371 aa, Bifidobacterium longum
MSKADKKVSKDRPGLFAPMTLREVTVRNRIWLPPMCTYSSFARDGRPTPFHYQHYVSRAFGGFGMVIVESTAVAPEGRITPCDLGLWEDGQIDAWRWIVDGIREAGAVPAIQLNHAGRKASTGCFAVGYDGQSVPEEAGGWPTMAPSEIAFGGLRTPRALSVDEIHGLVGAFAAAAGRAVAAGFQAIQIHAAHGYLISQFLDPLSNERDDEYGGDLTGRSRFLVEVVDAVRGAVPEGVPVLVRISATDWAAGGWDLDQTIALSKVLKEHGVDVMDVSTGGIMSGVSIPVKPNYQVPFSEQVKAKADIPVTAVGLITKPKQAAKILAHGEADAVEIGRAALRDPYWPLRAANKLGIPSTEIPYAPQYVAGAY

SEQ ID NO: 4859 - protein, 737 aa, Psychrobacter arcticus
MMKKQPAQWLLSAASVGIAGLILTQSYGTAVADTNTEGFKQTPEQQVTTRQVAALLDRSHYLNQPLDTATGSEILSMYIDSLDPNHTLFLQSDVDEFKKKYADEFGVRLKRGDLSAGVEVFERYRKRSNEYFAMAKKMLKTDINLTSKDTIVLDREKLNHFKTKKEQRDYWTSQLKFQLMSITLGKEDEKAKEKVFLDNPDITRGQDLVRNDERTPSEILLNRLSRQQEQFTRLKDDEIMETILNTAMLTYDPHSNYYAPIQANELQIQSSLQLEGVGVSIRPDRKNPDYTRIVTLVDGGPAAKSGQIKPNDLIIGIAQDGKTMTDVVGWSTREIVSLIRGKRGTSVTIKVRQPNTPDASARNVTVVRDIIQQEESGVTQRVVEVQRPNIDKTPKRIGVLEIPSFYLNYRARRNGEDYRSVSIDTEKALKELNTKNIDGLVVDLRNNPGGSLDEVAKMLGFFIKSGPLVQIRDNRGNIQVYRDDDGGEQLYDGKVVVLTNLASASASEIFAAAIQDYGRGLVVGSTTTGKGSAQIQLDSLALGSATLTQRKFYRITGGSTQNKGVVPDVELVNIYDNATFGERAQKKALPWDTIKTAPYKPEGKFTSNTLATLNQQSKIRQQKNPQFVYLSTLNDIRNMEDEKKPVALDINKRRAKMQLIEKRSLEVENKRLIATGERPYANWNTYQAAMDAKFEERSQMKAGERPELPEDEAFINEAAYIMLSTEPKTLSSPEEKP

SEQ ID NO: 4860 - protein, 434 aa, Arabidopsis thaliana
  misc_feature (307)..(307): Xaa can be any naturally occurring amino acid
MSLKIKFLLLLVLYHHVDSASIVKFLPGFEGPLPFELETGYIGIGEDENVQFFYYFIKSENNPKEDPLLIWLNGGPGCSCLGGIIFENGPVGLKFEVFNGSAPSLFSTTYSWTKMANIIFLDQPVGSGFSYSKTPIDKTGDISEVKRTHEFLQKWLSRHPQYFSNPLYVVGDSYSGMIVPALVQEISQGNYICCEPPINLQGYMLGNPVTYMDFEQNFRIPYAYGMGLISDEIYEPMKRICNGNYYNVDPSNTQCLKLTEEYHKCTAKINIHHILTPDCDVTNVTSPDCYYYPYHLIECWANDESVXREALHIEKGSKGKWARCNRTIPYNHDIVSSIPYHMNNSISGYRSLIYSGDHDIAVPFLATQAWIRSLNYSPIHNWRPWMINNQIAGYTRAYSNKMTFATIKGGGHTAEYRPNETFIMFQRWISGQPL

SEQ ID NO: 4861 - protein, 215 aa, Aspergillus oryzae
MSSTSPSKEPEVEPEVQSGEEQEQMDKEQQDQAQNQGEFEVKEQDRWLPIANVARIMKLALPDNAKIAKEAKECMQECVSEFISFITSEASEKCQQEKRKTVNGEDILFAMTSLGFENYAEALKIYLSKYRETQSARGEHQNRPTSSGYASGGPVGGVSSAPGGRPATAGGFPDAADNTNSIMNPSLDPTEQDPSAYGYPPMVGQPHNGTAGDSY

SEQ ID NO: 4862 - protein, 372 aa, Candida albicans
MKKSTGPTQTRQVVFNISQNFKVLKILGEGAYGIVALAVHLPTETKVAIKKIEPFERPLFCLRTLREIKLLTKFKNHDNIVRLYDVQKPMNYDSFNEVYLIQEYMPSDLHNIIHTHLLSDQHVQYFIYQILKGLKMIHSARVIHRDLKPSNILVNEKCDLKICDFGLARLDTKHYNFDEAPRISMLTEYVATRWYRAPEIMLSASNYSTAIDLWSVGCILAELLTYRALFPGSDYINQLKLIFEVLGTPTDEDLQIIKSERAQKFIRSLPTKVKIDLSEFINNHPYRNIKHRGRDQVNPLAIDLLEKLLVFDPAKRITVQEALEHPYLNSYHEQLDEPVTSPIPIEEFDFDIDKKNLDTNDLKKQIFEIVMS

SEQ ID NO: 4863 - protein, 737 aa, Thiobacillus denitrificans
MRRRCAPGSRDAASRQSPLAARPCLAPLSAYKDESKRTFRKATMSQKKKPAKAGPDENFERGAGGEIHQTANGAHPPLTTNDGVPISDDQNSLRSHPRGPTLLEDFVLRDKITHFDHERIPERVVHARGSAAHGYFELTESLEKYTTARILTEVGEKTPVFTRLSTVAGGAGSVDTPRDVRGFAVKFYTKEGNWDLVGNNIPVFFIQDAIKFPDLVHSFKMEPDRGFPQSSTAHDTFWDYVSLTPESMHMILWIMSDRTTPRSLRMIEAFGVHSFRLVNAKGASTFVKFHWRPKLGLQSTIWDETVKIAGADPDFHRRDLFEAISEGNFPEWEFAVQLFTEADAERFPFDHLDATKLIPEELVPLKVIGRMVLDRWPDNFFAETEQVAYCPTHVVPGIDFSNDPLLQGRLFSYVDTQLLRFNSPNFHQVPVNMPKCPFANLQRDGHMQMERPKGRVNYEPNTLGTDTPRETPQGFRSAAVTESGEKGRIRAERFADHYSQARQFYVSQTEYEQAHIASTLVFELAKVDHVHIREAMVGHLRHVDEDLAHRVAKGLGIDPLPPAPEAAAPVQDLPPSPALQIIGNMKDTLEGRMVGILVGDGSDGARVEALRRAATDAGAAVKIIAAHVGQVKLANGKMLKVDKQLAGTPSVLFDAVAVVVSEDAAKMLLKESAALDFVHDAFGHLKAIASDAGGQALLDAVHVVRDAGVVDAADVGAFIAAAKTRQWDREPSVRLLA

SEQ ID NO: 4864 - protein, 497 aa, Arabidopsis thaliana
  misc_feature (313)..(313): Xaa can be any naturally occurring amino acid
MGLPGKNKGAVLSKIATNNQHGENSEYFDGWKAYDKDPFHLSRNPHGIIQMGLAENQLCLDLIKDWVKENPEASICTLEGIHQFSDIANFQDYHGLKKFRQAIAHFMGKARGGRVTFDPERVVMSGGATGANETIMFCLADPGDVFLIPSPYYAAFDRDLRWRTGVEIIPVPCSSSDNFKLTVDAAEWAYKKAQESNKKVKGLILTNPSNPLGTMLDKDTLTNLVRFVTRKNIHLVVDEIYAATVFAGGDFVSVAEVVNDVDISEVNVDLIHIVYSLSKDMGLPGFRVGIVYSFNDSVVSCARKMSSFGLVSXSQTQLMLASMLSDDQFVDNFLMESSRRLGIRHKVFTTGIKKADIACLTSNAGLFAWMDLRHLLRDRNSFESEIELWHIIIDRVKLNVSPGSSFRCTEPGWFRICFANMDDDTLHVALGRIQDFVSKNKNKIVEKASENDQVIQNKSAKKLKWTQTNLRLSFRRLYEDGLSSPGIMSPHSPLLRA

SEQ ID NO: 4865 - protein, 854 aa, Arabidopsis thaliana
MSEPKVRRWVGKYEVGRLIGECNFGKLRSAVDTETGDPVALMILDKDKVLKHKMAEQRDSQIDPSSVQKYDVGLSRLLLQIKREISIMKLINHPNVVQLYEVLASKAKIYIVLEFISGGKLFDKIKNDGRMNEDEAQRYFQQLINAVDYCHSRGVYHRDLKPENLLLDAQENLKVAEFGLIALSQQAGGDGLRHTACGNPDYAAPEVLNDQGYDGAKADLWSCGVILFVLLAGYLPFEDSSLTTLYKKISSADFSCPPWLSSGVKNLIVRILDPNPMTRITIPEILEDVWFKKDYKPAVFEEKKEANLADVEAVFKDSEEGRVQLRSFPCVICSGGTTCGDVRSRTKLMNGLIERGRPQEAHSIFNTLIEEGHKPSLITYTTLVTALTRQKHFHSLLSLISKVEKNGLKPDTILFNAIINASSESGNLDQAMKIFEKMKESGCKPTASTFNTLIKGYGKIGKLEESSRLLDMMLRDEMLQPNDRTCNILVQAWCNQRKIEEAWNIVYKMQSYGVKPDVVTFNTLAKAYARIGSTCTAEDMIIPRMLHNKVKPNVRTCGTIVNGYCEEGKMEEALRFFYRMKELGVHPNLFVFNSLIKGFLNINDMDGVGEVVDLMEEFGVKPDVVTFSTLMNAWSSVGDMKRCEEIYTDMLEGGIDPDIHAFSILAKGYARAGEPEKAEQILNQMRKFGVRPNVVIYTQIISGWCSAGEMKKAMQVYKKMCGIVGLSPNLTTYETLIWGFGEAKQPWKAEELLKDMEGKNVVPTRKTMQLIADGWKSIGVSNSNDANTLGSSFSTSSKLNIPNNIASSRSPLFLKGMPEKPKLCIKSQFGLRQTLLVVLCRDQIGEAGRFCKFM

SEQ ID NO: 4866 - protein, 452 aa, Unknown
  Bradyrhizobium sp. BTAi1
MMRKTSVILLSAATGAALTLFVTQPRAVLMGSTARAATADTYRQLNLFGDVFERVRSDYVEKPDDSKLVESAISGMLSGLDPHSSYMDAKSFRDMQVQTRGEFGGLGIEVTMEDGLIKVVSPIDDTPASKAGIQANDIITNLDEEAVQGLTLNQAVEKMRGPVGTKIKLKVVRKGADNPLDITLTRDNIRVRSVRSRIESDDIAYIRITTFNEQTTEGLKKSIADLQTQIGDKLKGYVIDLRNNPGGLLEEAVTVSDAFLERGEIVSTRGRNAEETQRRSAHAGDLTKGKPVIVLINGGSASASEIVAGALQDHKRATLVGTRSFGKGSVQTIIPLGAGNGALRLTTARYYTPSGKSIQAKGIVPDIEVLQDVPDELKSRTDTKGEASLRGHLKNDGDEKTGSQSYVPPDAKDDKALKLAADLLHGIKNSANTPAPTTDKAAADKPATKAAN

SEQ ID NO: 4867 - protein, 508 aa, Haemophilus influenzae
MSSQCPFSHLAATNLTMGNGAPVADNQNSLTAGPRGPLLSQDLWLNEKLADFVREVIPERRMHAKGSGAFGTFTVTHDITKYTRAKIFSEVGKKTEMFARFTTVAGERGAADAERDIRGFALKFYTEEGNWDLVGNNTPVFFLRDPRKFPDLNKAVKRDPRTNMRSATNNWDFWTLLPEALHQVTVVMSDRGIPASYRHMHGFGSHTYSFWNEAGERFWVKFHFRTQQGIKNLTNAEAAEIIANDRESHQRDLYEAIERGDFPKWTLFVQIMPEADAEKVPYHPFDLTKVWPKKDYPLIEVGEFELNRNPENFFADVEQSAFAPSNLVPGIGASPDRMLQARLFNYADAQRYRLGVNYRQIPVNRPRCPVHSNQRDGQGRVDGNYGSLPHYEPNSFSQWQQQPDFAEPPLRINGDAAHWDYRNDDNDYFSQPRALFNLMNAEQKQSLFNNTAAAMGDAPDFIKYRHIRNCHWCDAAYGEGVAKALGLTVEDALKARDTDPALGQGGLL

SEQ ID NO: 4868 - protein, 164 aa, Cleisostoma racemiferum
IENKINRQVTFAKRRNGLLKKAYELSVLCDAEVALIIFSNRGKLYEFCSSTSMLKTLEKYQKCNFGSPESTIISRETQSSQQEYLKLKSRVEALQRSQRNLLGEDLGPLGSKELEQLERQLDSSLKQIRSTRTQFMLDQLADLQRREHMLCEANKALKRRFEES

SEQ ID NO: 4869 - protein, 256 aa, Triticum aestivum
MGSMDGHPLQGNHGYAHVPAGSNNDEDDASPPPSAGGGSSGSGRRPRGRPPGSKNKPKPPVVVTRESPNAMRSHVLEIASGADIVEAIAAFSRRRQRGVSVLSGSGAVTNVTLRQPAGTGAAAVALRGRFEILSLSGAFLPAPAPPGATGLAVYLAGGQGQVVGGSVMGELLASGPVMVIAATFGNATYERLPLDQDAEEGAVLSGSEGAATQLEQQGSGGAAVPPPMYAVPQTPPGDMFGQWGQAAVARPPPTSF

SEQ ID NO: 4870 - protein, 444 aa, Unknown
  Bradyrhizobium sp. BTAi1
MRKNWLFLAGTLTGVGLTLLVSGPDGAQLIARAKAAAGMADTYSQLNLFGAVFERVRADYVEKPDDPALIEGAINGMVSSLDPHSRYMNDKSWRDMQETTSGEFGGLGIEVTMEDGLVKVVAPIDDTPASKAGILSGDLIAKIDGEAVQGLTLEQAVAKMKGGVNTKTKLTIMRKGKDAPLDVTLTREIIRVRPVRYHTEGGDIGYIRITSFNEQTTESLRKAITSISKDIPQDKLAGYVVDLRNNPGGLLDQAVSVSSTFLPRGEVVSTRGRNPEETQRFTARGGDLTKGKPLVVLINGGSASASEIVAGALHDHKRATLVGTRSFGKGSVQTIIPLGAGNGALALTTARYYTPSGRSIQAQGIAPDIEVKQDVPDDLKDRTDIKGEASMRGHLSAADGTEQTGSQSYVPPDEKDDKALHAAFNVLRGVTVNADVRAKAAVPN

SEQ ID NO: 4871 - protein, 572 aa, Arabidopsis thaliana
MYRVLSKLSSSIGSSTSRKLVSGRIISSRNYAAKDISFGIGARAAMLQGVSEVAEAVKVTMGPKGRNVIIESSYGGPKITKDGVTVAKSISFQAKAKNIGAELVKQVASATNKVAGDGTTCATVLTQAILIEGCKSVAAGVNVMDLRVGINMAIAAVVSDLKSRAVMISTPEEITQVATISANGEREIGELIARAMEKVGKEGVITVADGNTLDNELEVVEGMKLARGYISPYFITDEKTQKCELENPIILIHEKKISDINSLLKVLEAAVKSSRPLLIVAEDVESDALAMLILNKHHGGLKVCAIKAPGFGDNRKASLDDLAVLTGAEVISEERGLSLEKIRPELLGTAKKVTVTRDDTIILHGGGDKKLIEERCEELRSANEKSTSTFDQEKTQERLSKLSGGVAVFKVGGASESEVGERKDRVTDALNATRAAVEEGIIPGGGVALLYATKALDNLQTENEDQRRGVQIVQNALKAPAFTIAANAGYDGSLVVGKLLEQDDCNFGFDAAKGKYVDMVKAGIIDPVKVIRTALTDAASVSLLLTTTEASVLVKADENTPNHVPDMASMGM

SEQ ID NO: 4872 - protein, 456 aa, Arabidopsis thaliana
MENKPSVLTERYEVGRLLGQGTFAKVYSGRSNHTNESVAIKMIDKDKVMRVGLSQQIKREISVMRIAKHPNVVELYEVMATKSRIYFVIEYCKGGELFNKVAKGKLKEDVAWKYFYQLISAVDFCHSRGVYHRDIKPENLLLDDNDNLKVSDFGLSALADCKRQDGLLHTTCGTPAYVAPEVINRKGYEGTKADIWSCGVVLFVLLAGYLPFHDTNLMEMYRKIGKADFKCPSWFAPEVKRLLCKMLDPNHETRITIAKIKESSWFRKGLHLKQKKMEKMEKQQVREATNPMEAGGSGQNENGENHEPPRLATLNAFDIIALSTGFGLAGLFGDVYDKRESRFASQKPASEIISKLVEVAKCLKLKIRKQGAGLFKLERVKEGKNGILTMDAEIFQVTPTFHLVEVKKCNGDTMEYQKLVEEDLRPALADIVWVWQGEKEKEEQLLQDEQGEQEPS

SEQ ID NO: 4873 - protein, 565 aa, Saccharomyces cerevisiae
MKRTVISSSNAYASKRSRLDIEHDFEQYHSLNKKYYPRPITRTGANQFNNKSRAKPMEIVEKLQKKQKTSFENVSTAMHWFRNDLRLYDNVGLYKSVALFQQLRQKNAKAKLYAVYVINEDDWRAHMDSGWKLMFIMGALKNLQQSLAELHIPLLLWEFHTPKSSLSNTKEFVEFFKEKCMNVSSGTGTIITANIEYQTSELYRDIRLLENEDHRLQLKYYHDSCIVAPGLITTDRGTNYSVFTPWYKKWVLYVNNYKKSTSEICHLHIIEPLKYNETFELKPFQYSLPDEFLQYIPKSKWCLPDVSEEAALSRLKDFLGTKSSKYNNEKDMLYLGGTSGLSVYITTGRIRTRLIVNQAFQSCNEQIMSKALKDNSSTQNFIKEVAWRDFYRHCMCNWPYTSMGMPYRLDTLDIKWENNPVAFEKWCTGNTGIPIVDAIMRKLLYTGYINNRSRMITASFLSKNLLIDWRWGKRWFMKHLIDGDSSSNVGGWGFCSSTGIDAQPYFRVFNMDIQAKKYDPQMIFVKQWVPELISSENKRPENYPKPLVDLKHSRERALKVYKDAM

SEQ ID NO: 4874 - protein, 151 aa, Picea abies
MAMDPLLSTVQQLLGVPDDLERILHAPTRSYMRDTEATASTPVDVKEYPNSYVFIVDMPGLKSNDIKVQVEDENVLNISGERKRNEKEEGAVKYIRMERRVAKFMRKFTLPADCNLEAISAACQDGVLTVTVPKLPPPEPKKPKTIAVKIG

SEQ ID NO: 4875 - protein, 149 aa, Thiobacillus denitrificans
MANISRYDPFSMSRIDPFTDLDDFFKGFFVRPALMEGGAQAPLQIKMDVKENDNAYTIHADIPGVKKEDIQVSVDGNQVSISAETRSEKEEKEGEKVLRSERHVGKIARSFTLPHEVDDAQCQAKYSDGVLELTLPKKAAASAKKLSIQ

SEQ ID NO: 4876 - protein, 436 aa, Bartonella henselae
MIRKVILLVAGVFLGACSMIMVQSVAANNEGDVYKQLAIFGDVFERVRMQYVTVPDDKKLIENAINGMLTSLDPHSSYMNAQEAKEMRDSTKGEFGGLGIEVTMEKNLIKVVSPMDDTPASKAGILAGDLISKIDGVQTNGQTLNEAVNKMRGAPGTPITLTIIRSGIDKPLEIKVVRDIIKVKAVKYRVEGDIGYLRLIQFSEQTFGNLQAAIKDIQSKIPQDKLKGYVLDLRLNPGGLLDQAVSVSGAFLNKGEIVSTRGRRKNDVTRFDAKPGDIIKGKPLIVLINGGSASASEIVAGALQDHRRATILGTQSFGKGSVQTIIPLGENGALRLTTALYYTPAGTSIQGTGITPDIIVEQPLPEKYKGYDVKLGESELKGHIKGERENNKGSGSAAFVPRDPKEDAQLNEAYKLLRGEMANAAFPPDPNKDILK

SEQ ID NO: 4877 - protein, 613 aa, Alkaliphilus metalliredigenes
MCGIAGWIDYQRDLRDENPIIERMTASLGHRGPDTKSSYISKHGLLGHRRLIVVDPSGGAQPMTKRLGEKTYTMVYNGELYNTEDLRKELKDKGHTFNSYSDTEVLLVAYMEWGENCVQHLNGIYAFGIWNEVEKTVFLARDRLGVKPLFYNLKNGGLFFASEIKALLAHPEIDPVVTTEGLCEVFGLGPARSPGNGVFKDINEIKPGYCLTYTPQGVKIKSYWQLESKPHEDSLGDTIENVRGLLIDAIERQLVSDVPICTFLSGGLDSSAIASVTANAFKRDGRGQLHTYSIDYVDNDQYFKPSEFQPNADSEWIGRMVSHIDSKHHDIIIDTPQLTEALEAAVLSTDLPGMADVDSSLYLFCKNVKQNDTVALSGECADEIFGGYPWFRRREDIEANTFPWSKATTERRNILSGDLRKLPLEEYVATKYEETLREVPRMKGESLETHRMREIFYLNMKWFMITLLNRKDRMSMANGLEVRVPFADHRIVEYAWNIPWEMKYLGQREKGLLRSALKDILPEDVRTRKKSPYPKTHNPAYLKAVQQWMGEIMQDPSSPILQVINQEKVKEIVETGGKSFGKPWFGQLMTGPQLIAYLIQVNLWMKHYNVSIE

SEQ ID NO: 4878 - protein, 267 aa, Humulus lupulus
MADANMGAGGGQFPDFPSVLTHGGQYVQFDIFGNFFEITTKYRPPIMPIGRGAYGIVCSVLNTELNEMVAVKKIANAFDIYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTELLGTPTESN

SEQ ID NO: 4879 - protein, 244 aa, Unknown
  Acinetobacter sp. ADP1
MMRYQIDYIDVKNSLKNYIWILKDSHTQEIIVVDPTESSLVQQYCEKHQVKIAQIWLTHWHKDHIGGVPDLIDGSHIPVYGPREELSKIPLITHPLQHENHFKFNHLNVEVLATPGHTLGHVVYFIEETGSLFCGDTLFAMGCGRVFEGSFEQMYHSLNRLAALPTTTKVYCTHEYTLANAEFAVTVEPDNLALKERLKEVQSLRSRHQITLPSTIALELATNPFLRTESVEEFAKIRTLKDQF

SEQ ID NO: 4880 - protein, 221 aa, Glycine max
  misc_feature (196)..(196): Xaa can be any naturally occurring amino acid
MGRGRVELKRIENKINRQVTFAKRRNGLLKKAYELSVLCDAEVALIIFSNRGKQYEFCSGSSMLKTLERYQKCNYGAPEDNVATKEALELSSQQEYLRLKARYEALQRSQRNLMGEDLGPLSSKELESLERQLDSSLKQIRSIRTQFMLDQLSDLQRKEHFLGESDRDLRQRLEEFQINPLQLNPSAEDMGYGRHXRYHPDPVSVVTEGPSMNNYMAGWLP

SEQ ID NO: 4881 - protein, 493 aa, Unknown
  Synechococcus sp. CC9605
MAALQIVWFKRDLRIVDHQPLAAAVERGLVLPLYVVEPELWRQPDASERQWMFCRESLLELRQALADRGQPLVVRAGDVVQVLERARRQFGIDGLWSHEETGNGWTYQRDKRVGAWARRHGIAWMELPQFGVTRRMHSRNGWAKRWEVQMTEPITPVPAALQALDGIDHGVIPERPCSELLLDACPQRQIGGRSTGLEELNDFLQHRAQRYQRSMSSPNTAFTGCSRLSTYLTWGCLSMREVLQTSRTHSGRGVSSFESRLHWHCHFIQKLEDQPAIEFSDFHPFMRGIRAADAERLTAWSEGRTGVPFVDACMRALRAHGWINFRMRAMLMSFASYNLWLPWRDSGLHLARQFVDYEPGIHWSQCQMQSGSTSINTIRIYNPIKQGMDHDPQGLFIRQWCPELKDVPTIHIHEPWMLGGGMPAPIVDVTASMQDAKDRIWDIRRSAGFDRHADAIQCKHGSRKAGLKPTTARRRRRQPQPPDNGSQQLSLGF

SEQ ID NO: 4882 - protein, 355 aa, Unknown
  Shewanella sp. ANA-3
MTIEHAANSVGNLFDTYKLNDTITLKNRILMAPLTRCMADADLVPTDDMVAYYARRAEAGLIISEATIIRPDGQGYPNTPGIFNQAQIAGWRKVTDGVHANGGKIFVQLWHTGRVAHPHFFGGGDVLAPSAEKVEGSVPRMRELIYVTPKAATLEDIQGLVRDYAKAAENAIEAGFDGVEIHGANGYLIDAFLHHDSNRRTDEYGGTPANMSRFALEVVDAIAARIGKDRTGLRISPGAYFNMAVDNRDRAVFDYLLPELEKRELAFVHIGIFDDSMEFDYLDGRVSSYVRANYGKTLVGVGGYSAQSASEAIAADKFDLIAIGRPFIANPDYVARVRQGHELVTYSDEMLASLV

SEQ ID NO: 4883 - protein, 485 aa, Nicotiana plumbaginifolia
PSSAFNSPFCTTNSGAPVFNNNSSLTVGARGPVLLEDYHLVEKLANFDRERVPERVVHARGASAKGFFEVTHDITHLTCADFLRAPGVQTPVIVRFSTVIHERGSPETLRDPRGFAVKFYTREGNFDLVGNNFPVFFIRDGMKFPDMVHALKPNPKSHIQENWRVLDFFSHVPESLHMFTFLFDDIGIPQDYRHMDGSGVHTFTLINKAGKSTYVKFHWKPTCGVKSLLEDEAARVGGANHSHATQDLYDSIAAGNYPEWKLFIQTMDPDHEDRFDFDPLDVTKTWPEDILPLQPVGRLVLNKNIDNFSNENEQLAFCPSIVVPGVYYSDDKMLQTRIFSYSDTQRYRLGPNYLQLPANAPKCAHHNNHYDGSMNFMHRDEEIDYFPSRYDPVRHAEKYPIPSTMCTGKREKCVIQKENNFKQPGERYRSFTPDRQERFIRRWVETLSDPRITYEIRSIWISYWSQADKSLGQKLASRLNVRPSI

SEQ ID NO: 4884 - protein, 492 aa, Nicotiana plumbaginifolia
MDPSKFRPSSAYDSPFLTTNAGGPVYNNVSSLTVGPRGPVLLEDYHLIEKLATFDRERIPERVVHARGASAKGFFEVTHDISHLTCADFLRAPGVQTPVIVRFSTVVHERGSPESLRDIRGFAVKFYTREGNFDLVGNNVPVFFNRDAKSFPDTIRALKPNPKSHIQEYWRILDFFSFLPESLHTFAWFFDDVCLPINYRHMEGYGVHAYQLINKAGKAHYVKFHWKPTCGVKCMTEEEAIRVGGTNHSHATKDLYDSIAVGNYPEWKLSIHIMDPEDVERFDFDPLDVTKIWPEDILPLMPVGRLVLNRNIDNFFAENEQLAFNPGHIVPGLYYSEDKLLQTRIFAYADTQRHRIGPNYMQLPVNAPKCAHHNNHRDGAMNFMHRDEEVDYLPSRFDPCRHAEQYPIPSRVLNGRREMCVIEKENNFKQAGERYRSWEPDRQDRYVSKWVEHLSDPRVTYEIRSIWISYLSQADKSCGQKVASRLTLKPTM

SEQ ID NO: 4885 - protein, 1364 aa, Xanthomonas campestris
MPHGRWDLRRKYGRRASIGAVLLLSAGLIAAFLVGFAVHRHNELERERRFDMVVRVLARNISERMYTFEHGLRGARGAVIGAGSDVISRDRFTRYSRSRDYPREFPGVLGYGYIHRVAAADEAAFLDAARADGAPDIQRRLLAPWDGERFIVLYFEPESSGNRPLGLDVASEPRRRIAAIAAARSGQPTMTSPVSLSGYQTPSEGGFLVLLPVYREGMPLQTPQQRMDATTGWAYAPLSVKQMLESTLGDRDDVAISLSDREDTQHTFYRSGIAAPESMRRAAHTQLLPIYGRTWVLTARPTLHFIGSLNQNSPWLMGSLVLGTAILLAALLGLYFSNGLRREEVLRKQMELAALVSHSSEAIVAETPDGEITHWNPAAEAMFGYPADVAIGQDLTTLLSPQPYAMPQIDQDEAPPVAALSAAQTMRHRDGHQVFVLASKAPIIEHDNAVSGHSHFFRDISERVRSHQRIVDLNASLEHQVAERTSELVQFSVLQRAILAHAGYAIIATDSSGFVTMFNPAAEKLLGYSADDVIGRRKASQFIEADELQERALRLAEQTGTPVAGTLEAVAALTSLGRSDTSEWTYVSQDGRRLPVLLTLSTLRDDNDQVIGYLGVAVDLTEQKLHEKQLRLAMDAARSANQSKSDFLANMSHEIRTPMNAILGMLYLLQRSELPGAAQDMVTKIDRSARSLLEIINDILDFSKIEAGRIDLERAPFDLNQLFDNIADLMRSSLSAKPVEMIVEPLPRECRWLLGDALRINQVLVNLVGNAIKFTEQGEVVLSVRRFPSGDPNKIKLLFSVRDTGIGISKEKQSLIFSPFLQADTSTSRRYGGSGLGLTISRRLIELMGGALEVESVPGRGSEFYFVITLERTDPPKAQQEAALLPPESMPRVLIADDHDAALNNLVRIATELGWRVDAVASGQAAMQAIEDATEPYDIFLLDWRMPDIDGVAIARQVRARATPGRHPVIVMVTAYERRLLEQHPEQQDLDAVMTKPVTSAALHRLVEQLVDERPNARPATPTFVARRLEGAQLLLVDDSEINCEVAQRILEGEGAMVTVAHDGEQAVNTLKRAPDLFHLVLMDVQMPVVDGYEATRRLRQIPSLASLPVIALTAGAFRPQQEKALEAGMNGFIAKPFNVEELVTAIRHFLQPGSRRVSSLPHERAPAAGPEWAHTDPLLLDAARAQSLWREREPYERYLLKLLRDNPDPAETAAAHLRNNELPAIGALAHKLRGAAGSLALPALAGASGDLESRVEQGHDLTAALLALKDTMAQTTAAIHAFLQTSPSTQDTGQTGAALDDDSALILENALRSDDADKIDHALLICAPRLPPPLQEDLQRAVDDFDFRRAEATLRDWQANHPR

SEQ ID NO: 4886 - protein, 492 aa, Nicotiana plumbaginifolia
MDPYKYRPSSANNSPFWTTNSGAPVWNNNSSMTVGTRGPILLEDYHLVEKLANFDRERIPERVVHARGASAKGFFEVTHDITHLTCADFLRAPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGVPQDYRHMEGSGVNTYMLINKAGKAHYVKFHWKPTCGVKCLLEEEAIKVGGANHSHATKDLYDSIAAGNYPEWKLFIQIIDPDHEDRFDFDPLDVTKTWPEDILPLQPVGRLVLNKNIDNFFAENEQLAFWPAIVVPGVYCSDDKLLQTRIFSYSDAQRHRLGPNYLQLPVNAPKCAHHNNHHEGFMNFMHRDEEVNYFPSRFDPCRHAEQYPIPPCVLTGKRDKCIIEKENNFKQPGERYRSWAPDRQERFICRWVDALSDPRVTHEIRSIWFSYWSQADKTLGQKIASRLNVRPTM

SEQ ID NO: 4887 - protein, 259 aa, Pseudomonas syringae
MIQIHALPAFNDNYIWLLQDLSSQQCAVVDPGDAKPVLGWLAQNPDYRLTDILITHHHNDHVGGVAELKQSTAARVLGPAAETIPARDIALVDNDRMTVLGLEFVVHAVPGHTLGHIAFYHEDATTPLLFSGDTLFAAGCGRLFEGTPQQMHDSLGRLAKLPDSTLIYCAHEYTLSNLRFAQAVEPANVDIAERLAEVTRWRSENRISLPSNMALEKRTNPFLRTGETSVKEKADERSDAQNTSQSAVFASLRAWKDKF

SEQ ID NO: 4888 - protein, 493 aa, Unknown
  Shewanella sp. ANA-3
MSDNQTPAAKHALMWFRQDLRLTDNQALTAACDWVRQAPGAKLRAIYIATPNQWLSHDMAPIQIDFIQRHVNLLAQGLASLGIEFELIQLDSFKEVPAFLASYCEKLGVERVFAGREPEINEQKRDQACLDTGIPLVLSDEHCLLPPGTVLNLSGDMYKVFTPFSRKWREIAAKRAIFPLAVPAPLGPMLPEPKPISFKERFQSTSKLTSSEQWAAGEGQAKRILTAFIKQKVQDYKQDRDFPALDGTSVISPYLALGVLSPRQCIAALLGRFPDVIVDDTSPGRTWLNELIWREFYRHLLVAFPDLSKGHNFNRQADHVQWRNNQAEFLAWCEGKTGYPIVDAAMRQLNQTGWMHNRLRMVVASFLTKHLLIDWRWGERYFRQHLIDGDLAANNGGWQWSAGCGCDAQPYFRIFNPISQSEKFDPDGSFIRKYLPELASWGIKRLHQPNMQKTPSLFEAPMLESDSAYPCAIVEHNAARARALAVLGVLKKA

SEQ ID NO: 4889 - protein, 909 aa, Pseudomonas tolaasii
MLRRMGIKGRVLLLTLLPTTLMALLLGGYFTWMQLSELQTQLLQRGEMIAEQLAPLVAPALSTRNTDLLERIATQSLEQPDVRAVSFLAPDRSPLAHARPTMLNQPPVGNSSHLVAASGNDATRYLLPVFGRHRNLAGELIPDEADRLLGWVEVELSHNGMLLRGYRSLFASLLLIAIGLICTAALAVRISRTINSPIGQIKQPVAQLKDGNLETCLAPLGSQELDQLASGINRMAETLQNAQEELQHSIDQATEDVRQNLETIEIQNIELDLARKEALEASRIKSEFLANMSHEIRTPLNGILGFTHLLQKSELSPRHVDYLGTIEKSADNLLGIINEILDFSKIEAGKLVLDSVPFNLRDLLQDTLTILAPAAHAKQLELVSLVYRDTPLAVVGDPLRLKQILTNLISNAIKFTREGTIVARAMVEDEEEDSVQLRISVQDTGIGLSNQDVRALFQAFTEADNSLSRQPGGTGLGLVISKRLIEQMGGEIGVDSTPGEGSEFWISLNLPKTRDDVDDLPSAPLLGRRVAVLENHDVARQALQHQLEDCGLEVTPFNTLESLTNGITSTHQTEQAIDLAVLGVTANDIPPERLNQHLWDLEHLGCKVLVLCPTTEQMLFNQSVPNPNSQLQAKTPCTRKLRRALADLISPPVAQRTREPLSSRAPRVLCVDDNPANLLLVQTLLEDMGAKVLAVESGYAAIDAVKQETFDLVLMDVQMPGMDRRQSTEAIRQWESERHGTPLPVVALTAHAMANEKRALLQSGMDDYLTKPISERQLAQVVLKWTGLALRNQGPERGNDNLGHGVQLLVLDHEEGLAAANKADLAADMLAMLLASLEADRLAITVAREAKDNNALIERIHRLHGATRYCGVAELRAACQRAETLLKQDDAQGHGALDELDMAIGAAGQ

SEQ ID NO: 4890 - protein, 405 aa, Actinobacillus pleuropneumoniae
MERFPKSDKLANVRYDIRGAIHKEALRLEEEGNKILKLNIGNPAPFGFEAPDEIVVDVIRNLPKSQGYCDSKGLYSARKAIVQYYQSKGIRNVDVNDVYIGNGVSELITMSMQALLNDGDEMLIPMPDYPLWTAAATLAGGKAVHYLCDENNEWMPDIEDIKAKITPRTKGILVINPNNPTGAVYSRSMLLEIAEIARQHNLMIFADEIYEKIIYDGAVHHHIAALAPDLLCVTYNGLSKAYRVAGFRQGWMVLSGPKNQARGFIEGLDMLASMRLCATTPMQHAIQTALGGYQSINEFVLPGGRLLEQRNKMYELLVQIPGISCVKAKGALYMFPKIDTEMYGIKDDAKFIYDLLQAERVLLVQGSGFNWHKPDHFRVVTLPYAHQIEEALGRLANFLKTYKQS

SEQ ID NO: 4891 - protein, 166 aa, Zea mays
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQVIYRTVIC

SEQ ID NO: 4892 - protein, 151 aa, Picea glauca
MAMDPLLSTVQQLLGVPDDLERILHAPTRSYTRDTEATASTPVDVKEYPNSYVFIVDMPGLKSNDIKVQVEDENVLNISGERKRNEKEEGEVKYIRMERRVAKFMRKFSLPADCNLEAISAACQDGVLTVTVPKLPPPEPKKPKTIAVKIG

SEQ ID NO: 4893 - protein, 775 aa, Schizosaccharomyces pombe
MSTISEVGPWELGLSLGSGGPNSSRLAKHRETGQLAVVKPIVGWSELTSSQQARIEGELVLLRLIEHPNVLQLIDVISAQEQLFVVVEYMPGGELFDCMLRKGSFTEQDTAKFLWQILCGLEYCHKLHICHRDLKPENLYLDAHGSIKIGEFGMASIQQPGKLLQTSCGSPHYASPEIIMGRSYDGCASDIWSCGIIFFALLTGKLPFDDDNIRSLLLKVCQGQFEMPSNISPQAQHLLYRMLDVDSSTRITMEQIREHPFLSCFVHPNISIPIISAPIQPIDPLIVQHLSLVFRCSDDPMPLYEKLASQSPLVEKTLYTLLSRHLHPPSSAAVDRNRAVVDDLLGTAASNGQQMDEEEIEQAINIPTLAPYPISYAAESVPRPATSASPFLTPVTTSGTFNYSFNATNPQSILQRPATTSSAVPQLPKSVTPGLAYPHDSSMLSSNYRPPSALSPRNFNVSINDPEVQLSRRATSLDMSNDFRMNENDPSIVGNLAASNFPTGMGPPRKRVTSRMSEHTGNRVVSFPRGSAFNPRVTRFNVGNEQFSNNIDNNNYNQPYANATMNNSRRLRTPSGERSMRADLSQSPASYDSLNVPKHRRRQSLFSPSSTKKKLSGSPFQPKRSFLRRLFSSEPSCKCVYASLVASELEHEILEVLRRWQLLGIGIADIIYDSVSASISARIKRQNSLNLKPVRFRISVLAEFFGSQAVFVLESGSSTTFDHLATEFQLIFEDKGFLDNLELSYFQASASRPVSRMSVSSSPFAVFRQRQSVQS

SEQ ID NO: 4894 - protein, 161 aa, Pseudotsuga menziesii
MSIIPSFFGRRSSSAFDPFSLDVWDPFRAFTDLAAGGPSGQFVNEASAVANTQIDWKETPEAHIFKADLPGLKKEEVKIELEEGQRILQISGERSKEEEQKNDKWHRIERSHGKFLRRFRLPDNAKVEEIKAAMENGVLTVTVPKEPEPQPPQPKSIEISG

SEQ ID NO: 4895 - protein, 146 aa, Funaria hygrometrica
MALSLFGRGSGSFFDPFDLSLLESGPSRQFARDAHAVANTQIDWRETPEAHIFKADLPGLKKEEVKVQLVDGKTLEISGERRKEEVHKDDTWHRVERAHGSFLRRFRLPDNSNVEAVEAQVQDGVLTVTIPKIQKPKPQVRQIEIA

SEQ ID NO: 4896 - protein, 454 aa, Burkholderia pseudomallei
MDFRSSTQPERHAMPDSNPTAAALLAQPLTLPNGTVLKNRLAKSALSEALCGHDGRVTPQLIALYRRWSGSGAGLLVTGNVMIDGKALGEPGNVVIEDDRDLPRLREWAAAAKAHGSEIWMQINHPGKQAMRGLNEETVAPSAIGFGPKLSPYFAVPRALTVDEIDALIRRYGTTAAVAQQAGFTGVQLHGAHGYLINQFLSPQHNQRTDEWGGSAENRRRFVLAVYAEVRRRVGPDFPIGIKLNSADFQRGGFTEEESLDVIRALAEAGIDLIEISGGTYETPVMQLGDRKASTIAREAYFLAFAEKVRADVKVPLMVTGGFRSLAGMEAPLRDGALDLIGLGRILAIEPDAPARLLRGEETRHRVKPLSTGVKYFDSLGSLEVTWYTRQLHRIGKGRNPIPDENALKSFLLDLSSKGCAIFKARRLRASSSEASAARGSATSVAGGPRHDAH

SEQ ID NO: 4897 - protein, 440 aa, Synechococcus elongatus
MSLFSRLRFSVYGSALLAASGAVCIGISAEHARALPWQDSPKVVLDQAWQLIDREYVDPTFNRQDWQAVRRELLSRNYGSNEEAYAALRSALRRLDDPYTRFLAPEQFKTLTEQTAGEASGIGIEIIPDSKDSRPRIQAILDNSPASKGDVQVGDRILAIDADSTRELTLDEVRNRLQGKVGSEIDLKLQRGDRIFSVKLTRVQIEIPSVTAELRQHSGRSVGYIQLREFTAHAAREMRTSIRSLDEQGATSYVLDLRGNPGGLLYSSIEIARMWLNNGTIVKTVDRNGKSETINANNSAITNKPLAVLVDQNSASSSEILVGALKDNNRAVVIGRQTFGKALVQSVHTLADGSGLAVTVAHYYTPNGTDLGNRGIQPDVEVRLNQRQQALQRSDPSFLGSNQDPTYGQAIATLEQRTAESTPSPASSPQLSQRPSEIRP

SEQ ID NO: 4898 - protein, 585 aa, Xanthomonas campestris
MIERNVTTPAWGAWPAGDGQVRFALWAPDAHTVEVIFDSGERAALQRQDDGFFSGVVACALDARYRYRVDGQTPVPDPASRWQPDGVHGSSAVQRVDGYHWTHTQWQGRPWDEAVIYELHVGACGGYAGVQAQLPQLAAMGITAIELMPLSAFPGAHNWGYDGVLPYAPAEAYGTPDELKALIDAAHGHGLMVLLDVVYNHFGPDGNYLGSYASAFFNEDKPTPWGAAIDFRKPPVQRYFLDNALMWLHEYGFDGLRLDAVHAITPNAFLDTLRETIEASLPAGRHVHLVLENEANQASQLDRGYTAQWDDDFHNALHVLLTGEEEGYYAAFADQPTQHLARVLGEGFAYQGQPDPRGHVRGEPSGALPPHKFVIFAQNHDQIGNRACGERLSVLVSPQRLRAALALTALTPMIPLFFMGEPWGATQPFLFFTDFGPPLDDAVREGRRREFAHFAAFADPAKRETIPDPNSHATFAASRAPIEDAAHGDGAQWAAWFQALLGVRRQWLVPGLAQARALRTSVLADGAVTATWELPGGLWHIAFNVGAEAVPLPPLRGRVAHAENVTADAQTLPTDSFIAWYEEHA

SEQ ID NO: 4899 - protein, 283 aa, Physcomitrella patens
MGRGKIEIKKIENTTSRQVTFSKRRGGLLKKAHELAVLCDAEVALVIFSSTGKLFEYASSGSMRDIIERYKKSPNGAMKSGASTDFLGREVVKLQEQVERLKSSQRRMLGEDLSALKVPDLLQLEQQLDLGASRVRARKNQLILEEIEGLQKKEQELMVANEDLRKKIADAEAVARANLSEARPESPRHLARTLSRDVSASSHPAATVYPHPNLRDVQRSQTSLQLGMFSSESYPPSSSRWPSEQQFPSASEGCAGESSMKWDHPHYHIQNRLHANILPSVRI

SEQ ID NO: 4900 - protein, 545 aa, Unknown
  Frankia sp. EAN1pec
MPKIIAFDEEARRGLERGMNQLADAVKVTLGPKGRNVVLEKKWGVPTITNDGVSIAKEIELEDPYEKIGAELVKEVAKKTNDVAGDGTTTATILAQALVREGLRNVAAGANPIGLKKGIEAAVERVSEELSSVAKDVETKEQIASAASISAGDPAIGAMIAEAMDKVGKEGVITVEESNTFGLELELTEGMRFDKGYISPYFVTDTDRMEAVLDDPYILITNSKISAVKDLLPILEKVMQAGKQLVILSEDVEGEALATLVVNKIRGTFKSAAVKAPGFGDRRKAMLTDIAVLTGGQVISEDIGLKLEGTTVDLLGRARKVVITKDETTIVEGAGDADQIAGRVNQIRNEIEKSDSDYDREKLQERLAKLAGGVAVIKVGAATEVELKEKKHRIEDAVSNAKAAVEEGIVAGGGVALLQASTSAFEKLDLSGDEATGALIVERALAAPLRQIATNAGLEGGVVVEKVRGLPTGHGLNAATGEYVDMIAAGIIDPVKVTRSALQNAASITGLFLTIEVVVADKPEPAGAGGGADAAAMGGMGGMGF

SEQ ID NO: 4901 - protein, 651 aa, Chlamydophila caviae
MIKILRLCALVLTCLPSFSFASELLHEADIRKTVDRLIEYHVDVQDISPDILMRSLRGYSQSFDSHKAYLTEQEVGNFIQSTDIKKRLLKNYKTNNFAIYQNLNRVIKDSIIRAREWRTEWLSDPEALVKEAATHALIKKPKQWARSIQEVKERQRSLLLSYISVYLSDSSKNRYQGKEASLTQLCVRQLEAHENPYLGINDYGKPMSPQEESHHFHVRVVKAMAHSLDAHTTYFSKDEALAMRIQLEKGMCGIGVILKEDIDGVSVKEIIPGGPAHKTGDLHVDDIIYRVDGKNIENLPFRAVLDCLRGSQGSEVTLDVHSQDQNRTVKLRREKISLDDRRVDVSYESYGNGVIGKITLHSFYEGENQISSEQDLKRAIQSLQDKNLLGLVLDIRENTGGFLSQAIKVSGLFMTNGVVVVSRYADGSIKRYRTVSPKKFYDGPLTILVSKSSASAAEIVAQTLQDYGVAIIVGDEQTYGKGTIQHQTITADSDKEGFFKVTVGKYYSPSGKSTQLQGVRSDIHIASRYFAEPLGERYLEHPLPADSCDNVMDDNLKDLDAQMRPWFQKYYTPNLQKEETVWKEMLPQLTANSKQRLSENKNYKIFLDELKDPSEAIRPFGSNDLQMEESVNILKDMILLRERKAAISLGG

SEQ ID NO: 4902 - protein, 164 aa, Caulobacter crescentus
MPHAGLCLYRREAPSRRSAMRYLHTMIRVRDLDASLRFYCKGLGLQEMYRTENEKGRFTLVFLAAPEDVELAKARKAPLVELTYNWDDEEYGGGRNFGHLAYRVDDIYETCQRLMDMGVTINRPPRDGHMAFVRSPDNISIELLQDGDLPPAEPWVSMPNVGAW

SEQ ID NO: 4903 - protein, 392 aa, Unknown
  Nocardioides sp. JS614
MTADVFAPTTLGPVRLRNRTVKAATFEGRAPHGQVTDELIDYHLAVTHGGVGLTTVAYLAVAPEGRTHREQIVVGEPTLAGLTRLADAIHESGAAIAGQVGHAGPVANGRSNGVKAISASRMPSPLSMQLIRSATEADLTRVTKAYVAASRLLVRAGFDVLELHMAHSYLISSFLAPGLNRRKDGWGGSLANRARLGRQVARAVRDEIGSDAAITAKVSVGDGFRGGVTTDEGIEYAQLLEADGTLDALQLSGGSSLMNPMYLFRGEAPVREFAATMPLVVRLGMKTPVGQSFLKAYPFEEAYFREKALRFREAVSMPLMLLGGINRLATMEQAMAEGFDFVAMGRALLREPDLVDRLQSGRATAGVCIHCNRCMPTIYSGTRCPVIAPEPA

SEQ ID NO: 4904 - protein, 544 aa, Rhodospirillum rubrum
MVLTLLAGLTGCAHPAPLASTALPQATAVSHSGKIPPTAVWTVPSAFDKGLRGETEDLFSYGYGAIADRYIDEVNLRELGVEGLSGLTSLDPAITVAPVGAMLDVYRNGTVVGRFPLAGARDSAGWGVLTANVVMLARDLSPSLNASDPEEIYQAIFTSALGGLDPFSRYASRDDAEVNRGQRNGFGGIGVMYDVGGRGATITQVMPGTPAADARLRLGDVIVAVNGQSTRGATRHDLREWLRGPTSSEVTLTLVSADTPTERTLTLTRALIIMPTVDLHLDEGVGFITVSSFNQGTTTRVAEAIGEARRQLGADLRGLVIDLRGNPGGLLDQAVTMSDLFLDTGPIVSTRGRNPDARQFYASSGGDIAQNLPIVALIDGDSASAAEIVAAALQDNGRAVVIGTSSFGKGTVQTLIQLPNGGELTLTWSRFHSPSGYVLHGLGVLPVACTSGIAEASREDGAPADKVLTTMRRDQSEIAAHVALWRQTDMRDASRRLALRDACPAEHHPRALIDETVARKLIADQGLYGRALRLTAPAQSASGL

SEQ ID NO: 4905 - protein, 309 aa, Zea mays
  misc_feature (198)..(198): Xaa can be any naturally occurring amino acid
MARHFVLNTGAKVPYVGLGTWQSDPGVVGNAVYAAVKAGYRHIDCARVYGNEKEIGLALKKLFEEGVVKREDMFITSKLWNDHHAPEDVPEALNHSLNDLQLEYLDLYLIHWPFRVKKGANTSPENFVTPDIPATWGAMEKLYDAGKARAIGVSNFSSKKLGDLLAVARVPPAVDQVECHPGWQQTKLHSFCQSTGVXTAYSPLGSPGTTWMNGNVLKEPIIISIAEKLGKTPAQVALRWNIQMGHSVLPKSTNEERIKQNLDVYDWSIPDDLLAKFSEIKQDRLLRGNFIVNPESAYKTHEELWDGEL

SEQ ID NO: 4906 - protein, 517 aa, Lilium longiflorum
MGNSLGCSASGERLVSAARDGDAVEARMLLEFSPCLAKYSTFGGLNSPLHFAAAKGHIEIVEMLLENGADVNSRNYCGQTALMQACRHGHWEVVQTLLLFRSNVTRADYMSGRTALHFAAMDGHTRCIRLLVADFVPSTPYGETTDSPVEGGERARNGGGSPVSPSESKNDQLSLARFINKAAEGGLTALHMAALSGHFDCVQLLLDLHADVSAETYNYSSSMNFIGSGSTPLHYAACGGSLKCCQMLLAKGASRLKMNGNGWLPIDVARIWGWNILEPILDPTSDPNLPTFPPSTYLSLPLKSIVNIARECGLQSSTTNEDNDLCAVCLERACNVAAEGCSHELCVQCALYLCSTSNKTSETAGPPGSIPCPLCRNGIVSFMKLPNTTAKELRPNLSLSFCNPCIFPPRTLNQPAADCKSEFRKNRVTSVSSEAICPLPCAPFPSVSIPSCSCDDDPCQCIESDGDRQEQQPHRRSQSTPTELDRLEEQSLASCSGMFWTRRNCQREHQCNAEINA

SEQ ID NO: 4907 - protein, 454 aa, Fremyella diplosiphon
MLAGKVMSEPRVTILHVDDNEANRYVVTRILQNAGFAVVEAATGAAGLKAVANHQPDLVILDVKLPDISGFEVCRQIKANPELAFIPVLQLSASFIQSQDKAEGLDSGADGYLVQPVEPIELLATVRSLLRIRRAEEAALSSAREWQTTFDSINDGVCLVDREGRIRRCNRAMIQLVCKHKSEILGRLYHELLNAEWGMGDGTCFRRAQETHQRQVLEFQSQGRWFAKTIDPVFDRLGTLTGAVFILSDITERKQAEVLLQEQNERLNRLMVSLQQQTEQAQQANRIKDEFLAVLSHELRSPLNPILGWTKILQTSQQDVAKTQYALATIERNAKLQAQLIEDLLNVSRILQGKLSLNKVPVSLSLIIKAALETVRLAAEAKSIQIQTVFEPNLGQVLGDSGRLQQVVCNLLSNAIKFTSQGGRVEVRLERMKNEVDTHPLEYTQITVSDTGMG

SEQ ID NO: 4908 - protein, 217 aa, Euryale ferox
MGRGKIEIKRIENASNRQVTFSKRKQGILKKAREISVLCDAQVSLVLFSSAGKLNEYCSPSTNLKEILTRYQKTSGKKLWDARHEYLNTELDRIRKENENMQIELRHLMGEDLSSLSVVELRNLEDSLQFGYDHVRMKQTECLNNDIEILRKNERMLEEENRQLKYILHQQEQMAMREMRDIEIGSNKKEKGYPSQSRVQPFGFCVQPIQPNLQQNK

SEQ ID NO: 4909 - protein, 376 aa, Arabidopsis thaliana
MAKEIESATDLGDTNIKGVLVHGGRYFQYNVYGNLFEVSNKYVPPIRPIGRGAYGFVCAAVDSETHEEIAIKKIGKAFDNKVDAKRTLREIKLLRHLEHENVVVIKDIIRPPKKEDFVDVYIVFELMDTDLHQIIRSNQSLNDDHCQYFLYQILRGLKYIHSANVLHRDLKPSNLLLNSNCDLKITDFGLARTTSETEYMTEYVVTRWYRAPELLLNSSEYTSAIDVWSVGCIFAEIMTREPLFPGKDYVHQLKLITELIGSPDGASLEFLRSANARKYVKELPKFPRQNFSARFPSMNSTAIDLLEKMLVFDPVKRITVEEALCYPYLSALHDLNDEPVCSNHFSFHFEDPSSTEEEIKELVWLESVKFNPLPSI

SEQ ID NO: 4910 - protein, 392 aa, Acridocarpus adenophorus
DLEPVNPADVPVTAAGALKSYKLAAKAISRLQSLPSGDISLLCDVLVKEVRDLTGYDRVMAYKFHEDEHGEVVSECRRSDLEAYLGLHYPATDIPQASRFLFMKNKVRMICDCLAPPVKVIQDERLPQPLSLCGSTLRSPHGCHAQYMENMGTIASLVMSVSINEDDDMMDGDQQQMPRKLWGLVVCHHTSPRFVPFPLRYACEFLIQVFGVQINKEVELAAQVREKHILRIQTLLCDMLFRDAPVAIITQSPNVMDLVKCDGAALYYKNKFWLLGITPTEAQIRHIVEWLLECHSGNTGLSTDSLMEAGYPGASVLGDAVCGMAAVGITSRDFLFWFRSHTAKEIKWGGAKHDPDDKDDGTKMHPRSSFKAFLEVVKWRSLPWEDVEMDAI

SEQ ID NO: 4911 - protein, 466 aa, Streptococcus suis
MVTEQREYRFPEGFLWGSSTSGPQSEGSVAGDGKGWNNWDYWYSQEPKLFHQQIGPEQTSTFYEHFQSDLDLLVETGHSIFRTSIQWSRLIPEGIGEVNPQAVEFYRAVFAGIRERGIKLLVNLYHFDLPYVLQEKGGWENKEIVWAYEAYARQCFSLFGDLVDHWITFNEPIVPVECGYLGSYHYPCKVDAKAAVVVAYHTQLASSLAVRACHQLHPDHKISIVLNLTPAYPRSQSPEDLQAARIAELFQTRSFLDPSVLGQYPRELVDILEKHGLRPETTEEELTIIKENRVDFLGVNYYQPLRVQTPSEDGWNGEATFLSQYFQPYDKPDKKINPHRGWEIYEEGLYDIAKNIQENYGNIEWLVTENGMGVEGEDVFEENGMIQDDYRIHFMEDHLIQLHRGIDEGANCKGYMVWTFIDCWSWLNAYKNRYGLVSLDLQTQKRTVKKSGYWFKQVSAKNGFIR

SEQ ID NO: 4912 - protein, 147 aa, Funaria hygrometrica
MDFPLFQILSFPDELEKSLNPQSQKYVRDTKAMVSTAVDVKELPDAYIFVADMPGLKSADMKVQLENDNVLVIGGTRKREEPDPKVKYIRMERNSGSFMRKFTLPQNSNLDKIAASCVDGILTVTVPKIPPPEPAKPRTIEVTMGNQ

SEQ ID NO: 4913 - protein, 383 aa, Xanthomonas campestris
MWGMLAVLLVFTQLTIFAVTLYLHRSQAHRGVDFHPVIAHFFRFWTWLTTSMITREWVAIHRKHHAKVETEEDPHSPQTKGIGQVFWRGVELYREARAQRADIEQYGKGAPNDWIERHLYTPHANAGPIALLVVNSVLFGLPGIALWAIQMAWIPFWAAGVVNGLGHWWGYRNFESADTSTNLTPWALWIGGEELHNNHHAFPSSARFSMRRWELDIGWIAIRCLQALGLAKVLRVAPSLDIRPNIAVPDADTLKALLSHRFQAMTDYQRNVLKPALREEAAATGAKLRQLLPRRLRKGLVDDGRWLKPDAREQLQHWVAQRPRMRTLVEYRARLTAVLEARSHDASERLKQLQQWCHEAEASGNAALQAYAARLKGYALSGT

SEQ ID NO: 4914 - protein, 500 aa, Triticum aestivum
  misc_feature (117)..(117): Xaa can be any naturally occurring amino acid
  misc_feature (126)..(126): Xaa can be any naturally occurring amino acid
  misc_feature (170)..(170): Xaa can be any naturally occurring amino acid
  misc_feature (251)..(251): Xaa can be any naturally occurring amino acid
  misc_feature (280)..(280): Xaa can be any naturally occurring amino acid
  misc_feature (403)..(403): Xaa can be any naturally occurring amino acid
  misc_feature (414)..(414): Xaa can be any naturally occurring amino acid
  misc_feature (429)..(429): Xaa can be any naturally occurring amino acid
MVLSHAASAGSSDDSVHSTFASRYVRASLPRFRMPENSIPKEAAYQIINDELMLDGNPRLNLASFVTTWMEPECNKLMMDSINKNYVDMDEYPVTTELQNRCVNMIAHLFNAPLGEXETAVGVGTXVGSSEAIMLAGLAFKRRWQNKMKAAGKPCDKPNIVTGANVQVCXWEKFARYFEVELKEVKLSEGYYVMDPEKAVEMVDENTICVAAILGSTLNGEFEDVKMLNDLLVKKNEETGWDTPIHVDAAXSGGFIAPFLYPELEWDFRLPLVKSINVSXGHKYGLVYAGIGWCIWRSKEDLPDELIFHINYLGADQPTFTLNFSKGSSQVIAQYYQLIRLGFEGYRNIMDNCQENAMVLKEGLERTGRFNIVSKDQGVPLVAFSLKDSSRHDEFEISEFLRXRFGWIVPPYTXPPTRKHVTVLRVRLXRRTFSRTLAERLVLDVEKVLHELDALPARVVANGGDAAAASASEREMEKQREVISLWKRAVLAKKKTNGVC

SEQ ID NO: 4915 - protein, 353 aa, Saccharomyces cerevisiae
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEYVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHHKEALTTKDLKKLIWNEIFS

SEQ ID NO: 4916 - protein, 557 aa, Arabidopsis thaliana
  misc_feature (191)..(191): Xaa can be any naturally occurring amino acid
MQRFCVCSPSSYRLNPITSMATGSGSLIWFRKGLRVHDNPALEYASKGSEFMYPVFVIDPHYMESDPSAFSPGSSRAGVNRIRFLLESLKDLDSSLKKLGSRLLVFKGEPGEVLVRCLQEWKVKRLCFEYDTDPYYQALDVKVKDYASSTGVEVFSPVSHTLFNPAHIIEKNGGKPPLSYQSFLKVAGEPXSCAKSELVMSYSSLPPIGDIGNLGISEVPSLEELGYKDDEQADWTPFRGGESEALKRLTKSISDKAWVANFEKPKGDPSAFLKPATTVMSPYLKFGCLSSRYFYQCLQNIYKDVKKHTSPPVSLLGQLLWREFFYTTAFGTPNFDKMKGNRICKQIPWNEDHAMLAAWRDGKTGYPWIDAIMVQLLKWGWMHHLARHCVACFLTRGDLFIHWEQGRDVFERLLIDSDWAINNGNWMWLSCSSFFYQFNRIYSPISFGKKYDPDGKYIRHFLPVLKDMPKQYIYEPWTAPLSVQTKANCIVGKDYPKPMVLHDSASKECKRKMGEAYALNKKMDGKVDEENLRDLRRKLQKDEHEESKIRNQRPKLK

SEQ ID NO: 4917 - protein, 210 aa, Glycine max
MPSRRRTLLKVIILGDSGVGKTSLMNQYVNKKFSNQYKATIGADFLTKEVQFEDRLFTLQIWDTAGQERFQSLGVAFYLAFYRGADCCVLVYDVNSMKSFDNLNNWREEFLIQASPSDPENFPFVVIGNKIDIDGGNSRVVSEKKARAWCASKGNIPYFETSAKEGLNVEEAFQCIAKNALKSGEEEELYLPDTIDVGNSSQPRATGCEC

SEQ ID NO: 4918 - protein, 228 aa, Glycine max
MAAPSSSAAANIMLAISEKKTNSVDLYRPLRNYVAFHYSEREAQNLEYDLQTLKQLRSDVERHSDPSLPARRDLLQSYYKSLCLVETRFPISSDPDHVNALTFVWFDAFKPKQKASQQNIHLEKASVLFNLGAVYSQIGLSYDRNTVDGRRQASHAFIAAAGSFAFLRDNASLKASVGSSTTVDLSVECAGMLEKLMLAQAQECVFENTIAKGSTPGVYAKISRQVRC

SEQ ID NO: 4919 - protein, 421 aa, Xanthomonas oryzae
MPRSPPSCLHQPESAAVEMPMLSEPLIDFLTSGVARLGVWGMLAVLLVFTQLTIFAVTLYLHRSQAHRGVDFHPVIAHFFRFWTWFTTSMISREWVAIHRKHHAKVETEEDPHSPQSKGISQVFWRGVELYREARTQRADIEQYGKAAPTDWIERHLYTPHANAGPVALLVINSVLFGLPGIALWAVQMAWIPFWAAGVVNVLGHWWGYRNFESADTSTNLTPWALRIGGEELHTHHHAFPSSARFSMRRWELDIGWVVIRSVQAFGLAKVLRVAPSLDIRPNIAVLDADTLKPLLSHRFQAMTDYQRNVLKPALREEAAATGAKLRELLPRRLRKGLVDDGRWLKPEARAQLQTWVAQRPRMRTLVEYRARLTAVLEARSHDASERLRQLQQWCHEAEASGNAALQAYAARLKGDALSGA

SEQ ID NO: 4920 - protein, 444 aa, Oryza sativa
  misc_feature (143)..(143): Xaa can be any naturally occurring amino acid
MRMGKYEMGRALGEGHFGKVKLARHADTGAAFAIKILDRQRILAMKIDEQIKREIATLKLLKHPNVVRLHEVSASKTKIYMVLEYVNGGELFDKIALKGKLSEKEGRKLFQQLMDAVSYCHEKGVYHRDLKPENVLVDAKGNXKVSDFGLSALPQNQRKDGLLHTTCGSPNYIAPEVLLNRGYDGSLSDIWSCGVILYVMLTGNLPFDDQNTVVLYQKILKGDARIPKWLSPGAQDILRKILDPNPITRLDITGIRAHEWFRQDYTPAMPFDDDDDNNISDGNLHMTENQDIETSPAISQINAFQLIGMSSCLDLSGFFEKEDVSERKIRFVSNYSPTSLFEKIESTVTEKGFQVQKNSGKLKVIQVCKEPANPRGHGNLLISAEVFEINESLYVVELKRSSGDCSLYRQLCASLSEDLGICKRQQLLKKDSMRQDLCRYNSSF

SEQ ID NO: 4921 - protein, 140 aa, Magnetospirillum magnetotacticum
MLYPTYLRRSDPFALMRSMMRDLDRGFWPPARAAFPAVNVWQGPEAVGVTAELPGIEPGDIEISVKDNVLTLSGERKAPEVLDGARWHRNERSFGRFSRTIRLPFAASDDKVEARMTNGVLRIVISRPEEEKPKKIEGIL

SEQ ID NO: 4922 - protein, 411 aa, Unknown
  Synechococcus sp. PCC 7002
MLRKRLQAGLCSLLLVLVLVFGPMERAIAFTDEQDLLLQAWRYVSQAYVDETFNHQNWWLIRQKFLKRPLKTRDEAYEAVGEMLALLDDPYTRLLRPEQYRSLKVSTSGELSGVGLQINVNPEVDVLEVILPLPGSPAEAAGIEAKDQILAIDGIDTRNIGLEEAAARMRGKKGSTVSLTVKSPKTDTVRTVKVTRDTIALNPVYDKLDEKNGEKVGYIRLNQFSANAKTEIIKSLNQLQKQGADRYVLDLRNNPGGLLQAGIEIARLWLDQETIVYTVNRQGIFESYSAVGQPLTDAPLVVLVNQATASASEILAGALQDNGRAMLVGEKTFGKGLIQSLFELPDGAGMAVTVAKYETPLHHDINKLGIMPDEVVPQEPIGYAMMGSETDLQYQAALDLLTQDQRSPKFP

SEQ ID NO: 4923 - protein, 459 aa, Bacillus cereus
MNEHYDKQRQSLLGRDFNDNGERNEQAILHSQTVGSRGPVLEQDSVLHEALQEFIHEKILERPVHVKGFGAFGYFQTIYPMPEHTKLNFLQNANEKVPIMVRFSLAVSTKGTPDTARNVRGFSTKFYTKEGIFDLLCNHIPVFSVRDPMRFPETIQALSPSPKNNLIDPNRFWSFVARAPESIHFVVRLYSDNGTVKSLRHMPGHSVNTYVWRNAEGNRKYVKYHWYPFEGVQFITSEEANKLAAENPDYSGKDLYDAIANGKPVEYGLYVQLMDPKDEAHLSYDPLDDTKIWDEKVYPLIPVGKMVLNKNPENYMEQVEKVAFSPSNLLDGAELSDDKMLQGRANIYSDSQRRRIGPEFRKLAINQQQDWAPANQITSGDGRYVEGKLERTSITKQDDFTQAGEFYTKLKPIEKEHLAENLASDLKVISDDIRKVVLGYFHNVSADLVKKIESAMQKL

SEQ ID NO: 4924 - protein, 543 aa, Streptococcus pyogenes
MAKDIKFSADARAAMVRGVDMLADTVKVTLGPKGRNVVLEKAFGSPLITNDGVTIAKEIELEDHFENMGAKLVSEVASKTNDIAGDGTTTATVLTQAIVHEGLKNVTAGANPIGIRRGIETATATAVEALKAIAQPVSGKEAIAQVAAVSSRSEKVGEYISEAMERVGNDGVITIEESRGMETELEVVEGMQFDRGYLSQYMVTDNEKMVADLENPFILITDKKVSNIQDILPLLEEVLKTNRPLLIIADDVDGEALPTLVLNKIRGTFNVVAVKAPGFGDRRKAMLEDIAILTGGTVITEDLGLELKDATMTALGQAAKITVDKDSTVIVEGSGSSEAIANRIALIKSQLETTTSDFDREKLQERLAKLAGGVAVIKVGAPTETALKEMKLRIEDALNATRAAVEEGIVAGGGTALITVIEKVAALELEGDDATGRNIVLRALEEPVRQIALNAGYEGSVIIDKLKNSPAGTGFNAATGEWVDMIKTGIIDPVKVTRSALQNAASVASLILTTEAVVANKPEPAAPAPAMPAGMDPGMMGGF

SEQ ID NO: 4925 - protein, 716 aa, Yarrowia lipolytica
MGQSPSKNANSTSSLTTTNGQASGAGLGVISDEGGDDPSSSGCSGTSAHNKTPHHQKSSSSSTRPPTGRSRSSKSSTGGSRKERTSMSFDHDFSIDNASAADFMSKPKRRVSSGASKSAKTDMRHDPTGSERKSRRDKAEEAGLVAAMGEVVISRPHDSQSSSDTDNASLASTNSEGSTSSLTAPVAPIQNSNSEPGTAPGAHTEPISIPGNNDSLAHSKFLSAKRTPATTLPPPGSSGPVATPVIAVSHHDNNGSLTSNVTSEGSLSAISIASSSATSNASPENADKSKMSPQSSQSSSSSEEDLSDLSGLKSPIPTTHIGSSRANAVALSSKPSASTPQRVDLPAGYQSSLSVSVDSVTGSPARNIKNPKIEPAVSGASVASTASSKKATKKQPLPFDVNDFIKRLLDAGGKSGGAAPVPLRPNEIVQLCAAARTVFMSQPVLLELGTPVKVVGDIHGQFGDLIRIFQMSGFPPKTNYLFLGDYVDRGRQSLETILLLFCFKVKYPENFFMLRGNHECASITKVYGFYDECKRRATTKIWKSFVDTFNTLPIAATIGGKIFCVHGGLSPYLNSMDDIRKITRPTNVPDVGLLSDLLWSDPERSIMEWSENDRGVSYCFGRSVVNKFCTKFKFDLVCRAHMVVQDGYEFFNKRKLVTVFSAPNYCGEFDNWGAVMCVSKQLLCSFELLKPMDSASIKDAVRRGIKKTQKVKLGES

SEQ ID NO: 4926 - protein, 158 aa, Zea mays
MSLIRRSNVFDPFSLDLWDPFEGFPFGSGSSSSLFPSFPRTGSETAAFAGARIDWKETPEAHVFKADVPGLKKEEVKVEVEDGNVLQISGERNKEQEEKTDTWHRVERSSGRFLRRFRLPENAKTEQIRAAMENGVLTVTVPKEDVKKPEVKSIQISG

SEQ ID NO: 4927 - protein, 392 aa, Acridocarpus chevalieri
DLEPVNPADVPVTAAGALKSYKLAAKAISRLQSLPSGNIFLLCDVLVKEVRDLTGYDRVMVYKFHEDEHGEVVSECRRSDLEAYLGLHYPATDIPQASRFLFMKNKVRMICDCLAPPIKVIQDERLPQPLSLGASTLRSPHGCHAQYMANMGTIASLVMSVTINEDDDMMDGEQQQMARKLWGLVVCHHTSPRFVPFPLRYACEFLIQVFGVQINKEVELAAQVREKHILQIQTLLCDMLLRDAPVAIITQSPNVMDLVKCDGAALYYKKKFWLLGITPTEAQIRDIVEWLLEFHSGNTGLSTDSLMEAGYPGASVLGDAVCGMAAVSITSKDFLFWFRSHTAKEIKWGGAKHDPDDKDDGRKMHPRSSFNAFLEVVKWRSLPWEDIEMDAI

SEQ ID NO: 4928 - protein, 338 aa, Unknown
  Bradyrhizobium sp. BTAi1
MTAPEGTLESFLEGDCSVSEPLAITVTALAFVAETLAGVISSGPLNGRLGEEVGANSDGDRQKKLDVVADELFAGALAPTPVRWYASEERPTAEMLNPEGTLALAIDPLDGSSNIDVNISIGTIFSVFEAKESGVESFLRPGREQIAAGYVVYGPQTVFILATRTTLAQFVLHRGHFFLVSDSLRIPDRTTEFAINASNYRHWSRPIRAFVDDCIAGDEGPWGENFNMRWVASLVAETHRILTRGGIFLYPADARRGYGQGRLRLVYECAPIAFIVERAGGKATDGIDRILDLTPSELHQRTPLVFGTAEKVSQVCAYHDLPESEVSPLFGTRGLFRA

SEQ ID NO: 4929 - protein, 392 aa, Acridocarpus excelsus
DLEPVNPADVPVMATGALKSYKLAAKAISRLQSLPSGDISLLCDVLVKEVRDLIGYDRVIVYKFHEDEHGEVVSECCRSDLEAYLGLHYPTMDIPQASRFLFMKNKVRMICDCLAPLVKVIQDERLHQPLSLYGSTLRSPHGCHAQYMANMGTIASLVMSVTINEDDDMMDGDQQQMPRKLWGLVVCHHTSPRFVSFPLRYACEFLIQVFGVQINKEVELAAQVREKHILRIQTLLCDMLLRDAPVAIITQSSNVMDLVKCDGVALYYKNKFWLLGITPTEAQISDKVEWLLECHSGNTGLSTDSLMEAGYPGASVLGDAVCGMAVVGITSRDFFFWFRSHTTKEIKWGDAKHDPDDKDDGTKIHHRSSFKAFLKVVKWRSLPWEDVEMDAI

SEQ ID NO: 4930 - protein, 710 aa, Corynebacterium efficiens
MSANPGIPSSGTPEVNEPTTPVPPLPRKPDQATAEPYSPTGCPMHISPDVNAQQGEYLTTAQGGRLRDTDHSLKAGERGPLLMQDHHFREKITHFDHERIPERVVHARGAAAHGVFKANGAASSICRAGVFAEGKETPVFTRFSTVLGNRGSADTVRDTRGFAVKFYTDEGTWDLVGNNIPVFFIQDGIKFPDVIHAAKPHPDRDIPQAQSAHDTFWDFVTLHTEATHHTIWNMSDRGIPRSYRMMEGFGVNTFRMINDKGETSLVKFHWKPKLGVHSQVWEEAQITGGVDPDFHRRDLADAIESGAFPEWDLGLQVFPDNKEQMFEGIDLLDPTKIVPEELAPVQIVGTMTLNKNVSNFHEETEQVAFHPGHLPPGIDVTADPLLQGRLFSYLDTQISRLGGPNFAQLPINRPHAPVNDMFREGMHQQGQHIGVAPYQPNSLDGGNPFPAEPSNGALIDVPVPVEGEITRSAPASFDDHYSQARLFYVSLSPIEQKHVADAYTFELGKCYEKAIKERAVHVLSNVDHDLASTVAKGLGVPAPEKKDLPEPTPSPALSQVGKTWPIDGRQIGILVTDDLPEDQVADVASLSKAIEDAGMVPLVTSTSGGTIGEPEEATGVAVSRTYVTVRSIEFDAAVVVETPEQPEVSILLSEMIRHGKAVALVGDATAQVPDRMGDAPGVVTVNAAADALDVLTPMLKGHRTWAANPA

SEQ ID NO: 4931 - protein, 392 aa, Acridocarpus orientalis
DLEPVNPADVPVTAAGALKSYKLAAKAISRLQSLPSGNISLLCDVLVKEVRDLTGYDRVMVYKFHEDEHGEVVSECRRSDLEAYLGLHYPATDIPQASRFLFMKNKVRMICDCLAPPIKVIQDERLPQPLSLGGSTLRSPHGCHAQYMANMGTIASLVMSVTINEDDDMMDGDQQQMARKLWGLVVCHHTSPRFVPFPLRYACEFLIQVFGVQINKEVELAAQVREKHILQIQTLLCDMLLRDAPVAIITQSPNVMDLVKCDGAALYYKKKFWLLGITPTEAQIRDIVEWLLEFHSGNTGLSTDSLMEAGYAGASVLGDAVCGMAAVSITSKDFLFWFRSHTAKEIKWGGAKHDPDDKDDGRKMHPRSSFKAFLEVVKWRSLPWEDVEMDAI

SEQ ID NO: 4932 - protein, 395 aa, Legionella pneumophila
MVFGFLNLSFWGYVLATFILTQITIASVTIYLHRNQTHRALTLHPVVSHFFRFWLWLTTGMVTADWVAIHRKHHATTDVEGDPHSPVVEGIRKVFWQGAELYREARKDRDMVAKYSHGTPTDWIERNVYSRHSSKGILLMLLLDLFFFGIPGMTVWAIQMMWIPLFAAGVINGIGHYWGYRNFECPDAATNIIPWGFWIGGEELHNNHHTFASSAKFSVKWWEFDIGWMYIRILSLFGLAKVKKLPPKLAMDEGKFHVDLDTVRAVISNRFQVMSNYYKNVIRPILKYEKNTGIETKEDKKLFQRAGRLLRREDKLLSTKAKTRLQKLLDAREQLRVVYSYKQSLQNVWLKTATTQKELVEALQQWCRQAEESGLDVLKQFAQQLKGYVPVYTRE

SEQ ID NO: 4933 - protein, 392 aa, Acridocarpus smeathmannii
DLEPVNPADVPVTAAGALKSYKLAAKAISRLQSLPSGNISLLCDVLVKEVRDLTGYDRVMVYKFHEDEHGEVVSECRRSDLEAYLGLHYPATDIPQASRFLFMKNKVRMICDCLAPPIKVIQDKRLPQPLSLCGSTLRSPHGCHAQYMANMGTIASLVMSVTINEDDVMMDGDQQQMARKLWGLVVCHHTSPRFVPFPLRYACEFLIQVFGVQINKEVELAAQVREKHILQIQTLLCDMLLRDAPVAIITQSPNVMDLVKCDGAALYYKKKFWLLGITPTEAQIRDIVEWLLEYHSGNTGLSTDSLMGAGYPGASVLGDAVCGMAAVSITSKDFLFWFRSHTAKEIKWGGAKHNPDDKDDGRKMHPRSSFNAFLEVVKWRSLPWEDVEMDAI

SEQ ID NO: 4934 - protein, 222 aa, Brasenia schreberi
MGRGKIEIKRIENSSNRQVTFSKRKQGILKKAKEISVLCDANVFLILFSSAGKMYEYTSPSANLENILTRYQTASGKKLWDARHEYLNHELDRIKKEHDNMQIELRHLNGEDLSSLSVIDLRNLEDSLQIGYENVILKKTQWMYNELERLKQNGDAIDEENRRLRCLLKQQDAALCDLTDFDLGSNKKGKGNPSHLGMQPFGFHVQPIQPNLQHNKFKSGPC

SEQ ID NO: 4935 - protein, 392 aa, Acridocarpus zanzibaricus
DLEPVNPADVPVTAAGALKSYKFAAKAISRLQSLPSGNISLLCDVLVKEVRDLTGYDRVMVYKFHEDEHGEVVSECRRSDLEAYLGLHYPATDIPQASRFLFMKNKVRMICDCLAPPIKVIQDERLPQPLSLGGSTLRSPHGCHAQYMANMGTIASLVMSVTINEDDDMMDGDQQQMARKLWGLVVCHHTSPRFVPFPLRYACEFLIQVFGVQINKEVELAAQVREKHILQIQTLLCDMLLRDAPVAIITQSPNVMDLVKCDGAALYYKKKFWLLGRTPTEAQIRDIVEWLLEFHSGNTGLSTDSLMEAGYPRASVLGDAVCGMAAVSITSKDFLFWFRSHTAKEIKWGGAKHDPDDKDDGRKMHPRSSFKAFLEVVKWRSLPWEDMEMDAI

SEQ ID NO: 4936 - protein, 182 aa, Triticum aestivum
MSDEAASPPGGGGGGGGGGSDDGGGGGGFGGVREQDRFLPIANISRIMKKAIPANGKIAKDAKETVQECVSEFISFITSEASDKCQREKRKTINGDDLLWAMATLGFEEYIEPLKVYLQKYRETEGDSKLAGKSGDVSVKKDALGPHGGASGTSAQGMGQQVAYNPGMVYMQPQYHNGDISN

SEQ ID NO: 4937 - protein, 217 aa, Nuphar japonica
MGRGKIEIKRIENASNRQVTFSKRKQGILKKAKEISVLCDSQVSLILFSSAGKLYEYCSPSSSLKDVLTRYQKSSGKKLWDARHEYLSTELDRIRKENENMQIELRHFMGEDLSSLTVQELRALEDSLQIGFDSVHIKQTECLNNDIQILKKNERILEEENRQLKYILHQQEQSALRELRDIDLGSNKKGKGYPSQSGVQPFGFRVQPIQPNLQQNK

SEQ ID NO: 4938 - protein, 376 aa, Andropogon ternarius
ALSIAGAVQSQKLAVRAISRLQALPGGDVKLLCDTVVEHVRVLTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVLAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDNLADAGYLGAAALGDAVCGMAVAYITPSDYLFWFRSHTAKEIKWGGAKHHPEDKDDGQRMHPRSSFKAFLEVAKSRSLPW

SEQ ID NO: 4939 - protein, 154 aa, Lycopersicon peruvianum
MSLIPRIFGDRRSSSMFDPFSIDVFDPFRELGFPGTNSGETSAFANTRIDWKETPEAHVFKADLPGLKLEEVKVEVEEDRVLQISGERNMEKEDKNDKWQRVERSSGKFMRRFRLPENAKMDQVKASMENGVLTVTVPKEEMKKPDVKSIEISG

SEQ ID NO: 4940 - protein, 376 aa, Apluda mutica
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCLGDSTGLSTDSLADAGYLGAAALGDAVCGMAVAYITPSDYLFWFRSHTAKEIKWGGAKHHPEDKDDGQRMHPRSSFQAFFEVVKSRSLPW

SEQ ID NO: 4941 - protein, 571 aa, Candida albicans
MGNSPSKDDPLPKSSSSNKSSNGGSSSSSSTVSGTDLDPDEMAPALSQLMINDKLNYKKSNSPQRSSSLNVGNSTKYNKTSNNNSNKTNRVFELETSSTSVSATATTTPQRIPSVRSRQSSEAYDFDLEIGMSMAKLLKNQQDFPSSFESSNASVSSPVFTTLGVDTKDEDSLSSINSSPCDTTKSNVIANKQLSHPENMSTVKKLDVIDEINSLESSPSNSSKLSQANLRKHNKTLVHQLTKRISDSSTSSASGSPPLVGTSQKLEVDIDDIIARLLATKKRSTSRKSNKTRLPVETNELKYVLAKSRQIFLDQPTLLRLSPPVKIVGDIHGQFHDLIRIFNCCGYPPHSNYLFLGDYVDRGEKSLETILLLLCYKIKYPENFFMLRGNHESANITKIYGFYDECKRRLPNHKLWKNFIDVFNALPIAAVINEKIFCVHGGLSPDLNNFDQIENIKRPTDVPDKGLLADLLWSDPDASVKNFSLTNWPKNDRGVSYVFGKKHVDYFCSKFKLDLIVRGHMVVEDGYEFFNKRKLVTVFSAPNYCGEFNNFGAIMSVDKHLYCSFELIKPN

SEQ ID NO: 4942 - protein, 376 aa, Bothriochloa odorata
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCRATPVRVIQDPGLSQPLCLVGSTLRAPHGCHAQYMANMGSIASLVMAVIISSGGDHEQTGRGGISSAMKLWGLVVCHHTSPRCIPFPLRYACEFLMQAFGLQLNMELQLAHQLSEKHILRTQTLLCDMLPRDSPTGIVTQSPSIMDLVKCDGAALYYHGRYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 4943 - protein, 426 aa, Cryptococcus neoformans
MDNTPRHLFQTPNNVYILQQPWQFVKELGQGAYGCVSSARNSSTGETCAVKKVTNVFQKKILTKRCLRELRLLHHFRGHKNITCLYDMDIVFDPPGSGQFREVYLYEELMEADLHAIIRSGQPLSDAHFQSFLYQTLCGLKYIHSANVLHRDLKPGNLLVNADCELKICDFGLARGFQPGAVQTDQGQAGFMTEYVATRWYRAPEIMLSFANYTSSIDMWSVGCILAELLGGKPIFKGEDYVDQLNKILNLLGTPTEDTLRRVGSPRAQDYIRSLPIKPRVKFETLYPNASPLALDLLSKLLTFDPAKRYGCEEALEHQYLAVWHDPADEPLCEVPFDFSFEEEDSVSGMRDLILEEVRSFRYLVRQQSMPPARKDSHELPPAPPAPQHPGAGVGPAFHERANSEGDMEEHPGSALEKQLERQKLS

SEQ ID NO: 4944 - protein, 342 aa, Glycine max
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGSSNIDCGVSIGTIFGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 4945 - protein, 675 aa, Mesorhizobium loti
MCGIAGIVALNAAAASPSREALMRMVGTLAHRGPDEHGLYRDKRAGLAHARLSVVDLSSGQQPLADTGDTSWIVFNGEIFNYVELREKLIALGHRFRTRSDTEVALHAYRAWGEAAFERMNGQWAIAIWDSIAGRLVLSRDRFGICPLHFCEHAGRLYFASEVKAIFAADPTIPRAFDPAGLDQTFTLWTVVPPQGVFQGIHELVPGHVRIYQDGTVREQVFWQPSYPENIGALQGEFTGSCDDAVDRVRDALEAATALRMVRADVPVGCYLSGGLDSSLVATLGRRFAGRRFQTFSLRFADAEYDETRFQRLVAEATGSEHHEVVVSRGDIAAIFPEVIHHTERPILRTAPAPLFLLSRLVRERGIKVVLTGEGADEMFAGYDLFREAKVRRFWGRQPASTRRSRLLERLYPYLTRSPVQQQAMARQFFGRGIEAYDAPGFAHDTRWRSTGAIKRLFSADLRAESQRRDAVSELLARLPAAFSRWSHLAQDQYLEVQTLMSGYLLSSQGDRMLMAHSVEGRFPFLDDELVRLANSLPPSYKLRVLDEKHVLKRVAQPIVPSEIVTRKKQPFRAPNALCFAADAAPEYIREALSETAIRKANVFDPVSVTRLLDKCQARTGDGDLSNADNMALVGVLSTQLLHQQFVASCPSATHVRGLSVDVDREHREERLHVA

SEQ ID NO: 4946 - protein, 371 aa, Pyrococcus furiosus
MKFPRKGIPQEEVMRELEKYTSKDLSFSSGKILGSMCTLPHELAKEVFCMYMDRNLGDPGLHPGTKKIEEEVIEMLSDLLHLERGYGHIVSGGTEANILAVRAFRNLADVENPELILPKSAHFSFIKAGEMLGVKLIWADLNPDYTVDVKDVEAKISENTIGIVGIAGTTGLGVVDDIPALSDLARDYGIPLHVDAAFGGFVIPFAKELGYDLPDFDFKLKGVQSITIDPHKMGMAPIPAGGIVFRHKKYLRAISVLAPYLAGGKIWQATITGTRPGASVLAVWALIKHLGFEGYMEIVDRAMKLSRWFAEEIKKTPGAWLVREPMLNIVSFKTKNLRRVERELKSRGWGISAHRGYIRIVSHASCDGGHD

SEQ ID NO: 4947 - protein, 399 aa, Ashbya gossypii
MSFSSLPTKELRNTALFKPLKVGNTTIQHRIALAPLTRLRTTNPEHIPTDIVREYYDQRSKRPGTLVITEGTFPSASTAGMNDVPGIWSAEQASEWAKIFKVIHDNKSFAWVQLWVLGSQNDPSVIAKNGLRNDSASDDWYPSDGVRDLAKQLNVPSRAITKDQIKEYIQIYVSAAKRAIEAGADGVEVHSANGYLLNQFLDSVSNKRTDEYGGSIENRARFTLEVLDALAEAVGPEKVGVRFSPYGTFGNMAGTVDPNTVAQYAYIAGQLEKRAAEGKRLAYIHVVEPRVTDPSVEEGQSVYNGGTNDFFYSVWKGIILRAGSYAHHLDAAVRDAELGRTVIVYGRYFISNPDLPDRLEKGLPLNNYRRELFYTNEAEGYIDYPVYEEAVAKGYKQQS

SEQ ID NO: 4948 - protein, 629 aa, Novosphingobium aromaticivorans
MCGIAGIVHTEGPKPVDPDRVRRMCDAIAHRGPDGEGVWTAPGIGLGHRRLSIIDLAGSPQPMKAAEGDAVIVFNGEIYNFRDLRKELQALGAQFRTDGDTEVILQAWRQWGTACLPRLHGMFAFALYDLRQRTTLLARDRLGVKPLFTARLADGAVIFGSELKALLAHPSLRREIDPLAVEDYLAWGYVPDHRSMLKGVEKLPAGHYQLLRHDAPPAAPVQWWDVSFADRANGSAEDLGAHLLHHMRDAVTSRMVADVPLGAFLSGGVDSSSVVALMAEASATPVKTCSIGFDVAALDETAYADRIAARFATEHRKRLVSPDDFSLVDRLAGMFDEPFADASALPTFRVCELAREHVTVALSGDGADEAFAGYRRQTFQHREEQARALLPSALRKPLFGTLGRLWPKADWAPRPLRAKTTLLSLAASGEEGYARALSVTSPELRETLYTPDFKRLRGDYRAEQPLIELMRKAPARSGLDRAQYADLKFYLPGDILTKVDRTSMAVGLEAREPLLDHRLVEFGASLPERLRVRGATGKWLIKQTMRRYLPEDVLFRPKMGFVTPLAQWLRGPLAHEARALASDGLLARTGWLDAARIDALADAHVSGRADHSRLIWQLLMLRKSLQLLG

SEQ ID NO: 4949 - protein, 392 aa, Camarea axillaris
DLEPVNPADVPVTAAGALKSYKLVAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNEDDDTMDGDQQHMTKKLWGLVVCHHASPRFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLEYHSGNTGLSTDSLMEAGYPGASGFGDAVCGMAAVSITSRDFLFWFRSHTAEEIKWGGAKHDPDDKDDLRKMHPRSSFKAFLEVVKWRSMPWEDVEMDAI

SEQ ID NO: 4950 - protein, 392 aa, Heteropterys aureosericea
DLEPVNPADVPVTAAGALKSYKLASKAISRLQSLPSGNISLLCDVLVKEVMDLTGYDRVMVYKFHEDDHGEVVSERRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGASLYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVQWRSMPWEDIEMDAI

SEQ ID NO: 4951 - protein, 749 aa, Unknown
  Nocardioides sp. JS614
MSDKSTPRTTSEPAPASGPALHPVSTAELHQVAHGEHGNPHGVLGPHPHDGGVTVRVLRPLASRVVVRWSDGSGTSGEAELAHEHEGIWAGVIALPDVPDYRVAVSYGPDEHVVDDPYRFLPTLGEMDLHLINEGRHELLWTVLGARVHRYPGALGPVTGTSFAVWAPSARAIRIKADFNSWDGREHPMRQLGTSGVWELFVPDVGAGTSYKYTILGPDGQWREKADPMARWAEKPADTASRVFESGYTWNDDVWLEARARRAPVASPMSIYEMHLGSWKKHPDGRYWSWAELAEELPAYVAGLGFTHVELMPVMQHPFGGSWGYHVTSYFAPDARFGDPDGFRLLVDRLHQAGVGVILDWVPGHFATDEWALARFDGTPLYEDPNPQRGWHKEWGSHIFNFGRREVRNFLYANALYWLEEFHADGLRVDGVASMLYLDYAREPGEWTPNIHGGHENLEAVQFLQEMNATVYKRVPGITTIAEESTSWPGVTRPTSADGLGFGFKWNMGWMHDTLDYLAREPVHRAYHHGEMTFSLVYAWSENYVLPISHDEVVHGKGSLLRKMPGDRWQQLANLRAYLGFMWAHPGKQLLFMGAELGQESEWAESRELDWWLLDHPEHRGVQALVRDLNATYVDSPALWARDHEPEGFTWIDANDAGRNVFSFVRRGGDADLVCVSNFAAVPHDDYRLGLPAAGVWDEVLNTDAETYSGSGVGNLGSVTAVEGEWSGQPAHATLVVPPLATVWLRRRH

SEQ ID NO: 4952 - protein, 711 aa, Novosphingobium aromaticivorans
MSSNLYPHLLSPGRIGTLEVKNRIAVTAMGVSLSEDDGTVGERIIAYHEEQARGGAGLIISGVAGVAWPVGAVAMQQTAISDDRFIPGLRKLTDRVHAHGAKIATQLHHGGFVAGYSHARWGHPLWGPAVPPAAKGNFTDYFLMEELAGLAGMKMPELKILEQEDIDVAVQQFAQGARRAKEAGFDGIEIHGGHGYLLSSFTSPYTNTRTDKYGGSLENRLRLTLEVIAAIRAEVGRDYPVWIKLDSREVGKPGGITLDMAKEAAKLVEAAGVDAITITSYHDTSVGKLHSESNIPHLENWNLPATAEIRKVVSIPVIGSGRIEVDSAESAIAKGETDFVAMGRKLLADPHLPRKLTEGATEKVRPCVYCYTCVSAIYMGQPTRCAVNAGLGNEFEGEPPMAGANPRRVAVIGGGPGGMESARRLAALGHKVTLIEKSDRLGGTLRFASLAYEPNERILEWLRREVKEAGIDVRLSTVATPDLLRSIGADAVIVATGAIRDMPPIPGNDQDHVYSGDDMRRMMLGESSEELKRKTGLFTRIATKVGAATGATANLALVRKATHAWMPLADTVTIVGGELVGLELAEFLSERGRTVNVVEEAPRMGKGLTLVRRMRLMAELAEHGVGLHAGASDIVIGKDSVSFTDASGARQTVPAGNVVVAKGAHGDLSLAEALRAAGFEVHAIGDANGVGYIEGAMHGARGAVRAVAGAA

SEQ ID NO: 4953 - protein, 770 aa, Unknown
  Silicibacter sp. TM1040
MKAPLRKLLQSKGILSQIVVSMSLAALLVVVAVGGVARRYEVERVSEQLSEQANLTVSLLSGLMLEAIIVEDVPVLETGLVEAITRYPKILSINIENSEGEVIAEASNSAADEAEGYVMYRRPVEFEGFVFGTMVVQWSTAEGREIVLDKVRQTITWTVLAVIAMSLLMLYLVYRLALNPLQIVHARMSNAVAGAKTGHFSLPWYSSREFQALNVSVGVLEDSFAERDEREKALEHAREQAEIASRAKSEFLANMSHEIRTPMNGVIGMAEVLRETELTPDQELYTETIVKSGNALLSIINDILSFSKIEAGKLELTQATFNLRTVIEDVIMLLAPKAAEKWVQLTLRYDPDLAEFYDGDAGRIRQIVTNVVGNAVKFTSRGSVHIDVTGVARGQLMDLRISVVDTGIGIPAEKLDRIFHAFEQVDGAATRNFEGTGLGLAISTRLLQMMKGRIHVTSSEGKGSVFTIDISLPTSDRAPVAFLPEQPVSGLHALIVDDLELNRRILGERLRSWGLRVTEAASAMEAMLHLDEMRDATDTCDLIFLDYNMPDCDGYELALRIRGLPNTASVPIIVISSVDPALSQSMLADIEVCHQVLKPVRADDLRGVISQALGAGSAVEERAPSGSEDAKIMQRIKVLMAEDNRTNQVVVTRMLKSESVDIIIASNGQEAIEMYLRERPDVILMDMMMPVMDGLDATKAIRKIENETGVRQVPIIALTANALQSHEEACLEVGMDDFLSKPIRKQALLDALHQWTEDRDSAEPQNKLEA

SEQ ID NO: 4954 - protein, 180 aa, Rubrivivax gelatinosus
MSFTTEQQPGVCEQAPAATKGFTLNHSMLRVKDPKVSLDFYTRVLGMRLLRKLDFPEMSFSLYFLAQAEEAAMAPQDVGERTAWTFAQRGILELTHNWGTENDTEFKYHDGNAKPQGFGHICISVPDLDAAVRWFDENGVTYVKRPEQGKMKDVAFIKDADGYWIEIVEPARLAKLGRPA

SEQ ID NO: 4955 - protein, 392 aa, Heteropterys bahiensis
DLEPVNPADVPVTAAGALKSYKLASKAISRLQSLLSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTNPRFVPFPLRYACEFLIQVFGVQINKEVELAAQVREKHILQIQTMLCDMLLRDAPVAIITQSPNVMDLVKCDGAALYFKNKTWFLGVTPTEEQIRDIAGWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDIEMDAI

SEQ ID NO: 4956 - protein, 217 aa, Nuphar japonica
MGRGKIEIKRIENASNRQVTFSKRKQGILKKAKEISVLCDAQVSLILFSSAGKLYNYCSPSSSLKDILTRYQKSSGKKLWDARHEYLSTELDRIRKENENMQIELRHFMGEDLSSLTVQELRALEDSLQIGFDNVHVKQTECLNNDIHILKKNERILEEENRQMKYILHQQEQMALRELRDIDLGSNNKGKGYPSQSGVQPFGCRVQPIQPNLQHNK

SEQ ID NO: 4957 - protein, 392 aa, Heteropterys bicolor
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSATINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDAVCGIAAVSITSRDFLFWFRSHTAKEIKWGGAKHDPDDKDDLRKMHPRSSFKAFLEVVKWRSMPWEDMEMDAI

SEQ ID NO: 4958 - protein, 560 aa, Zea mays
GPNPPHSVTPPAMEAATAATAAMMWFRKGLRVHDNPALDAARRHGVGAASARLYPVFVLDPRYLRPDPVAASPGSARAGVARIRFLLESLSDLDARLRRLGSRLLLLRARDDVADAVCAALKDWNIGKLCFESDTEPYALARDKKVTDFALASGIEVLTPVSHTLSDPEEIIKKNGGRPPLTYQSFVSIAGEPPAPAMEEYSELPPLGDTGEYELLPVPTVEGLGYGDISQEEIPPFHGGETEALRRMKESLQNKEWVAKFEKPKGDPSAFVKPSTTVLSPYLKFGCLSSRYFYHCIQDVHRSVRNHTKPPVSLTGQLLWRDFFYTVSYGTPNFDRMKGNKICKQIPWSENEDLFVAWRDGQTGYPWIDAIMIQLRKWGWMHHLARHSVACFLTRGDMFIHWEKGRDVFERLLIDSDWAINNGNWLWLSCSSFFYQYHRIYSPITFGKKYDPNGNYIRHFIPVLKDMPREYIYEPWTAPTSIQKKANCIIGKDYPKPVVDHETASKECRKRMGEAYASSRVDAKPSKGKTLNSRRKMLHGDRDTSNSTIAKRLKRNSRVE

SEQ ID NO: 4959 - protein, 463 aa, Novosphingobium aromaticivorans
MGHHADDVFRPVRTHRRPLVLPPPPAALLVRHRPQQAAGGRPQDALAGRAALSRQLPRPVPELEDLLGTPGTAARRPGRTARPAREIHRDHAPRRPPAPPARAELTDMADLFSPVRLGEIELANRIVMAPMTRDRAGPHDEPTDLMVEYYRQRASAGLIVTEGTQPSPNGKGYWRTPGIHSPEQVEGWRRVAEAVHGEGGRIAVQLMHVGRASVRANKAPDAETVAPSAIPCPDPIPGPDGVPVPTEMPRELAAHEIPGVIAEYVAAARNARAAGIDGVELHCASGYLPMQFLSSNSNQRGDAYGGSAENRVRFVVETLSALAAAISPGRVGFRICPGVKFNGMDDADPAETYATLLRAVDHMGLAYCHLIHIPNQGFDSLDLVRANWSGPVIENCGLTRERAEKVLAEGKAEAVSFGYAFIGNPDLVERLRTGAPLAKADRDTFYTGHGDDARGYTDYPRAG

SEQ ID NO: 4960 - protein, 392 aa, Heteropterys byrsonimifolia
DLEPVNPADVPVTAAGALKSYKLASKAISRLQSLPSGNISLLCDVLVKEVRDLTGYDRVMVYKFHEDEHGEVVSECRRSELESYLGLHYPATDIPQASRFLFMKNKVRMICDCLAPPVKVIQDERLPQPLSLCGSSLRSPHGCHAQYMTNMGTIASLVMSATINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHGGNTGLSTDSLMEAGYPGASVLGDAVCGMAAVSITSRDFLFWFRSHTAKEIKWGGAKHDPDDKDDLRKMHPRSSFKAFLEVVKWRSMPWEDIEMDAI

SEQ ID NO: 4961 - protein, 414 aa, Triticum aestivum
MAFDAFTDKTAVFRRLKAKPENKMCFDCNAKNPTWASVTYGIFLCLDCSAFHRSLGVHITFVRSTNLDSWTPDQLKMMAFGGNNRAHAFFKQHGWTEGSGKVDSKYTSRAAELYRQILQKEVAKSSTVNVLPSSPVAASQPPNPTDDFPDFKLADAPEETTNGKHEPLVANPPKEPAQAPKAPTHPTYVSSVKKPLGAKKLGAKTGGLGVKKLTTKSNESLYDQKPEEPKPALPTMTTTTSAAKSGPSSHSRFQYMENEPSTESKTGGGNKTGHVAAPKTSDFFHEYGMDNGFQRKTSTAASKTQIEETDEARKKFSNAKAISSSQYFGNTDREQKEAQLSLQKFSGSSSISSADLFGRDTNDSDLDASAADLINRISFQASQDLSSLKNMAGETGKKLTSFASNFITDLDRIL

SEQ ID NO: 4962 - protein, 437 aa, Brassica nigra
GVDFFHRYKEDIQLMKNLNTDAFRMSIAWPRIFPHGRKEKGVSQAGVQFYHDLIDELKRNGITPFVTVFHWDTPQDLEDEYGGFLSERIVKDFREYADFVFQEYGGKVKHWITFNEPWVFSHAGYDVGKKAPGRCSKYVKEECHDGRSGFEAYLVTHNLLNSHAEAVEAFRQCEKCKGGKIGIAHSPAWFEPHDLADSQDGASIDRALDFILGWHLDTTMYGDYPQIMKDIVGHRLPKFTEAQKAKLKNSADFVGLNYYTSMFSNHLEKPDPAKPRWMQDSLINWETKNAYNYSIGSKPITGALPVFARGFRSLLKYIKDKYGNPEIMIMENGYGEELGAADSIEVGTADHNRKYYLQRHLLSMNEAICIDKVNVTGYFVWSLLDNFEWQDGYKNRFGLYYIDFKNNLTRYEKESGRYYKDFLSQGVRPSMINRDEL

SEQ ID NO: 4963 - protein, 442 aa, Agrobacterium tumefaciens
MIRKVSLLLIGGLMGATAMSVIYSASMPAQAAGPSTYKELSIFGDVFERVRAQYVTPPDDEKLVENAINGMLSSLDPHSSFMNAKDANDMRTQTKGEFGGLGIEVTMENELVKVISPMDDTPASRAGILAGDYISEIDGTPVRGLKLEQAVEKMRGAVKTPIKLTVIRKGADKPLEFTVVRDVIAVRAVKSRVEGDNVGYLRVISFTEKTYDDLEKAIKKIKADVPADKLKGYVLDLRLNPGGLLDQAINVSDAFLERGEVVSTRGRNPDETRRFNATAGDLTDGKPVIVLVNGGSASASEIVAGALQDLRRATVVGTRSFGKGSVQTIIPLGEAGALRLTTALYYTPSGKSIQGTGIEPDIKVEQPLPAELQGRVTAEGESSLSGHIKGQSETDEGSGSSAYVPPEAKDDIQLNYALDLLRGAKTDPSFPPNPDKAVVNKQ

SEQ ID NO: 4964 - protein, 538 aa, Wolinella succinogenes
METSKRLRILYVEDDALIREATLPVLERFALEVFSAQNGEEALKFFREKRPNIIITDIRMPVMDGLAMARLIKTESPYVPIIFVSAHNDTDQLMEAIDLGADAFLVKPFSLQKLREILRKFDRYIAEQEETKRSQRLLEEYKKAVDASAILSISDLSGNIIFANEKLCEITGYTREELLGHPHSMFRHPDTPKEVFERLWSTILEGKIWKGMLKNRKKNGEPYYVDATVVPLMDENNQITQFLGLCYEITSLIRAQNALRVALKRAEEADRVKGVFLANMSHEMRTPLNGIIGFGRLLLEENLNQEQREYVEIIDKSGEHLLGIINDILDLSKIESGKFELESLPMKLSEELRAVADFCEVKAREKGVKLLCLFKEIEGLIIQGDVMRLKQVTANLLGNAIKFTPEGGEVRLGVEVLEEREEAIALDFSVSDTGIGIAPEYLEKIFRPFEQAESSTARNYGGTGLGLSISQELVRLMGGEMRCQSEEGKGSRFSFTLTLPKAKGLTQAEREIPKEAFLMARCWWRRTILPIKSLFASF

SEQ ID NO: 4965 - protein, 376 aa, Chionachne koenigii
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVVQDPGLSQPLCLVGSTLRSPHGCHAHYMANMGSIASLVMAVIISSGGDDEHTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAATLGDAVCGMAVAYITPSDYLFWFRSHTAKEIKWGGAKHHPEDKDDVQRMHPRSSFKAFLEVVKSRSLPW

SEQ ID NO: 4966 - protein, 376 aa, Chrysopogon fulvus
ALSMAGAVQSQKLAVRAISRLQALPGGDVKLLCDTVVEHVRELTGYDRVMVYRFHEDEHGEVVAESRRDNLEPYLGLHYPSTDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 4967 - protein, 910 aa, Legionella pneumophila
MLKSIGIKYQLRITTLIPAFLVALLFAFFYNGLFGKDLKQHMSRLGEAYIRQLLPAAQYAMLRNDYRTLQGLINASTINPEVKALAFYNADGRLIAYRGGKHSIHKPFNPPDYTGDYIESKQINPFTINFIAPITIPKFNLYSSTEFKEPSTPKIFQADDILGWLSIDIDTQSLLIKRYQMLIVTIFITLFGLLMGLTIHYFLSKRIYMPIARLRRSMKQILSNEFETEIRVSSPGELGIIEKGCAHLQRQYLNTVRDLNHHIEIATADLQQSLELLEEKNIELSLEKKKTEEKSRQKSEFIANMSHEIRTPMNGVIGFTNVLLESKLDPLQLDYVKTIKSSAQDLLSIINAILDFSKIDAGKLNLDCIPLDVRGCIDEVLSLASPNAHKKVIDLIPITDINVPKMVLGDPLRIKQIISNLVTNAVKFTDHGYVLIRTKIEQETDKDYTLLFAITDTGIGISPEDQTKLFTAFNQADTSITRRYGGSGLGLVICKKLCEEMHGRISLTSEINKGSTFSARIKVEKLVAYEIEKNQTHRFAHLKIICFDDNPLHLEAIGNGLGFWGIEAIRVDSFNKLSRTLTKHKDCKIAFINVNQGCERQAAELIAKHKQIPFVLISKWPINDFAALGARGFLYKPISIQKLQDLIESIANENQTEKNTNQELDTLREQLRFLHPEILIAEDNPVNKMLLTSLLNNNANITTVDDGEMAVTACEDKKFDMILLDLHMPKLNGLEAAKMIRQKSLMNKHSPIVLITASSSDLSSIDMKKSGVDFCFQKPIDEKQLLIQILRIVDKIKHAAIDWQLCVQKVSGNQALAEEFLAKFIEELYKNREEFIGLMHQKNVKGLADLAHKLHGACCFCGVPILQKRVAQLEKLARRTANADNLSEAFTDLIQSIDAVISEYENQYSQ

SEQ ID NO: 4968 - protein, 287 aa, Arabidopsis thaliana
MGDKNKDDSSSQSKAVRKEKRAFLFRKWTRVDVMRVSAVGAVHLLCLLAPFNYTWEAFRFAAMVGISTNLSITFSYHRNLTHRSFKLPKWLEYPFAYSALFALQGHPIDWVSTHRFHHQFTDSDRDPHSPIEGFWFSHVFWIFDTSYIREKCGGRDNVMDLKQQWFYRFLQNTIGLHILTFWILVYLWGGLPYLTWSVGVGGAIGYHATWLINSACHIWGSRAWNTKDTSRNIWWLGPFTMGESWHNNHHAFEASARHGLEWYQVLGLATDVKLPTDAQKRKMSLAR

SEQ ID NO: 4969 - protein, 482 aa, Lactobacillus gasseri
MAEVEPNNSHQKKTTKNKKKHLPKYAQFLLTGIAGAAIGAGLTFGIMEVKELKSPFYQVEKVYEQLQGSYYKKVSSQTLRQGAINGMLDSLNDPFSEGLSGANQEQVNNILEGSTFGGVGIQMAVRNNKVVVDSIVANSPASKSTIKPGDEIVAVDNKKVSAAQFTKVASLVRGKVGTKVTLKLKRANSTFSVTLKRAKISQSSLTKRTEGNATIITITQFDVNTAKDLKVALKSINTKKYPKLIIDLQDNPGGEMNAALKSASYFLPNNKIIMQYKDRKEKEVIRSDKKLSGGFHTSLKPIILINGNTASASEIFTAALVQNHCGVSVGQTSYGKGTVQQVGQTEDSEYKYTVAKWLTPNGTWINQKGLKPTYPVSESPLAKLPQFQSMSILKRSMTGVDVATLQQYLTALGYLPKHVTGVFDDETKNAVIKFQKEHDLTTDGIVNGQVQAQLYLAVAQKLQDDNPALKKALSLNLKDMED

SEQ ID NO: 4970 - protein, 376 aa, Chrysopogon gryllus
  misc_feature (240)..(240): Xaa can be any naturally occurring amino acid
ALSIAGAVQSQKLAVRSISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVVISSGGDDEQTGRGGISSAMKLWGLVVCHHTSPRCIPFPLRYACEFLTQAFGLHLNMELQLAHQLSEKHILRTQTLVCDMLLRDSPSGXVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 4971 - protein, 1190 aa, Xylella fastidiosa
MRCLKRVRGGLLTALLVFVSLLTATAAVPEMPRFRVLDATSGLPSNVVRAMLQDAAGYLWLATSDGLARYDGTAFKVWRHDPNDPGSLPGDSVLALYIDVQDRIWVLSENAGLAVLDAQRRRFIQIPVGSVAKTDALHTLTGHGDAIWLSDLHASVIRIDSAGALTRYALADVSPTLKDTPVVALTFDANGRLWVGTPDGLLYFEAGRLHLAPPPLDKASIHSIAAVGSRLWVGSTDGVYLQDAEGRWRVPNWGPMFAFGNLLLSVADAGDGEFWLGSERGLWRTRQERPPVQIPLSDMHHGVSTVSSLWRDTSGGLWVPVYGRGLGYLRQDWKRMAVVRPSDSGESAYCNVAPAAYSGGLWQLNRIGELMHLNTSTGELVHTGWQRHELRGVNITTTLEDSRGRLWLANMQNGLSRLDLKNGQWREWAAHGDDAVPLYGPISWIVEMPDSSLWLEALGVLQQRDLESGHVLNQIVPGSHGVDGSRVEQIGLGPDGRLWLAAGSGVYAWESQRRMFVPIPDLTGTRAYSFVPVGGNEVWVHRLRGLEQWRHSSHGWKRIALVGPQHGLPAMESLGMQHDAQGRIWLSTRRGLWRIDNTDELQVRNFGLRDGLGTQEFAEACLWMAPDGVLVGGTTDGYLMLFDTAMPDPAPFVPQLRMETVSVIRAGRRIDLPVDQPFELLPNDRQLIVGARLLSFGDPLSNRYSYWLKGFDTGWIDQGSSGTREFSSLPPADYTLLIQGTDPMGNLSRIHLVTFRVLPPWWRSAWGMSVLTGSGLLLLWGVAWNYHRRLRRRARLQLEQHQREVAERASLAKTQFLATLGHEVRTPMTGVLGMSELLLETPLDTRQHGYATSIQAAGKHLLRLVNDALDLAKIEAGKLSLERRDFDFHALLEQVVAMIRPMVERKGLRFVYRLDPEVPQYVHGDADRLQQILLNLLINATKFTEHGEVVLQVAPGQEQACLGVRIDVADTGPGLSEEQCQRLFRRFEQVNGASTVARYGGSGLGLAICRELATVMEGEIHVDSELGKGTCFRVLLPLPWVLAVQPEVAVMDMEPSPCSNPLHLLLIEDDPTVAEVIVELLRVRGHRVTHALHGLEALVEVTLTRFDVCLCDLDLPGLDGAGLIVQLRAQGQSFPIVVVTARTDADAQRQAFHVGCDAFLRKPVTGEMLEQVLTQVLSAPRQDADVDTPT

SEQ ID NO: 4972 - protein, 376 aa, Cleistachne sorghoides
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISGGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 4973 - protein, 376 aa, Coelorachis selloana
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSSMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 4974 - protein, 431 aa, Picrophilus torridus
MNLFIFRRDLRLYDNTALLKSLNNETATIFIMDPAQVKNNEYRSEKALNFMISSLYDLMTDIEGNHGKLAVFHGDPVDVLKRLVNRENINEIYINRDYTPFSIKRDERIKEFSIKNNIKFNALDDYFLSDPELRTGSGSFFKNFTAFYNRAMEINVKKPVYEIKKSNLIPIDGDDMELKYNNYGRKTAIEKMHNFIKNDYSLRDFPELNMTSFLSADIKFGNISIREAYHYIKDPEFRRQLYWRDFYLYIAYHFPYVFGSNFNRKYNIKWENKEKYIDAWKNGLTGYPIVDAAMRSLNETGYINNRLRMIVSSFLVKDLHVDWRIGEKYFAQKLIDYDPASNNGNWQWVASTGVNSRGMYRIINPWIQQKKFDPECKFIKRYVNELSDLEPEIIHNLYKIRLNNYPAPLVDHKTAVMEFRKLINQTPTYLS

SEQ ID NO: 4975 - protein, 794 aa, Psilotum nudum
GSIGSLVMAVIVNDNDAEPSGRGNQPKNRRLWGMVVCHHTTPRAVPFSLRSACEFLMQVFGLQLNMEIELAAQMREKHILRTQTLLCDMLLRDAPIGIVTQSPNIMDLVKCDGAALYYGKKFWLLGTTPTEAQIKDLADWLLDVHRDSTGLSTESLADAGFPGAAALGDAVCGMAAVKITPRDYLFWFRSHTAKEIKWGGAKHNPDDKDDGKKMHPRSSFKAFLEVVKWRSSPWEDVEMDAVHSLQLILRGSFQDIDDSESKTMIHHRLNDLNLHGMDELSTVANEMVRLMETATAPILAVDSSGFINGWNGKAAELTGLPLEDAMNKSLVRDLVVDESVSTVERLLYLALQGEEERNVEIKLKTFGTQADKGPVILVVNACASRNITANVVGVCFVGQDVTGEKVVMDKFTRIQGDYRTIVQSPNPLIPPIFGSDEFGYCSEWNPAMVKLSGWKMEEVLGKMNVGEIFGSEMACCRLRGQDAMTKFMIVLNSAMGGQDSDRFPLGFFDRQGKYVEALLIANKRTDGAGAITGVFCFLHIASAEVQQALQVQKRSARTALDKLKEVAYMRQEIRNPLYGIMFTRRLLEGTNLSEEQKQIIDTSAVCEKQLHQILDEDNFENLDHGNIDLDTIEFTMGTVMDAVISQGMIRSREKGLQLIRETPVDIKNMRLYGDQLRLQQVLADFLTTAVRFTSSSDGWVGIKVVPTMKGLGGGLHVMRFDYRISHPGKGIPEDLVQQMFDCSREITQEGMGLSVSRKLVRLMNGDVSYIREAGVCYFLVNVEFPLADRDDSQN

SEQ ID NO: 4976 - protein, 726 aa, Thiomicrospira crunogena
MMNQTVTEEAVRRLAEGTHHDPFQILGCHAVGKKWEVRVWLPTAESASVEGWHALTRVEGTSLFIASLTEKQKKALPLHFKVNWVEANGSEHTVVSPYTFLPQLGELDLHLYAEGRHWHVYDVLGAQVKEVDNISGVQFSVWAPAASRVSVVGDFNGWNGLRHPMRTNGQSGVWELFIPGMVSGDIYKFEIRNYQTDQLLVKTDPYAKAMEFRPQTGSIVYDSTFQWQDRDWLAARAHFDWQASPINIYEVHLGSWQRDHDGFFLNYKEIAQRLVEYVKWMGYTHIELLPISEHPLDESWGYQTTGYFSPTSRFGSPDDFRYFVNYCHENGIGVFLDWVPAHFPKDEFALARFDGTALYEHEDPRRGEHQDWGTYIFNYGRNEVRNFLIANALYWLKELHIDGLRVDAVASMLYLDYSRKDGDWLPNQYGGRENIEAIEFLKTLNAEVHAQCPGALMMAEESTSWPMVSRPTWMGGLGFSMKWNMGWMNDTLDFFQQDPIYRPYHHNQLTFSQMYAYSENFILPLSHDEVVHMKHALVSKMPGDTWQKMANMRLLMGYQTLNPGKKLLFMGGEFAQWQEWSESRGLDWYLCEQPANRGVQMLVRDLNLLYQTSPALYCHDFDQEGFEWIDCHDYEQSVLSFVRISEKESLICVFNFTPVPRYDYRIGLPETGIYEEVLNSDSELYGGGNVGNSGQLTTEDQRWMNRPCSTTLVLPPLAVVVLRKKS

SEQ ID NO: 4977 - protein, 665 aa, Mesorhizobium loti
MCGIAGILLAPDAANTNALRAIGPMMMALRHRGPDGEAFWMSREAGIAFGHRRLAIVDLSEAGRQPMHSASGRYVITFNGEIYNFRDLRRELEGAGHHFRGTSDTEVMLCAIESWGLEAALARFAGMFAFGLWDLKNRTLHLARDRMGKKPLYVASTPEALVFASELKAITCFPGFTPELDVDAAATMLSKGWVPDDRCIWQGVFKLPPGSVLSVTAADFANARGAGSLAHRIRRWWSLADVACKAQRDPIAGSDEDLTTELDSLLRLAVKERMVADVPLGAFLSGGIDSSTVVALMQAQSPTPVRTFTIAFGESGFDEAPHAAAVARHLGTDHTELHLSPAAALEVIPELPRIWDEPFADESQIPTLLVSRLARRHVTVALSGDGGDECFAGYSRHFLATRLRRQHELPSSFRRMLAAGAGLLAQASQKDIFGSLPLSANMRHGLRGDRLNRLARLFAAANEDQLLQRLTESSTNKLIHHKPAASNASATQLDGLLSRLLFDDMTGYLPGDILVKLDRATMANSLEGRCPILDHRVVEFAWRLPTDAKVRSGKGKWILRQLLDRYVPRRLVDRPKQGFDVPVGAWLRGPLRDWATDIIATTRLSGDGVIDCAKVDACWRDHLHGNQDHFRDLWPLLMFQAWRNDAMRPSAPATHASYDIELTGD

SEQ ID NO: 4978 - protein, 505 aa, Arabidopsis thaliana
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPSIPRHSNFTGLKVLVMDENGVSRMVTKGLLVHLGCEVTTVSSNEECLRVVSHEHKVVFMDVCMPGVENYQIALRIHEKFTKQRHQRPLLVALS

SEQ ID NO: 4979 - protein, 432 aa, Neisseria gonorrhoeae
MPSETALPLYADTRAAHTLVWFRQNLRIRDNAALCAAVAEGSPVIGIWIDDAETDNPRRAAFYRQSAAELAQGLARRGIPLYTAASPAGLVRLAVRLNIRAVIADESHTFADKLADNALWHELDKHGIALTFVNDRSVFGKTDLTPDNGTAHTDFNRYREVWLDRFSKQPPAGSDLFAAYRQPFPENLPAPPPAALSDGIFLPQNGGETAAWRQWRRFLEQAASYSVLKDFPSRKNTSLMGAYLSVGCISPRLLARESLERRLNAWADNIIRRDFFLQLALQHADDDPSDGNPEHTLRLTLWQQGRTGIPIIDAAMRCLHKTGSLHPALRRLSADFFCHVLNLPRREGEIWFARQLTDFDAAINQGNWRLAASRHTCPDIAAASYRTDPDGTFIKRHIPELAHLSADTVHTPWRFACSVDTHGYPARPVAGV

SEQ ID NO: 4980 - protein, 531 aa, Neurospora crassa
MGNSSSKDAGASSKNRGDDDLKSYPSFSKSDTKDSSRSFRGLRSKIPGGSKTDSPRNSTILSSEEVAEKMNALSGKNGRPSVHTRPSRRDMSPSPASPSTSSPSSPSLDTATLASPTGEPLPPPSPVHNATGGHHDVRAAQESGEVDHISDQPPSGGGGANSNQQPGQSILVKRENTINPVYDTPNQDPQNEQAVSGVAMSDIKDIDLDDFIKRLLDAAYAGKVTKSVCLKNAEIVAICHRARELFLSQPALLELDAPVKIVGDVHGQYTDLIRMFEMCPFPPNSNYLFLGDYVDRGKQSLETILLLMCYKLKYPENFFLLRGNHECANVTRVYGFYDECKRRCNVKIWKTFVDTFNCLPIAAIVAGKIFCVHGGLSPALGHMDDIRNIARPTDVPDYGLLNDLLWSDPADMDQDWEANERGVSYCFGKKVISDFLATHDFDVVCRAHMVVEDGYEFYTDRILVTIFSAPNYCGEFDNWGAVMAVSTELLCSFELLKPLDSAALKTHIKKGRHRRNNMLNSPPAHFNPQSV

SEQ ID NO: 4981 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRAIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 4982 - protein, 408 aa, Arabidopsis thaliana
MGSLRRSTSNRSRKKGTAVKMNRMPSSLSPPTPPCSAIVGGTGKSKKRRGGVCLWTRFDRTGFMEVAGCDKSTIIERSSVSAKDLRTAFSHSSKILAREKAIVLNLEVIKAVITSEQVMLLDSLRPEVLTLTDRLKHHFPRKDGPENILQASSHGHQEGGEEGLKSKLPFEFRVLEIAFEVFCSFVDSNVVDLETQAWSILDELTKKVSNENLKDLRSLKTSLTHLLARVQKVRDEIEHFLDDKEDMEDLYLTRKWIQNQQTEAASNSIVSQPNLQRHTSNRISTSMVTEEDDIDDMEMLLEAYFMQLEGMRNKILLMKEHIDSTEAYVKILQNSRRNGLIHLMMLVNIGNYAITAGTVVVNLFGMNIPIGLYSTPDIFGYVVWAVVALCIVLFIVTVGYAKWKKLLD

SEQ ID NO: 4983 - protein, 138 aa, Ashbya gossypii
MWLTESQKFGVAFTFGGCLFFLFGMFTLFDRALLTLGNILFLIGVLLIIGPARTYTFFARPASRRGSILFVVGLTLILFKWTFTGFVLESLGIVGLFGNFFSVIVQFLRSLPVVGPLLSHPAVAPVVDRLAGLRVLPV

SEQ ID NO: 4984 - protein, 494 aa, Bacillus cereus
MPFATPPVCFGKGNSALKRRVAIIGMVVAFLIGAGGMFAGMSLFGVNPAEVTQTISSGNASTAQGNLAKINEAYALIDSRYVEDVKDEKLVEGAIQGMLSTLKDPYSTYMDKETAKQFSESLDPELEGIGAEVNKTDGKLIIVSPIKGSPAEKIGIKPNDQILSVDGNSVKDLSREEAVLKIRGKKGTTVAIEIKRAGVADPIVFKIKREKIPIFTVFSSVKQESGKDIGYMQITSFAENTAKEFKDQLKELEKKNIKGLVIDVRGNPGGYLNSVEEILGEIMTDKKPMLQVEQRNGEKKKFSTELKERKPYPISVLIDNGSASASEILAGALKEGEGYDLIGEKTFGKGTVQQAVPFKDGSNIKLTMFKWLTPDGNWIHKKGIAPTVEVKQPDYYHATPIQIEKTLSYNSNDVQVKHAQEMLKSLGYVTGREDGYFSKETESALKAFQNANKMEATGQLDKKTAEAIQTKIIEKIRSGENDLQLQSALKLMAK

SEQ ID NO: 4985 - protein, 336 aa, Xanthomonas oryzae
MSRPSLTRFLIEEQHAGRIDAELRQLITIVSRACKRISIAVSKGALGGVLGDAGTGNVQGEAQKKLDVLSNDILLEANAWGGHLAACASEEMDHSQPVPEQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPDETAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAAATRYHLDADKA

SEQ ID NO: 4986 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRSIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 4987 - protein, 204 aa, Triticum aestivum
  misc_feature (145)..(145): Xaa can be any naturally occurring amino acid
PPPPRQVSDQHVIDVNDTGTKVGYKPGVVLGGKDLEHDCGVHRGIGYFIEPLILLGLFARSPLSIRLKGITNDTKDPSVDTFRMVTLHMLKHFGVPLDGLELKIENRGAPPRGGGEVLLRVPNINSTLKAVNGIDEGMVKRIRGXAGYGVSVVAETTTGCLISADATVSYPNVDEVSEQSKKPELMSPEDLGEQVASMLLEEVA

SEQ ID NO: 4988 - protein, 392 aa, Heteropterys capixaba
DLEPVNPADVPVTAAGALKSYKLASKAISRLQSLPSGNIFLLCDVLVKEVRDLTGYDRVMVYKFYEDEHGEVVSECRRSDLESYLGLHYPATDIPQASRFLFMKNKVRMICDCLAPPVQVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALFFKNKTWLLGVTPTEEQIRDIAEWLLEYHSGNTGLSTDSLMEAGYPGASVLGDAVCGMAAVSITSRDFLFWFRSHTAKEIKWGGAKHDPDDRDDLRKMHPRSSFKAFLEVVKWGSMPWEDVEMDAI

SEQ ID NO: 4989 - protein, 392 aa, Heteropterys catingarum
DLEPVNPADVPVTAAGALKSYKLASKAISRLQSLPSGNISLLCDVLVEEVRDLTGYDRVMVYKFHEDDHGEVVSECRRSDLESYLGLHYPATDIPQASRFLFMKNKVRMICDCLAPPVKVIQDERLPQPLSLCGSTLRSPHGWHAQYMTNMGTIASLVMSVTINEDDDMMDGDQQQMTGKLWGLVVCHHTSPRFVPFPLRYACEFLIQVFGVQINKEVELAAQVREKHILQIQTMLCDMLLRDAPVAIITQSPNVMDLVKCDGASLYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDVEMDAI

SEQ ID NO: 4990 - protein, 288 aa, Zea mays
VKSLQRCTRHSLERPPFETALGEYCQFPRPSLSPATAAAATSGGRGEVDEGIFVRTPLKRKAPYGEYDTAESTGWSIVSSGFIHGVDSPRKTPISGKTARKYKPKSERTKAAPQAATLNAAGSPGNPPTPAGCRYDNSLALLTKKFINLLNEAQDGILDLNSTAETLGVRKRRMYDITNVLEGIGLIEKKLKNRICWKGLGELGTNLDNDLSVLKIDFENLNLQEQALDEHISKIREKLKDLTEDEGNQRWLFLTEDDIKGLPCFQNKTLIAIKAPRGSSLEVPNPDV

SEQ ID NO: 4991 - protein, 284 aa, Brassica napus
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAVRVGGTNHSHATQDLYDSIAAGNYPEWKLFIQVIDPADEDKFDF

SEQ ID NO: 4992 - protein, 727 aa, Xylella fastidiosa
MSLRILNSLKVALLTLAITTSPALMAKSDSASPQVATPDQTTATKLVYGLLSDSRYAYRLRPLDETMSKDIFKRYLEALDNNKQFFTEADIDNFSAFKAEIPDSIRNGNLKPAFSIFTVYKKRVAERVTYANQLLKQNFDFSGQEKYEYDRSKAPWPASPQDLDDIWRRSIMNDWLRLKLAGKKPEDIRKTLKKRYANLLKTVNELKGEDVFQLYLNAYTNSIDPHTDYFTPRTADAFNQQMSLSLEGIGAQLQKQEDMVIIREVIPGGPTALDGTLKPGDRIVGVGQGKGGPIEDVIGLRIDDVVSKIRGKKDTQVRLEYIPAESGIDGAHRIVTLTRQKVRLAEQAAKGETITIEGSNGDAQRRIGIIKLPTFYEDFEGRRRNVANYTSATRDVAKLLTNFKTDKVDGVVLDLRNNGGGSLDEAIQLTGLFIEQGPVVQVRESGGRVTVNGDRDDKVTWDGPLAVLINRGSASASEIFAGAIQDYGRGLVIGETSFGKGTVQNIVDLDRWPANESRRFGQVKLTIAQFFRISGSSTQHKGVLPDIAFPASVGATEFGESTYENALPWTQIASLQHTQYGNFSPILSKLKKIHISRTANDIEFKWWQEDVHNFSLEKEKKYVILNEAKRLAERRKQETQHRERQTIRKNLGLQLDPLSEESDDGLIGNERDIAKDTAREKLADKRPDPLLHESAAILTDTINLLEKDQILSAQVLLQSTTPGHWAN

SEQ ID NO: 4993 - protein, 392 aa, Heteropterys chrysophylla
DLEPVNPADVPVTAAGALKSYKLASKAISRLQSLLSGNISLLCDVLVKEVRDLTGYDRVMVYKFHEDEHGEVVSGRRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWFLGVTPTEEQIRDIAEWLLEYHSGNTGLSTDSLMEAGYPGASVLGDAVCGMAAVSITSGDFLFWFRSHTAKEIKWGGAKHDPDDKDDLRKMHPRSSFKAFLEVVKWRSMPWEDIEMDAI

SEQ ID NO: 4994 - protein, 365 aa, Novosphingobium aromaticivorans
MSLSSSPSSSLFEPLTFAHGPAWRNRLMLAPLTNQQSHPDGRLSDEELRWLEMRGQGGFGMVMTAAAHVQAIGQGFPGQLGVFSDDHVPALSRLADALRRSGAVSAIQLHHAGSRSPAALVGTPVSPSASDNGARALTLQEVERLRDDFIAAAHRADRAGFDGVEVHGAHGYVLAEFLSPTINRREDRYGGSAENRARIVFEVIEGIRATCRPDFQIGLRLSPERFGQDLGEILAVAARAMGEARIDYLDMSLWDVFKHPEDETRRERTLLEWFADLPRGKVRLGVAGKIMGGRDAAHVLEQGCDFAVIGRAAILRHDFPERVRQDGDYVSPALPVTARHLADEGLSKPFLDYMRTWKGFVTEDA

SEQ ID NO: 4995 - protein, 265 aa, Oryza sativa
MRNSTSSAAAQPAPASAAMYGSYASPSSGAGGYAKIPTYPPPPSAYPAAPPPPVMGQPVPPPPAQLHDPTAPPSPIAKAAELVTRFREQGQALIAARRPWGEVFRAPAFSRPPSVGEAVARARRNAAYFRANYALAVLAVVAASLLWHPGTLFALLALCAAWFFLYFARPASSAGQPLRLLGMEFEDGTVLAALTGVTVIALLFTNVGWNVIGSVMIGAALVAAHATLRSTDDLFLTEQEAAGDGLVAAGMSAAGPILPTYVRIA

SEQ ID NO: 4996 - protein, 219 aa, Aspergillus nidulans
MSSTSPSKEPEVEQEPQSGEEHEQMDKEQDNQTQGQGEFEVKEQDRWLPIANVARIMKLALPENAKIAKEAKECMQECVSEFISFITSEASEKCQQEKRKTVNGEDILFAMTSLGFENYAEALKIYLSKYRETQSARGEHQNRPPSSGYAGGGPVGGAASGPSVVRAGGAAAGGAFPEASDNAGSIMNQGLDPSEQDASAYGYPPMVGQGHNGAGGESY

SEQ ID NO: 4997 - protein, 243 aa, Oryza sativa
MGQSKKKFRGGRQRHWGSWVSEIRHPLLKRRVWLGTFETAEEAARAYDEAAILMSGRNAETNFPVARNATGELTPAAAVAGRDGRVGGGSGSSSSMTANGGGNSLSQILSAKLRKCCKTPSPSLTCLRLDPEKSHIGVWQKRAGARADSSWVMTVELNKDTAVSSAATVAAATAVSSSDQPTPSDSTVTTTSTSTTGSPSPPPPAMDDEERIALQMIEELLGRSGPGSPSHGLLHGGEGSLVI

SEQ ID NO: 4998 - protein, 392 aa, Heteropterys lindleyana
DLEPVNPADVPVTAAGALKSYKLASKAISRLQSLPSGNISLLCDVLVKEVRDLTGYDRVMVYKFHEDDHGEVVSECRRSDLESYLGLHYPATDIPQASRFLFMKNKVRMICDCLAPPVKVIQDEGLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGASLYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDVEMDAI

SEQ ID NO: 4999 - protein, 392 aa, Heteropterys megaptera
DLEPVIPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELVAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDMEMDAI

SEQ ID NO: 5000 - protein, 376 aa, Coix aquatica
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRSPHGCHAQYMANMGSIASLVMAVIISSGGDDEQTSRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPNDYLFWFRSHTAKEIKWGGAKHHPEDKDDGQRMHPRSSFKAFLEVVKSRSLPW

SEQ ID NO: 5001 - protein, 245 aa, Lilium longiflorum
MGRGKIEIKRIENTTNRQVTFCKRRNGLLKKAYELSVLCDAEVALIVFSTRGRLYEYANNSVKGTIERYKKASSDAFNTGSVSEANAQYYQQESSKLRNQIVSLQNAHRSMLGESIGSMGTQGTEIHGEKAGKMDNNKIRTKKNELLFAEIEYMQKREAELQNNSMFLRTKIAENERSQQQQMDMERSQQQHMDMDRSHQRHLEMLPTTSAFETMPTFDSRNFFDINLIEAHHHYQQQQTALQLG

SEQ ID NO: 5002 - protein, 376 aa, Cymbopogon flexuosus
ALSIAGAVQSQKLAVRAISRLQALPGGDVKLLCDTVVEHVRELTGYDRVMVYRFHEDEHGEVVAESRRDNLEPYLGSHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGRRMHPRSSFKAFLEVVKSRSLPW

SEQ ID NO: 5003 - protein, 333 aa, Dichanthium aristatum
TGYDRVMVYRFHEDEHGEVVAESRRDNLEPYLGLHYPATDIPQASRFLFRQNRVRMIADCHATPVRVIQDPGLSQPLCSVGSTLRAPHGCHAQYMANMGSIASLVMAVIISSGGDDEQTGRGGISSSMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 5004 - protein, 376 aa, Elionurus muticus
ALSIAGAVQSQKLAVRAISRLQALPGGDVKLLCDTVVEHVRELTGYDRVMVYRFHEDEHGEVVAESRRDNLEPYLGLHYPATDIPQAPRFLFRQNRVRMIADCHATSVRVIQDPGLSQPLCLVGSTLRAPHGCHAQYMANMGSIASLVMAVIISSGGDDEQTGRGGISSSMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGITPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRTLPW

SEQ ID NO: 5005 - protein, 376 aa, Heteropogon contortus
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGEGEQTARGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEAQIKDIIEWLTVCHGDSTGLSTDSLADAGYLGAVALGDAVCGMAVAYITPSDYLFWFRSHTAKEIKWGGAKHHPEDKDDGQRMHPRSSFKAFLEVVKSRSLPW

SEQ ID NO: 5006 - protein, 704 aa, Saccharomyces cerevisiae
MYNIPDNVKGAVEFDPWLKPFADVLSERRYLADKWLYDITHATPDGSYQSLSKFARDSYKSYGLHANPETKEITYKEWAPNAERAFLVGDFNNWDTTSHELKNKDEFGNFTITLHPLPNGDFAIPHDSKIKVMFILPDGSKIFRLPAWITRATQPSKETSKQFGPAYEGRFWNPENPYKFVHPRPKFSESVDSLRIYEAHVGISSPEPKITTYKEFTEKVLPRIKYLGYDAIQLMAIMEHAYYASFGYQVTNFFAASSRFGTPEELKELIDTAHSMGILVLLDVVHSHASKNVEDGLNMFDGSDHQYFHSISSGRGEHPLWDSRLFNYGKFEVQRFLLANLAFYVDVYQFDGFRFDGVTSMLYVHHGVGAGGSFSGDYNEYLSRDRSFVDHEALAYLMLANDLVHEMLPNLAVTVAEDVSGYPTLCLPRSIGGTGFDYRLAMALPDMWIKLIKEKKDDEWEMGSIVYTLTNRRYGEKVVAYCESHDQALVGDKTLAFWLMDAAMYTDMTVLKEPSIVIDRGIALHKMIRLITHSLGGEAYLNFEGNEFGHPEWLDFPNVNNGDTYKYARRQFNLADDPLLRYQNLNEFDRSMQLCEKRHKWLNTKQAYVSLKHEGDKMIVFERNNLLFIFNFHPTNSYSDYRVGVEKAGTYHIVLNSDRAEFGGHNRINESSEFFTTDLEWNNRKNFLQVYIPSRVALVLALKE

SEQ ID NO: 5007 - protein, 505 aa, Arabidopsis thaliana
GLRLQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCIPGVENYQISLRIHEKFTKQRHQRPLLVALS

SEQ ID NO: 5008 - protein, 402 aa, Thermotoga maritima
MRLNQISKFAIVSVVVLVLALLLGGSAKTNLTVEEVNKALEPFFDSLSYILNYYYEADKLDINKLIDHAIDGLVKGTGDDFSYYQDPETYRENQIEMKGEYGGLGIEVTYDAEHGAIKVVAPMYGTPAWRAGLKAGDLIITIDGTPVSKMTYMEAVNNLRGEPGTSVTIEVLRDGEKLTFTIVREKIEIKMVLYSFIETEKGSIGYVRITRFGEKADSDMKNALDKIFEKGVKGLIIDVRDNPGGYLDVALKIVSMFVDKGVILKVRNGFGEEDVYESYGNSYPNVPIVLLVNEGSASASEILTGALKDLGIATVVGRKTFGKGSVQTGFPLSNGGVLFLTTAHYLTPSGKDIHKIGIEPDVLVEESVEEELHAETREQIEVDPEKDPFVKKGLEVLLEKIK

SEQ ID NO: 5009 - protein, 368 aa, Synechococcus elongatus
MSESLKLLTPVQVGRYELRNRIVMAPLTRNRATGPDNIPNDLNVLYYQQRASAGLIITEASQISPQGQGYPLTPGIHSPEQVEGWKPIVQAVHDRGGCIFLQLWHVGRISHPSLQPDGALPVAPSAIQPAGMAATFQGEQPFVTPRALETEEIAGVVEDYRRAAENALAAGFDGVEVHGANGYLIDQFSQDGTSQRSDRYGGSFENRSRFLREVLDAVISVWGSDRVGLRLSPWGQFNDMRDSDPVGLFSYVAQMLNPYNLAYLHWIEPRWDKAEESPEFNQMATPVFRSLYNGPVIAAGGYSRSTAEAAIASGAADLVAFGRLYISNPDLVERFALDAPLNPYDRNTFYGGDEHGYTDYPSLEAASV

SEQ ID NO: 5010 - protein, 477 aa, Lycopersicon esculentum
MGLISKIATNDGHGENSAYFDGWKAYENDPFHPTQNPNGVIQMGLAENQLCFDLIQEWIVNNPKASICTYEGVQDFQDTAIFQDYHGLPEFRKAVARFMEKVRGDRVRFDPERIVMSGGATGAHESLAFCLADPGDAFLVPTPYYPGFDRDLRWRTGVQLFPVVCESSNNFKVTKEALEEAYSKAQESNIKVKGLLINNPSNPLGTILDKETLKDILRFINDKNIHLVCDEIYAATAFSQPSFISISEVKSEVVGCNDDLVHIVYSLSKDLGFPGFRVGIIYSYNDAVVNIARKMSSFGLVSTQTQRLIASMLLDTIFVEDFIAKSSMRLLQKHGLFTKGLGQVGITTLKSNAGLFIWMDLRRFLENSTFDDELKLWHIIIDKVKLNVSPGCSFHCSEPGWFRVCFANMDDATMKIALRRIRHFVYLQPNKGVEVATKKQYCRTRSKLEISLSFRRLDDFMNSPHSPMSSPMVQARN

SEQ ID NO: 5011 - protein, 505 aa, Arabidopsis thaliana
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCMPGVENYQIALRIHEKFTKQRHQRPLLVALS

SEQ ID NO: 5012 - protein, 370 aa, Pneumocystis carinii
MDSKHSVFNVMGQEFVLQKGYEVIKGLGKGSYGVVCSAKNIEVEDNNKVAIKKITNIFSKKMLAKRALREIMLLQHFRNHKNITTLYDMDIVDPSKFNELYLYEELMQANLNSIIRSDQPLTDAHFQSFIYQILCGLKYIHSANVLHRDLKPSNLLINADCKLKICDFGLSRGISVNQGQGTEYMTEYVTTRWYRAPEVMLSFQSYSKAIDLWSVGCILAELLGRKPFFKGSNYVDQLNQIFCILGTPNENIISKIKSASAQSYIRSLPTLPKMPYSKIFPYANPDALDLLNCLLTFDPYDRISCEEALEHPYLIIWHDPNKEPVCSEQFDFGFEAIDSIEEIRQMIINEVSRFKGLTGNQKLYHSISNT

SEQ ID NO: 5013 - protein, 530 aa, Arabidopsis thaliana
  misc_feature (322)..(322): Xaa can be any naturally occurring amino acid
  misc_feature (345)..(345): Xaa can be any naturally occurring amino acid
  misc_feature (410)..(410): Xaa can be any naturally occurring amino acid
MRRFLINQAKGLVDHSRRQHHHKSPSFLSPQPRPLASSPPALSRFFSSTSEMSASDSTSSLPVTLDSINPKVLKCEYAVRGEIVNIAQKLQEDLKTNKDAYPFDEIIYCNIGNPQSLGQLPIKFFREVLALCDHASLLDESETHGLFSTDSIDRAWRILDHIPGRATGAYSHSQGIKGLRDVIAAGIEARDGFPADPNDIFLTDGASPAVHMMMQLLLSSEKDGILCPIPQYPLYSASIALHGGSLVPYYLDEATGWGLEISDLKKQLEEARSKGISVRALVVINPGNPTGQVLAEENQRDIVNFCKQEGLVLLADEVYQEXNVYVPDKKFHSFKKVARSLGYGXKDISLVSFQSVSKGYYGECGKRGGYMEVTGFTSDVREQIYKMASVNLCSNISGQILASLVMSPPXERDGILSSMAKRAKTLEDALNSLEGVTCNRAEGAMYLFPRINLPQKAIEAAEAEKTAPDAFYCKRLLNATGVVVVPGSGFGQVPGTWHFRCTILPQEDKIPAIVNRLTEFHKSFMDEFRN

SEQ ID NO: 5014 - protein, 505 aa, Arabidopsis thaliana
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRLVTKGLLVHLGCEVTMVSSNEECLRVVSHEHKVVFMDVCMPGVENYQIALRIHEKFTKQRHQRPLLVALS

SEQ ID NO: 5015 - protein, 374 aa, Vibrio parahaemolyticus
MKQRPNKLFEPAQLKALSLQNRIVMAPMTRARTTQPGNIPNEMMATYYQQRASAGLIISEATQISDDSQGYSFTPGVYTDAQVAGWQGVTQAVKLQGAAMFCQLWHVGRVSHPTFQNGEQPIAPSALAPVETQVWIADEQGNGNMVDCVEPRAMTQADINRVVGDFANAAKRAIESGFDGVEIHGGNGYLIDQFLRTNSNHRTDNYGGSRENRIRFLIEVVDAVIAAVGAHRVGVRLAPFITFKDMDCPDIVPTILEASKQLQERDIAYLHLSEADWADAPTIPETFRIELRKRFRNAIIVAGRYDPQRANEVLEKGYADLVAFGRPFVANPDLVSRLQHHHPLAELDGSTLFGGNERGYTDYPALQQECAEQA

SEQ ID NO: 5016 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRQIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 5017 - protein, 505 aa, Arabidopsis thaliana
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCIPGVENYQISLRIHEKFTKQRHQRPLLVALS

SEQ ID NO: 5018 - protein, 504 aa, Candida boidinii
MSNPPTYTTSQGCPVSDAFSTQRISGTKISIKTPVGPLLLQDFKFLDSLAHFDRERIPERVVHAKGAGAYGVFEVTEDISDICSAKFLDTVGKKTKIFTRFSTVGGEKGSSDSARDPRGFATKFYTEEGNLDLVYNNTPIFFIRDPTKFPHFIHTQKRNPATNCKDANMFWDYLTNNPESLHQIMYLFSNRGTPTSYRKMNGYSGHSYKWYNAKGEWVSSVHFISNQGVHNMTDEEAGDLSGKDPDFQTMDLYKAIEQGDYPSWECYVQTMTLEEAKKQPFSVYDLTKVWPHKDFPLRHFGKFTLNENAQNYFAEVEQAAFSPSHTVPGMEPSNDPVLQSRLFSYPDTHRHRLGVNYSQIPVNCPMRAVFAPQIRDGSMMVNGNLGGTPNYAGAYNCPVQYQAPIKASSKTPEEQYEGETLSYDWTEVNEYDFYQPGRFWEVLGKTKGEQEALVHNVANHVSGADEFIQDRVFAYFSKANPVIGDLIRKEVLKKSPRGASKNKF

SEQ ID NO: 5019 - protein, 728 aa, Xanthomonas oryzae
MTTEGISEMSQTLQALADGLPVDAFAVLGPHPLADGRRQVRVLAPGAEAMGLIDSRGKLLARMQASAIDGVFEGILSIEGPYRLRIVWPDMVQEIEDPYAFAVTLDESLLLQIAAGDGQALRRALGAQHVQCGEVPGVRFAVWAPHAQRVAVVGDFNGWDVRRHPMRQRIGGFWELFLPRVEAGPRYKYAVTAADGRVLLKADPVARQTELPPATASVVPGTDTFAWTDAAWMAKRDPSAVPAPLSIYEVHAASWRRDGHNQPLDWPTLAEQLIPYVQQLRFTHIELLPITEHPFGGSWGYQPLGLYAPTARHGSPDGFAQFVDACHRAGIGVILDWVSAHFPDDAHGLAQFDGAALYEHADPREGMHRDWNTLIYNYGRPEVTAYLLGSALEWIDHYHLDGLRVDAVASMLYRDYGRAEGEWVPNAHGGRENLEAVAFLRQLNREIAAHFPGVLTIAEESTAWPGVTAAISDGGLGFTHKWNMGWMHDTLSYMQRDPAERAHHHSQLTFGLVYAFDERFVLPISHDEVVHGTGGLLGQMPGDDWRRFANLRAYLALMWAHPGDKLLFMGAEFGQWADWNHDQSLDWHLLEGARHRGVQLLVGDLNATLRRTPALYRGTHRAKGFDWSVADDARNSVLAFIRHDPDGGGVPLLAVSNLTAQPLHDYGVGVPRAGAWREILNTDSAHYGGSNLGNSGRLATEPMGMHGHAQRLRLTLPPLATIYLQAEK

SEQ ID NO: 5020 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVREIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 5021 - protein, 353 aa, Escherichia coli
MGLFVKIVAVALLHKHCRESFMKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 5022 - protein, 392 aa, Heteropterys nitida
DLEPVNPADVPVTAAGALKSYKLASKAISRLQSLLSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVRCDGAALYFKNKTWFLGMTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDVEMDAI

SEQ ID NO: 5023 - protein, 392 aa, Heteropterys pauciflora
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTVLCDMLLRDAPVTIITQSPNVMDLVKCDGAALYFKNKTWLLGVTPTEGQIRDIAEWLLEYHSGNTGLSTDSLMEAGYPGATVLGDAVCGMAAVSITSRDFLFWFRSHTAKEIKWGGAKHDPDDKDDLRKMHPRSSFKAFLEVVKWRSMPWEDVEMDAI

SEQ ID NO: 5024 - protein, 392 aa, Heteropterys rhopalifolia
DLEPVNPADVPVTAAGALKSYKLASKAIARLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLDMSVTINEDDDMMDGDQQQMTRKLWGLVVCHHTSPRFVPFPLRYACEFLIQVFGVQINKEVELAAQVREKHILQIQTMLCDMLLRDAPVAIISQSPNVMDLVKCDGAALYFKNKTWLLGVTPTEEQIRDIAEWLLEYHSGNTGLSTDSLMEAGYPGASVLGDAVCGMAAVSITSRDFLFWFRSHTAKEIKWGGAKHHPDDKDDLRKMHPRSSFKAFLEVVKWRSMPWEDVEMDAI

SEQ ID NO: 5025 - protein, 173 aa, Lilium longiflorum
  misc_feature (2)..(2): Xaa can be any naturally occurring amino acid
MXLSVLCDAEVALIVFSTRGRLYEYANNSVKATIERYKKASTDISNTRSVSEANAQYYQQEWTKLRQQINSLQNSNRNLLGESLSNMNLRDLKQLENRLEKAINKIRTKKNELLYAEIEYMQKREMELQSDNMYLRNKVAENEREQQQQMNMMPSTSEYEVMPHFRFTEFPSS

SEQ ID NO: 5026 - protein, 408 aa, Nitrosomonas europaea
MQPIKKSSKLDNVCYDIRGPVLDRARQMEDEGQRVIKLNIGNPASFGFEAPDEILQDVIRNLSAASGYCDSKGLFAARKAIMHYTQEKNIANVQMDDIYIGNGVSELIMLATQALLENGDEILVPSPDYPLWTAAISLAGGVARHYTCDEQSSWLPDPENIKAQVSSRTRAIVIINPNNPTGALYPDDLLREIIEIARRNNLIIFADEIYDKILYDSASHTSVASLADDVLFVTFNGLSKNYRAAGFRSGWVVVSGNKTHARDYITGLNMLASMRLCANVPAQFGIQTALGGYQSIHDLTMPTGRLKRQRDLAWKLLTDIPGVTCFKPQSALYLFPRLDPDYYPVKDDEQFALDLLLEEKVLVVQGTGFNWSQPDHFRIVFLPNSDDLTEAIGRIAKFLDRYRTRHGS

SEQ ID NO: 5027 - protein, 341 aa, Oryza sativa
MDHAAEAQRTDLMTITRHVLNEQGRHPESRGDFTILLSHIVLGCKFVASAVNKAGLAKLIGLAGDTNVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGSAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 5028 - protein, 392 aa, Heteropterys sanctorum
DLEPVNPADVPVTAAGALKSYKLASKAISRLQSLPSGNISLLCDVLVKEVRDLTGYDRVMVYKFHEDDHGEVVSECRRSDLESYLGLHYPATDIPQASRFLFMKNKVRMICDCLAPPVKVIQDERLPQPLSLCGSTLRSPHGCHAQYMTNMGTIASLVMSVTINDDDDMMDGDQQQMTRKLWGLVVCHHTSPRFVPFPLRYACEFLIQVFGAQINKEVELATQVREKHILQIQTMLCDMLLRDAPAAIITQSPNVMDLVKCDGASLYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDVEMDAI

SEQ ID NO: 5029 - protein, 549 aa, Unknown
  Pseudoalteromonas sp. PS1M3
MAAKEVLFAGDARAKMLTGVNILANAVKVTLGPKGRNVVLDKSFGSPVITKDGVSVAKEIELEDKFENMGAQMVKEVASKANDAAGDGTTTATVLAQSIVNEGLKAVAAGMNPMDLKRGIDKAIIAAVAELKALSVPCADTKAIAQVGTISANSDKEIGDIIAEAMEKVGRNTGVITVEEGQSLENELDVVEGMQFDRGYLSPYFINNAEKGAVELDNPFILLVDKKVSNIRELLPTLEAVAKASKPLLIIAEDLEGEALATLVVNNMRGIVKVSAVKAPGFGDRRKAMLQDIAVLTGGTVISEEIGLELEKATVEDLGTAKRVVITKDDTTIIDGAGEEEGITGRVSQIKAQIEEATSDYDKEKLQERMAKLAGGVAVIKVGAATEIEMKEKKDRVEDALHATRAAVEEGVVPGGGVALVRAASKLVELLGDNEDQNHGVKVALRAMEAPLRQIVTNAGDEASVVINAVKGGEGNYGYNAATGEYNDMIEMGILDPTKVTRSALQFAGSIAGLMITTEAMVAEIPKEEAAGAPDMGGMGGMGGMGGMM

SEQ ID NO: 5030 - protein, 724 aa, Novosphingobium aromaticivorans
MATPTKGKAPARAAKERSPALDNALRDHQPGAGQTDEATALGNAGEIHQEAAAENDAAAFLTDNFGHRLSDNQNSLRAGMRGPTLIEDFILREKIFHFDHERIPERIVHARGSGAHGVFEVTRAIPDLTRAGLFQKKGQTCPVFVRFSTVAGGAGSIDTPRDVRGFAVKFYTDEGNWDLVGNNIPVFFIQDAMKFPDLVHSVKMEADRGYPQAASAHDTFWDFIGLMPESMHMIMWAMSDRAIPRTLRMMEGFGVHTFRFVNAAGEGRFVKFHWKPVLGMESLIWDEAVKVAGADPDFHRRDLFESIAAGHFPAWDLGVQVFDEEFAASQPYDVLDATKLIPEEDVPVEIVGRMTLNRNVDNFFAETEQVAFLPSNVIPGIDFSNDPLLQGRLFSYLDTQKSRLGTTNFHQIPVNAPKCPFHNMQRDGLMQTLVPTGRANYEPNSLDEAGEDSGPRACPETGFTSFRENGERHDPTEKVRVRADLFADHYSQAALFFHSQTESEQAHIASALVFELSKVALEHVRARVVSRLRNIDETLAQRVADGLAMDLPEKAPAARQPVKMKPSDALSIQKQAKKTFAGRKVGILFAEGSDKATIDKLKAGVEEAGGTVFLVAPKVGGIPVKGGTLKADGKLDGSPSVLFDAVASVLMPEAAAKLAMQGAAVQWFMDAYGHCKTIAHCNGTRIILEKAGVEPDEGVVPNEKLLEVGPVRHFAREPKVRDLA

SEQ ID NO: 5031 - protein, 392 aa, Heteropterys sericea
DLEPVNPADVPVTAAGALKSYKLASKAISRLQSLLSGNISLLCDVLVKEVRDLAGYDRVMVYKFHEDEHGEVVSECRRSDLESYLGLHYPATDIPQASRFLFMKDKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWFLGMTPTEEQIRDIAEWLLEYHSGNTGLSTDSLMEAGYPGASVLGDAVCGMAAVSITSRDFLFWFRSHTAKEIKWGGAKHDPDDKDDIRKMHPRSSFKAFLEVVKWRSMPWEDVEMDAI

SEQ ID NO: 5032 - protein, 1005 aa, Staphylococcus epidermidis
MSKEIFDTFKFKCGAELKNRVLMAPMTIQAGYFDGSVTSEMIDYYQFRAGDASAIIVESCFVENHGRGFPGAIGIDNDDKIPGLKRLAEAIQAKGSKAILQLYHAGRMANPKFNEGEQPISASPIAALRPDAVPPREMTHAQINQMIDDFGEATRRAIEAGFDGVEIHGANTYLLQQFFSPHSNRRQDSWGGSREKRTRFPIEVLTKVQHVVAEKEASHFIIGYRFSPEEIEEPGIRFEDTMFLLNTLAEYEPDYFHISANSYQRTSIVNQEDTEPLINKYIKMQSAQLAKIPLIGVGSIAQRQDAEHALELGYDLLSVGKAYLVEPQWTDKISQNEEVEQFVDIHDQKVLHIPSPLWKVMDFMILDKEEEHRKYEKLKALQNKKVKFNKGTYHVYAKGHNGNLPMKVQLSEDKIVSIEVDDSGESEGIANPVFERLPQDIINGQTLNVDVISGATVTSEGIVQGIADAIEQAGEDPDILRARPKPVVQWSDEVVEETTDVVVIGTGGAGLSAAATVLDEGKEVIMLEKFAAIGGNTIRTGGQVNAAEPKWQNAFPALAGEKETLLQLLNHDENDIDEAYIEDFNTLKRQIKDYLENSSNEDEYLFDSVELHRIQTYLGGKRKDRNNVEISCDYDLVKTLTDNVLESVYWLKDKGVHFDRSFVDMPVGALWRRGHKPMKAQGLEYIENLGDYVKHNHGRIFTETTAEKLIKEGNQVVGIEARKANGAKVKIHTRHGVVLATGGFGANTKMLQQYNTYWDNIPDDIKTTNSPAITGDGIRLGVQAGADIVGMGFSQMMPISDPKTGALFTGLIVTPSNFVFVNKEGQRFVNEFESRDVLSKAALEQKDGIFYIIADANIKALAMNTTEDKINQELEDGTLVKADTLEALAQKLNIDTTTFVNTIERYNTFVEQGQDEDFNKNAFDLKIEKAPFYATPRKPAIHHTMGGLKINTHAQVIDVEGHIIEGLYAAGEVAGGIHAGNRLGGNALADIFTFGRIAGQSAVTK

SEQ ID NO: 5033 - protein, 728 aa, Aspergillus fumigatus
MRLTFIPSLIGVANAVCPYMTGELNRRDEISDGDRAAATEEFLSQYYLNDNDAFMTSDVGGPIEDQNSLSAGERGPTLLEDFIFRQKIQRFDHERVPERAVHARGAGAHGVFTSYGDFSNITAASFLAKEGKQTPVFVRFSTVAGSRGSSDLARDVHGFATRFYTDEGNFDIVGNNIPVFFIQDAILFPDLIHAVKPRGDNEIPQAATAHDSAWDFFSQQPSTMHTLLWAMSGHGIPRSFRHVDGFGVHTFRFVTDDGASKLVKFHWKSLQGKASMVWEEAQQTSGKNPDFMRQDLHDAIEAGRYPERELGVQIMDEEDQLRFGFDLLDPTKIVPEEFVPITKLGKMQLNRNPRNYFAETEQVMFQPGHIVRGVDFTEDPLLQGRLFSYLDTQLNRHGGPNFEQLPINQPRVPVHNNNRDGAGQMFIPLNPHAYSPKTSVNGSPKQANQTVGDGFFTAPGRTTSGKLVRAVSSSFEDVWSQPRLFYNSLVPAEKQFVIDAIRFENANVKSPVVKNNVIIQLNRIDNDLARRVARAIGVAEPEPDPTFYHNNKTADVGTFGTKLKKLDGLKVGVLGSVQHPGSVEGASTLRDRLKEHGVDVVLVAEALADGVDQTYSTSDAIQFDAVVVAAGAESLFAASSFTGGSANSASGASSLYPTGRPLQILIDGFRFGKTVGALGSGTAALRNAGIATSRDGVYVAQSVTDDFANDLKEGLRTFKFLDRFPVDH

SEQ ID NO: 5034 - protein, 313 aa, Geobacter sulfurreducens
MPFSEPGKTKFQVDLRRHLRNQDISDNLVHLICEIAEASKYVINAVRTGDLGVAGTSNLYGEEQLALDVLSDRIIRKRLIHSGVVCNIASEEMDEIFQAQADADGLYSVAYDPLDGSSLVDVNLAVGTIVSIYEGCNLLQKGRNQVAAMYILYGPRVSLVYSVGKGVHEFTMNHLMEYTLSRENVTMKPDGDIYSPGGLRKKYLPETEKFVQHLESKGSKLRYSGGFVPDINQVLMKGKGIFMYPALNGSPNGKLRVLFELNPMAYLIENAGGAATDGKTPILDIEPQSLDQRAPIFIGCSNDVATAMEFMGG

SEQ ID NO: 5035 - protein, 500 aa, Crocosphaera watsonii
MCGIAGIWGQTEQTNVEAMMKSIIHRGPDAKGIFTVPNGSGILGHQRLSIMDVDGGDQPIYSKANTQAIIGNGEIYNYPKLQPELAKKYKFLTKSDTEAVLHLYEEKNTTAVGELDGMFAFAIIDDNKFIAARDPIGIKPLYYSEKDGNFWFASELKAITQFCENVEEFPPGHFFSSETGFSQYYSLPDIPPELDANVDELLQEIRETVEASVVKRLMSDVPLGAFLSGGLDSSIIAAIAKKHKSELHTFSVGIAGSKDINAARLVSDYLGTIHHEYIITPEEAIAKLPEIIYYLESFDQDLVRSGIPCYFTSRLASEYVKVILTGEGADELFAGYTYYKDIPSDDTLHRELRRSVNSLHNINLQRVDRLTMAHSIEGRVPFLDLKMIELGQKVPAHLKLKGTPPVEKWILRKAFEDILPEEIVWRKKEQFDEGSGTVDLLTETLKDVMNEQQAQQYQKEHPDIKLRSAEECYYHQIFMKAFDNPDALLTNVARWAETRF

SEQ ID NO: 5036 - protein, 250 aa, Solanum commersonii
  misc_feature (231)..(231): Xaa can be any naturally occurring amino acid
MGRGRVQLKRIENKINRQVTFSKRRSGLLKKAHEISVLCDAEVGLIVFSTKGKLFEYATDSCMERLLERYERYSFAEKQLVPTDHTSPGSWTLENAKLKARLEVLQRNEKLYVGEDLESLNMKELQNLEHQLASALKHIRSRKNQLMHESISVLQKQDRALQEQNNQLSKKVKEREKEVEQQNQWDQQNHEINSSTFVLPQQLDSPHLGEASQNTNVVDNGEVEGGNSSQXQGAANNTVMPQWMVRHLNG

SEQ ID NO: 5037 - protein, 376 aa, Hyparrhenia hirta
ALSIAGAVQSQKLAVRAISRLQALPGGDVKLLCGTVVEHVRELTGYDRVMVYKFHEDEHGEVVAESKRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHSSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDNLADAGYLGAAVLGDAVCGMAVAYITPSDYLFWFRSHTAKEIKWGGAKHHPEDKDDGQRMHPRSSFKAFLEVVKSRSLPW

SEQ ID NO: 5038 - protein, 442 aa, Pseudomonas fluorescens
RERIHERVVHARGTGAHGTFTVTDNLSDLTKAKVFAAGETTPVFVRFSAVVHGNHSPETLRDPRGFATKFYTAEGNWDLVGNNFPTFFIRDAIKFPDMVHAFKPDPRTNLDDDSRRFDFFSHVPESTRTLTELYSDSGTPASYREMDGNGVHAYKLINAKGEVHYVKFHWKSLQGIKNLDPKQVTEVQGRDYSHMTNDLVAHINKGDFPKWDLYVQVLKPEDLAKFDFEPLDATKIWPDFTERKVGQMVLNRNLDNVFQETEQVPWPPANLVPGIEPSEIRLLQARLCSYAETQIYRLGAKRLQLRIQRPTVTVNNGNQDGAMNFGKDTTGVNYQPKSSDAREEPATARYSESALAGNTQQAKIQREQNFKQAGDLYRSYSKKERQDLIDNFGGSLATTDDESKHIILSFLYKADPEYGTGVAKVAKGDLARVKALAEKLTD

SEQ ID NO: 5039 - protein, 376 aa, Ischaemum afrum
  misc_feature (261)..(261): Xaa can be any naturally occurring amino acid
ALSIAGAVQSQKLAVRAISRLQALPGGDVKLLCDTVVEHVRELTGYDRVMVYRFHEDEHGEVVAESRRDSLEPYLGLHYPATDIPQASRFLFRQNRVRMIADCHATPVRVVQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYXGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 5040 - protein, 223 aa, Capsella bursa-pastoris
MNSSSFSAFSEMFGSDYESPGSSGGGDYCPTLATSCPKKPAGRKKFRETRHPIYRGVRQRNSGKWVSELREPNKKTRIWLGTFQTAEMAARAHDVAAITLRGRSACLNFADSAWRLRIPESTCAKEIQKAAAEAALAFQDEMGDTTTAATTTTDHGLDKEETMVEATVTPEQSDSLYIDEEAMFGMPSFLDSMAEGMLLPPPSVQWNTNYDVDGDDDLSLWSY

SEQ ID NO: 5041 - protein, 323 aa, Microstegium nudum
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITP

SEQ ID NO: 5042 - protein, 727 aa, Magnaporthe grisea
MPRSSMLGLWASLVWIAQAGCPYADPAALRPREEHTDDYLAQFSVDDQDKFLTSDVGGPIGDQRSLKAGARGSTLLEDFVFRQKITHFDHERVPERAVHARGAGAHGTFTSYGDFSNITSASFLNSAGKRTPVFVRFSTVAGSRGSADSARDVHGFATRFYTDEGNFDIVGNNVPVFFIQDAIQFPDLVHAVKPSPDKEIPTAATGKRPDYKPNPDATHDSAWDFFSQQSSSLHALFWAMSGYGIPRSYRHMDGFGVHTFRMVADNGESRLVKFHFKTKQGKASLIWEEAQVLSGKNPDFHRQDLWDAIEAGHGPEWEFGVQVVNEEDALRFGFDMLDPTKILPEDLVPVHPLGLLKLDRNPINYFAETEQIMFQPGHLVRGIDFTEDPLLQGRVFSYLDTQLNRHNGPNFEQLPINRPRVTVHNNNRDGSGQNFIHKNIHPYTPSALNEFPKQADDDQGRGFMTAPRRRTQDAALVRELSETFDDHWTQPRLFWNSITPAEQQILVNAIRFETSNIVNTHVRQKVLQQLNRISDELAGRVAQALGMEAPAPEPAFYHENTTIGLSIFGIKLPTIKTLRVGVLASTGNVASLSQAADLKARFMGDGVAVAVLGETQVEGVDVTYSQSDATVFDGIIIAAGAEGLVAKDAPASALFPIGRPQQLVVDSFRWGKPIGLAAASDDSANIFSSLGTTGPGVFSGDDLGVLVTDFKEGLSTYKFVERFPMDS

SEQ ID NO: 5043 - protein, 363 aa, Capsicum annuum
MGLAENQLCFDLIQEWVVNNPKASICTAKGAEDFQEIAIFQDYHGLPEFRQAVARFMEKVRGDRVTFDPNRIVMSGGATGAHEMLAFCLADPGDAFLVPTPYYPGFDRDLRWRTGVQLFPVVCESSNDFKVTRKALEEAYEKAQESNIKIKRLLINNPSNPLGTLLDKDTLRDIVTFINSKNIHLVCDEIYAATVFDQPRFISVSEVVDEMIGCNQDLIHIVYSLSKDLGFPGFRVGIVYSYNDTVVDIARKMSSFGLVSTQTQHLLASMLSDEIFIEKFIAESSERLSKRQGMFTKGLAQVGISTLKSNAGLFFWMDLRRLLKEPTFDAELELWRIIIHEVKLNVSPGVSFHCSEPGWFRVC

SEQ ID NO: 5044 - protein, 373 aa, Paspalum simplex
ALFVAGGLQAHKLAVRAISRLQALPGGDVKLLCDTVVELVRDLTGYDRVMVYRFHEDEHGEVVAESRRENLEPYLGLHYPATDIPQASRFLFRQNRVRMIDDCHATPVRVIQDPGLSQPLCLVGSTLRAPHGCHAQYMATWVQLHRLLWQSSFGGDDEQTRGGISSAMKLWGLVVCHHTSPRFIPFSLRYACEFLMQAFGLQLNMELQLARQLSEKHILRTQTLLCDMLLRDSPTGIVTQSPSIMDLVKCDGAALYYHGKYYPWGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 5045 - protein, 333 aa, Phacelurus digitatus
TGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSGYLFWFRSHTAKEIKWGGAKHHPEDKDDGQRMHPRSSFKAFLEVVKSRSLPW

SEQ ID NO: 5046 - protein, 364 aa, Thiomicrospira crunogena
MKHLLSPLKIGNTELPNRVFMAPLTRSRAQQPGNAPGDLNAEYYSQRATAGLIVTEATPVSQQGQGYAYTPGIYTDVQEAGWKKVVDKVHSKGGHMSLQLWHVGRISNTELQEDGAAPVAPSAIQAENSQCSAPVEGGALKMVPCAMPRALETDELPGIVEQYRQAAIRGLKAGFDFFEVHSANGYLLHQFLATNTNHRTDEYGGSIQNRARLVLEVLDAVIKEVGKEKVGVRLSPNFVAHDMNDEASEEMTLYLAKEFSKREIAYLHIAEPDWAGGAPLTDEFRSALRDQFNGALIFCGNYDAEKAEQTLAKGLADAIAFGRAFIANPDLVARFKQGAELNTPNPDTFYGGGAEGYTDYPFMN

SEQ ID NO: 5047 - protein, 532 aa, Arabidopsis lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAVILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALRIHEKFTKQRHQRPLLVALTGNT

SEQ ID NO: 5048 - protein, 485 aa, Desulfovibrio vulgaris
MDKKRLTTNAGAPVADNQNVMTAGPRGPQLLQDVWFLEKLAHFDREVIPERRMHAKGSGAFGTFTVTHDITRYTRAAIFSEVGKKTDLFVRFSTVAGERGAADAERDIRGFAVKFYTEQGNWDMVGNNTPVFFLRDPLKFPDLNHAVKRDPRTNLRSARNNWDFWTSLPEALHQVTVVMSDRGIPATYRHMHGFGSHTFSFINAKGERFWCKFHFKTQQGIKNLTDAEAEAIVGKCRESHQRDLYDSIERGDFPRWTMYVQVMTEEKAAALPYHPFDLTKVWYHDDAPLIEVGVLELNRNPENYFAEVEQAAFNPANVVPGIGFSPDKMLQGRLFSYGDAQRYRLGVNHHLIPVNMPRCPFHSYHRDGMMRVDGNHGSTLAYEPNSYGEWQEQPGFAEPPLELSGAAAHWNAREDDADYFTQPGKLFRLMTPAQQEELFGNTARALGDAPDAIKLRHIGNCLKADPAYGNGVAKALGLDPAKALG

SEQ ID NO: 5049 - protein, 132 aa, Chlorobium tepidum
MLMKIAKDPMRLFDDIWSGSQMAVAPSFKVDISEDENAYHLDAELPGIAKEQIALNIEDDVLTIKAERTHKEEEKKKNYHRVERTYGSFSRSFNIGEIIDQEHIGATYDNGVLHVTLPKTQPAKKTKEIPIN

SEQ ID NO: 5050 - protein, 727 aa, Xanthomonas oryzae
MTAVSNRWDPGVIRALAEARHGDAFAVLGAHRTDTGRVLRTYLPGAERVSAVLDDGQTIALEAGPEPGLFAGDLPAQGGYRLRIGWPGGEQDTADPYAFGPQLSDFDLHLISEGHHLQLADALGANVVEVDGVRGTRFAVWAPNASRVAVVGDFNSWDARRHPMRLRHQSGVWELFVPDVGPGAHYKYQLRGPHGHELPAKADPVARRAELAPGTASIVADPTPYQWSDDGWMATRARRQAHDAPMSVYEMHAGSWLREEGVDLDWDGLADHLIPYVADMGFTHVELMPVTEHPFGGSWGYQPLGLFAPTARFGTPDGFARFVDRCHREGIGVIVDWVPAHFPTDAHGLAHFDGTALYEHADPREGFHRDWNTLIYNHGRREVSGFLIASAMEFLQRYHVDGLRVDAVASMLYRDYSRNAGEWVPNIHGGRENYETIAFLRRLNALVREHTPGAVMIAEESTAFPGVTADVAHGGLGFHYKWNMGWMHDTLHYASLDPIYRRYHHGELTFSMVYAYSERFVLPISHDEVVHGKGSLLGRMPGDDWQRFANLRAYLGFMFTHPGRKLLFMGCEFGQPTEWNHDSGLPWHLLDDPRHRGVQTLVRDVNRLYVQYPALHAHDDDPSGFAWVVGDDAGNSVVAFLRKGKRGDAPVLVVINFTPVVQHGYRIGVPQGGQWREVFNSDAGIYGGANLGNGGIVTAEQQSMHGHAHALPLLLPPLGAIVLTPPG

SEQ ID NO: 5051 - protein, 612 aa, Candida glabrata
MENKEHHHHHHHHHHHHSNGSYVSNKVSSLADGSRVGNYQIVKTLGEGSFGKVKLAYHVTTGQKVALKIINKKVLAKSDMQGRIEREISYLRLLRHPHIIKLYDVIKSKDEIIMVIEYAGNELFDYIVQRNKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGASDLIKRMLIVNPLNRISIHEIMQDEWFKVDLAEYLVPQDLKQQEQFNKKSGNEENVEEIDDEMVVTLSKTMGYDKDEIYEALESSEDTPAYNEIRNAYILIKDNKSLIKDMKQDNNVTQELDTFLSQSPPTFQQNGDGMKASEDQKKKHSGRRLASSVTQQRTFHQPPFMDQSKEEDSTISILPTSLPQIHRANMLAQGLPAASKISPLVTKKSKTRWHFGIRSRSYPLDVMGEIYIALKNLGAEWAKPSEEDLWTIRVRWKYDSDESRLIEDGVKKIPNLMKIVIQLFQIETNNYLVDFKFDGWESTYGDSTISTNMSEDEMSTFSAYPFLHLTTKLIMELAVNSQGN

SEQ ID NO: 5052 - protein, 481 aa, Pseudomonas syringae
MSQKTLTTASGAPVADNQNSRSAGPRGPLLLDDFHLIEKLAHFNRENIPERRVHAKGSGAHGTFTVTRDISQYTSARLFDTVGKQTPIFLRFSTVGGERGSADTERDPRGFAIKFYTEEGNWDIVGNNTPVFFIRDPLKFPDFIHTQKRLPQTNLKSPQMMWDFWSHSPEALHQVTILFSDRGIPDGYRHMHGFGSHTYSLISAAGERHWVKWHYKTRQGIKNLTPAEAARIAGTDPDYAQRDLFTAIEKGDFPKWQVCIQLMTEAQAANHHENPFDVTKTWSQKEYPLIEVGELELNRNPLNYFAEVEQAAFGPSNMVPGVGLSPDRMLQGRVFAYADAHRYRVGTNHQQLPINAPKSPVHSYQRDGAMAFGTNGGATPNYEPNSYSDAPKENPRYAEPALSLNGAADRHDHRVDGDYYSQAGKLFNLMSADQQALLIGNIAGAMAGVSSDVVQRQLQHFYKADPAYGEGIARALDVKLG

SEQ ID NO: 5053 - protein, 740 aa, Rhodospirillum rubrum
MDPKAYSEAVAALVGARHSNPFAFLGPHEGRAEGGRGGFCIRCFRPKATAVSLISAADDTVLGRMKRLHPDGLFGIDLPEAPGALAYRLRVSEGDEDRDIEDPYRFGPVLGELDRHLLGEGTHLDIYRKMGAHPMTRDGVRGTGFALWAPNATRVSVIGDFNGWDGRLHPMRAHPGSGVWDIFLPGVVEGHLYKYELLGPDGSLLPAKADPYAFQAEKPPHTASVVRGLGTYAWNDGRWMSERADRVATSAPVSIYEVHLGSWRHGGGDRSLSYREMAEQLIPYVKEMGFTHIELLPVSEFPFDGSWGYQPIGLFAPTSRFGEPDDFRHFVDRCHQEGVGVILDWVAGHFPEDAHGLSWFDGTHLYEHSDPRQGRHMDWGTYIFNYGRNEVRNFLLANALFWLEQFHIDGLRVDAVASMLYLDYSRKAGEWVPNKFGGRENLEAIDFLRRMNELVYGRFPGAVTIAEESTAWPMVSRPVHLGGLGFGYKWNMGWMNDTLSYMSQDPIYRRFHQHDLSFGLLYAFTENFVLPLSHDEVVHGKRSILGRMPGDAWQQFANLRAYYGFMWTHPGKKLLFMGCEFAQGREWNHNASLDWHLLDIDWHKGVQALVRDLNGLYAGVPALHDRDTEGYGFSWIDCTDADQSVLAFLRFGETAEDVVMVVCNFTPNPRHGYRLGAPIAGRWREIFNTDSAHYGGSNMGNSVVETEETKSHGHAQSVVLTLPPLATIVLRPDGPITRIA

SEQ ID NO: 5054 - protein, 673 aa, Rhodospirillum rubrum
MSIRARLDAGEPWPLGAMAREGGVNIAVFSEAATQIDLCLFDGDQETRLPLPARTGDIWHGFLPGGGPGLRYGLRAHGPYDPGRGQRFNPHKLLIDPAARRLDGPVVWDKALFGFDPDHPERDLSFSIRDSAAFVPKAVVEADPATRALRSPPDPGRLLIYEAHVKGLTRTHPQVAPEARGTFDGVAGSAVIAHLKHMGVTALELLPVWAFADEPHLPPLGLTNYWGYNPVCLTAPHAAYGPPDSFRRMIDCLHGADIAVILDVVLNHSGEGDEYGPTLSFRGLDNAAYYRLDPTDPRRYLNDSACGNTLRMEHPQVLRLAMDALRYWVGVMGVDGFRFDLAVTPARHKGAFDPSGPFLSAIAQDPLLSRALVIAEPWDVGPGGYQAGRFPKSWMEWNDLARDGLRRFWLANGRSGDLAAVLAGCAARYAPSGRGPRAGVSYISAHDGFTLADMVSYGHRHNNANGESNRDGSAIELSANHGVEGPTNDLAIRSLRDRQRRNLLACLLLSLGVPMIRGGDELGQTQQGNNNVYCQDNPLNWLDWGGADANFAAFAARAGALRARLPQLGRASFLNGFPDAKGKRDVVWLRPDGGEMSPADWDALPRLLAMRLTGAEKASDLLVLINGQPHEQSFRLPPGPAWTIALRSAGDDAPAAAGSSLVVPEMSLVALTS

SEQ ID NO: 5055 - protein, 141 aa, Oryza sativa
PAVPCHIYRSTKKHTNPPVSLTGQLLWRDFFYTVAFGTPNFDQMKGNKICKQIPWTENEELFPAWRDGRTGYPWIDAIMIQLRKWGWMHHLARHSVACFLTRGDLFIHWEKGRDVFERLLIDSDWAINNGNWMGLFWSSFF

SEQ ID NO: 5056 - protein, 764 aa, Silicibacter pomeroyi
MRIACLGGGPAGLYFAISMKLRDPSHQVSVIERNKGDDTFGWGVVLSDDALENLAANDPISAETIRSNFAYWDDIAVVHDGVRTVSGGHGFAGIGRKAMLLLLQDRARELGVDLQFQTEARPIAEYQAEYDLVVACDGLNSRVRSDLAAHFKPDIDTRQCKFIWLGTHQKFDDAFTFIFEKTEHGWMWVHAYQFDEDTATVIVECSQETWDAWGFEHMSKEDSVATCERIFAAHLGGHALMSNASHLRGSAVWINFPRVLCEKWHHENVVLMGDAAATAHFSIGSGSRLAFDSAISLATYLHSEPTMESAFERYQEERRLEVLRLQSAARNSLEWFEQVERYLDMDPVQFNYSLLTRSQRISHENLRLRDADWLRSAEQWFQTRAGAAAEPVRAPMFAPFRLRDMELKNRIVVSPMAQYKAVDGCPTDWHLIHYGERAKGGAGLVYTEMTCVSPKGRITPGCPGLYAPEHEAAWKRLTDFVHGETSAKICCQIGHSGRKGSTQLGWETMDAPLKAENWDLISASPIPWSANNATPREMTRADMDAVRDQFVAAAQMAERAGFDMIELHAAHGYLISSFISPMSNNRSDEYGGSLENRMRYPLEVFTAMRAAWAEERPLSVRISANDWVEEAGVTPEEAVKIAAMFHAAGADIIDVSAGQTSIEAKPVYGRMFQTPFSDRIRNETGIATMAVGNIYEADHANSILMAGRADLICVGRPHLADPYWTLHEAARIGDRHADWPLPYLAGRDQAWRLADRDAETEIRA

SEQ ID NO: 5057 - protein, 435 aa, Arabidopsis thaliana
MGSWIPKLLLLQLVLLLTKHADSSSIIKYLPGFEGPLPFELETGYIGVGEEDEDQMFYYFIKSESNPETDPLLLWLSGGPGCSSFTGLIYENGPLGFKVEAYNGSIPTLVSTTYSWTKVANIIYLDQPVGTGFSYSRNPLADIPSDTGSAKRVDEFLRKWLTKHPEYFSNPFYAGGNSYSGKMVPVIVQEISNGNCIYGKPQIRLQGYVLGSPVTDYDLDRNSRIQFAHGMALISNELYESMKRTCGGNYIFVDPLNTECLELIKDYDNCVSGIYENLILVPKCDLTSPDCHSYRSMLSDYWANNESVRRALKVVEGTTGRWERCKWTLQNNKDIKSSIPYHKKNSIQGYRSLIFSGDHDMLTPYVGTQDWIRSLNYSIIDKWRPWMILDQVAGYTTTYANKMTFATVKGGGHTLDYKPDENSILFKRWISGQLL

SEQ ID NO: 5058 - protein, 682 aa, Escherichia coli
MNMFFRLTALAGLLAIAGQTFAVEDITRADQIPVLKEETQHATVSERVTSRFTRSHYRQFDLDQAFSAKIFDRYLNLLDYSHNVLLASDVEQFAKKKTELGDELRSGKLDVFYDLYNLAQKRRFERYQYALSVLEKPMDFTGNDTYNLDRSKAPWPKNEAELNALWDSKVKFDELSLKLAGKTDKEIRETLTRRYKFAIRRLAQTNSEDVFSLAMTAFAREIDPHTNYLSPRNTEQFNTEMSLSLEGIGAVLQMDDDYTVINSMVAGGPAAKSKAISVGDKIVGVGQTGKPMVDVIGWRLDDVVALIKGPKGSKVRLEILPAGKGTKTRTVTLTRERIRLEDRAVKMSVKTVGKEKVGVLDIPGFYVGLTDDVKVQLQKLEKQNVSSVIIDLRSNGGGALTEAVSLSGLFIPAGPIVQVRDNNGKVREDSDTDGQVFYKGPLVVLVDRFSASASEIFAAAMQDYGRALVVGEPTFGKGTVQQYRSLNRIYDQMLRPEWPALGSVQYTIQKFYRVNGGSTQRKGVTPDIIMPTGNEETETGEKFEDNALPWDSIDAATYVKSGDLTAFEPELLKEHNARIAKDPEFQNIMKDIARFNAMKDKRNIVSLNYAVREKENNEDDATRLARLNERFKREGKPELKKLDDLPKDYQEPDPYLDETVNIALDLAKLEKARPAEQPAPVK

SEQ ID NO: 5059 - protein, 472 aa, Photobacterium profundum
MISPPDKSEFTTMKYQFPENFWWGSASSATQSEGAAFDGGKGDNIWDLWYQEQPNRFFNNVSATKASTFYQNYQTDIALMKEIGHNTFRTSFSWSRLIPTGRGEVNQEAVAFYGKVIDELIANDIEPFICLFHFDMPVAMQELGGWESREVVEAYADFADVCFKLYGDRVKHWFTFNEPIVPVEGGYLYDFHYPNVVDFKRAATVAFNTMLAHAEAVKRYRAQQLDGQIGIILNLTPSYPRSQNTADVKAANIADLLFNRSFLDPSVKGEYPQELIAFLQEHDQMPACQEGDLATIAAGNVDLLGVNYYQPRRIQAKLHTVNTDGPFLPEWFFDYYEMPGRKMNPHRGWEIYEQGVYDILTNLRENYGNIPCYISENGMGVEGEEKFIENGQVKDDYRIDFIKGHLTWLHKAVQEGANCKGYHLWTFIDNWSWANAYKNRYGFYRLDLETQTRTVKRSGEWFAQASKANGFD

SEQ ID NO: 5060 - protein, 172 aa, Glycine max
LHKMGLQGYRNVMENCRDNMLVLKEGLEKTGRFSIVSKDNGVPLVAFTLKDHTHFDEFQISDFLRRFGWIVPAYTMPPDAQHVTVLRVVIREDFSRTLAERLVADVEKVLHELDSLPARVISSTSVTVTAEENGKVVVAKKSAMETQREITAIWKKFVLERKKNNDKMNGVC

SEQ ID NO: 5061 - protein, 376 aa, Saccharum officinarum
  misc_feature (131)..(147): Xaa can be any naturally occurring amino acid
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIANCHATPVRVIQDPGLLQPLCLVGSTLRAPXXXXXXXXXXXXXXXXXVMAVIISSGGDDEQTGRGGISSAMKLWGLVVCHHTSPRCIPLPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADASYLGAAALGDAVCGMAVAYITPSDYLFWFRSHTAKEIKWGGAKHHPEDKDDGQRMHPRSSFKAFLEVVKSRSLPW

SEQ ID NO: 5062 - protein, 119 aa, Brassica napus
MENSATNQTIPLLTPFSMRNFNLSHRIVMAPMARMRSYGSIPQPHAALYYSERATPGGLLISEATGVSETAMAYHDMPGIWTKNQIEAWKPIVDAVHSNGAVSFLLPSSGSDSPPATAP

SEQ ID NO: 5063 - protein, 265 aa, Dechloromonas aromatica
MLEISFIPAFKDNYIWLLTRGKRAFVVDPGDAAPVLARLEAGGLMLEGILITHHHADHQGGVAELKARWQAEVYAPGNESITGCSCPLSGGESIDVLGQKVTVMAVPGHTLGHLAYYAPGALLCGDTLFGAGCGRLFEGTPAQMSASLDSIAALPGDTLIYCAHEYTEMNLRFALAVEPNNQALQARVAKVAALRAAGLPSVPLILAEEKATNPFLRCHEAAVVEAGLQHAASCLLGHAAQQGADIEDRSKTAIFAAIRSWRNTF

SEQ ID NO: 5064 - protein, 332 aa, Schizachyrium scoparium
GYDRVMVYRFHEDEHGEVVAESKRDNLDPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGITPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 5065 - protein, 250 aa, Oryza sativa
MEWDKAKASSGEAVDDRGGGEGGLGYVKVMTDEQMEVLRKQISIYATICEQLVEMHRALTAQQDSIAGMRLGNLYCDPLMVPGGHKITARQRWTPTPMQLQILENIFDQGNGTPSKQKIKDITAELSQHGQISETNVYNWFQNRRARSKRKQAALPNNNAESEAEADEESPTDKKPKSDRPLHQNIAMRDHNSERISEMHHFDTEHEQIRRMMYASNDSSSRSSGSLGQMSFYDNVMSNPSTSYKHPCFI

SEQ ID NO: 5066 - protein, 408 aa, Nicotiana tabacum
MDEATCSTNALPPFLTKTYEMVDDPSSDAIVSWSSSNKSFVVWNPPDFARDLLPRYFKHNNFSSFIRQLNTYGFRKVDPEKWEFANEDNFFRGQPHLLKNIHRRKPVHSHSAQNLHGLSSPLTESERQGYKEDIQKLKHENESLHLDLQRHQQDRQGLELQMQVFTERVQHVEHRQKTMLSALARMLDKPVTDLSRMPQLQVNDRKRRLPGNSCLYNETDLEDTRAISSRALTWENMNPSSLLTINAELLNQLDSSLTFWENVLQDVDQAWIQQNCSLELDESTSCADSPAISYTQLNVDVGPKASDIDMNSEPNANTNPEVAAPEDQAAVAGTTTNVPTGVNDIFWEQFLTENPGSVDASEVQSERKDIGNKKNESKPVDSGKFWWNMKSVNSLAEQLGHLTPAEKT

SEQ ID NO: 5067 - protein, 376 aa, Tripsacum dactyloides
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 5068 - protein, 376 aa, Tristachya superba
ALSIAGAVQSQKLAVRAISRLQALPGGDVKLLCDTVVEHVRELTGYDRVMVYRFHEDEHGEVVAECRRDNLEPYLGLHYPATDIPQASRFLSRQNRVRMIADCHATPVRVIQDPGLSQPLCLVGSTLRAPHGCHAQYMANMGSIASLVMAVIISSGGDDEQTARGGISSSMKLWGLVVCHHTSPRFIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYHGATALGDAVCGMAVTYITPSDYLFWFRSHTAKEIKWGGAKHHPEDKDDGQRMHPRSSFKAFLEVVKSRSLPW

SEQ ID NO: 5069 - protein, 174 aa, Glycine max
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNSQLVHQGSLNYIGLQVQPQHLVMPSMQSHE

SEQ ID NO: 5070 - protein, 376 aa, Urochloa mutica
ALSIAGAVQSQKLAVRAISRLQALPGGDVKLLCDTVVEHVRELTGYDRVMVYRFHEDEHGEVVAECRRDNLEPYLGLHYPATDIPQASRFLFRQNRVRMIADCHATPVRVIQDPGLSQPLCLVGSTLRAPHGCHAQYMANMGSIASLVMAVIISSGGDDEQTARGGISSSMKLWGLVVCHHTSPRFIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYHGATALGDAVCGMAVAYITPSDYLFWFRSHTAKEIKWGGAKHHPEDKDDGQRMHPRSSFKAFLEVVKSRSLPW

SEQ ID NO: 5071 - protein, 280 aa, Campylobacter jejuni
MQEVISYIQKAVLEISNALKFPDTSYSQNQNFTGDTQLKFDVLSDEIITKTLSQCSSIKAIISEEKDEILTLNERANFIVAYDPLDGSSLMDVNFAIGSIFAIYEEKASAKNLRAALYSMYGARLELVICKDQPKLYRLNANNEFIFIKDLRMNEKGKINATGGTQKFWEEKHAKFIKSLFDEGYRLRYSGAMVSDINQILLKGGGIFSYPATQDAPNGKLRAFFEVFPLAFIIEKAGGKTTNGKNRSLLELEFDKIHATTPCFFGSEYEISKLLKAYNE

SEQ ID NO: 5072 - protein, 592 aa, Prosthecochloris aestuarii
MCGIAGELRFDSAAASSTTVDAMLGILEPRGPDAQGVFAHNRICFGHRRLKIIDLSDCASQPMVDSALGLVLVFNGAVYNYRELCTELVGKGYSFFSQSDTEIIIKAYHAWGEDCVGHLQGMFAFAIWERDTGRTFFARDRLGIKPLYFTEDNASMRFASSLPALLKSGAVDTAIDPAALDCYMSFHSVVPAPWTIFRGIRKLPPATTMMVEPDGRKQQRTYWQPDYSRSDEERRRSAGEWIDAVHDALKLAVQRRLVADVPVGVLLSGGLDSSLVVGLLSELVQRHLSTFSVGFEDVAEEEGNEFRYSDIIAERYSTDHHKIFVDHRELQTHLSDCVRAMSEPMVSHDVIGFYLLSREVSQHVRVVQSGQGADEVFAGYHWYPPMMNTPPTEAYSTYSGVFFDRDFNEYRQAVNSSFITEDHAAAFVRNHFAMPGAEEPIDKALRLDSTIMLVDDPVKRVDNMTMAWGLEARVPFLDHELVELAAKIPAEYKVKDGGKYVLKEVGRRIIPHEVIDRPKGYFPVPALKYLEGEYLDMAKNILNQDAAKQRKIFNREYVDMLLNAPQDHITPLRGSKLWQITLLEYWLQEQGL

SEQ ID NO: 5073 - protein, 889 aa, Desulfovibrio vulgaris
MCGIAGIISRKDRNVSSQPLNRMLTSQEHRGPDAGYGVSFRRQSTGAFAAGRRHSADALAAGLEPAPVWLGHRRLSILDLSDKSAQPLRRGDLHIVFNGELFNYIELRSELTALGEHFETSGDTEVLLASYRHWGAGCLERFNGIFAFAIFDASRGSLFAARDPFGVKPFHYGVKPFHYAVTHDFLIFASEIKAISASGLVLRKWDPDVASAYLSYALTTAPQGRTFFENIRQIPPGHCLTLASPDDEPSVTRYYAPRITETPRSLHELVDEGAGLIRQSCRIRMRSDRDVGLCLSSGIDSANVAAALVAEGIAPECYSIDAASSSMLDEFPLITALADKLGLHVNPIRHPDAIPTADIVRYMLFNDEPSLFWGSYNQFHLYREMRKLGVIVSMSGHGGDELFCGYQRYYPAVVRDMLAQRRIMSLIWWCLRQSRHLMQDRRTIRSTWDSYSHPLGWANDYAHDIAALHLKHTIADPEEWISTFVGASSWGEQQQKSLFTYELQYLLRDADRNSMAHGIEERVPLLDTRLYEFCASVPLKDLCQDGYLKGLARQLFPAIPESLRFHQIKRGLYTDISSKLPQLQADLMPLVHRSPLLRELVDLQKLPQQLPGIVWWRLCSLAVLDVSGIEEWTAQTPLPRLVDDEMAERIGGVPSGTGRTAVIRHVLDEGLSYLEPGALHGLAETVGLIESAAIPGCIIEAGCALGGSTMVLATAKAKERPLHVFDVFGCIPPPGSNDGEEARARFAVIAAGESTGLNGKRYYGYEPDLLKNVQDNFVALGLPPAEHGITFVPGLYENTLYPSGPVALAHIDCDWYQSVKTCLERIAPHISPGGRMIIDDYDHYSGCRRAVDEFLEASNGQFIRERYARVHLVRTKADGQETDVHRPGD

SEQ ID NO: 5074 - protein, 1417 aa, Pseudomonas aeruginosa
MNVQQSKFRLSRWAGATLALGLLLSGLGAWGLALVNEQQARMALEREAELLAEAVTRRVELYQYGLRGVRGALLTAGEVHIDRELFRRYSLTRDIDREFPGARGFGFIRRVAAADEAGFLRQARADGQPEFRIQQLTPHDGERYVIQYIEPVARNGQALGLDIASEANRREAARAALETGQVRLTGPITLVQASGLRQQSFLILMPIYRSGITPPPGPQRELEGFGWSYAPLLTGEVLAGLPIDNAAIHLELSDVTGDGAAVPFFVNGAAAPAQRLFGHMLRREIYGRHWQMAFSALPLFVQRLHQPSPRILFLAGSLVSLLLAALVNASALGRLRRRREAATQARLAAIVGNSADGIIGVGLDGVISDWNRGAEALFGYREEQAVGRRVVDLLVPPSKENEELDILARIARKEQVVSFDTVRRHQDGHLLDVAVTVSPILGPDGGVVGASKTVRDISAKKAAEARIRELNTGLEHQIAERTAELRRLNVLLGSVLQAASEVSIITLDRDGIISGFNLGAERMLGYRADEVVGKASPTLLHSERELLARGQELGEEGFRVLVARAEQEGAETREWTYLRKDGSPLSVTLSVTVLRDEAGAINGYLGIAVDVTEWRNAEREMAAARDQLQMAADVARLGIWRWNLADDSLQWNERMCEMYGQPLALRDGGLVYEHWRSRLHPEDLERTEASLRAAVEGRGNYDVIFRVVLPDGGIRFIQAGAQVERDADGNPLQVTGINIDITSDQQLQARLREAKEQADAASAAKSSFLANMSHEIRTPMNAVLGMLQLARQTDLNERQRDYLDKASSAATSLLGLLNDILDYSKIEAGKLVLEMLPFELEPLMQDLAVVLSGNQGDKDVEVIFDIDPELPSAVVGDRLRLQQILINLAGNALKFTARGHVLVSLRRLAHDAHLVRLRVLVADTGIGISAEQQQRIFEGFTQAEASTSRRFGGTGLGLFICKRLVDLMGGELRVESAPGSGSRFWFDLDLDVAHDQPLRAACPGAGEPLRLLVADDNLVAGELLERTVGALGWRADCVGSGSEAVARVQAAMAEGRRYDVVLMDWRMPDLDGLSAAQLIRQLQGDLPPPMVIMITAYGREVLADARDHSAPPFVDFLTKPVTPKQLADSVLHALHGEQGAPANPPPRPVERTQRLRGVRLLVVEDNALNRQVAAELLSSEGARVALADGGLAGVQQVLEASVPFDAVLMDMQMPDIDGLEATRRIRADGRFAGLPILAMTANASLADREACLAAGMNDHVAKPIDKERLVLCLLGHLGRSGARGAPATAADAGELVEARGDIVGRFGGSLELIVQVLRRFVPDMQDLFAQLERQLGEGDVQGSAATLHTIKGSASTVGASALAGRASELEQALRRADPLRGMEILAGIRLDELRTLCDACLLRLQAMFGDVQAESAS

SEQ ID NO: 5075 - protein, 403 aa, Streptomyces avermitilis
MQVIQSTKLANVCYEIRGPVLEEAMRLEAAGHRILKLNTGNPAAFGFECPPEILEDILRNVSSAHGYGDAKGLLAARRAVVMHNQTLGIETDVEHVFVGNGVSELIVMAMQGLLDDGDEVLVPAPDYPLWTASVSLSGGTAVHYHCDEQSDWMPDLADVERKVTDRTKAIVIINPNNPTGAVYDEAMLRGLTDIARRHNLLVCSDEIYDKILYDGATHTPTAAVAPDLLTLTFNGMSKAYRVAGYRVGWMAISGPRAHADSYIEGLTILANMRLCANMPGQHGVVAALSGRQTINELVLPGGRLKEQRDVAHELLTQIPGVSCVKPKGALYLFPRLDPKVFKIKDDRQMVLDLLRREKIMVVQGTGFNWPDPDHFRVVTLPTVGDLTSAITRIGNFLDGYSQP

SEQ ID NO: 5076 - protein, 672 aa, Unknown
  Shewanella sp. ANA-3
MSFPHLLEPLDLGFTQLKNRVLMGSMHTGLEEEKGGFEKLAAFYKERALGGVGLIVTGGISPNLRGRLTPHACQLSFPWQVGKHRIVTQAVHEAGGKICMQILHAGRYGYHPFSQAPSRIKSPITPFTPSAMSSRQVRATIKDYASSAALAKRAGYDGVEVMGSEGYLINQFISSRTNTRTDEWGGSFEKRAQFPIEIVNAIRAKVGKDFIIIFRLSMLDLVDNGSTWDEVVQLAKWLEHVGVSIINTGIGWHEARVPTIATSVPRGAFAWVTEKLKKSVSVPLIATNRINTPEIGEQIIASGQADMVSMARPFLADPEFVNKAAANTPELINTCIGCNQACLDHTFSLKRATCLVNPRACYETEINFLPTNNKKRIAVMGAGPAGMAFSVYAAMRGHEVVLFEAKSEVGGQFNLARKIPGKEEFNETIRYFLNQIKLHKIDLRLNTRLDAKVLETETFDEIVIASGVVPRELSLPGFDSPKVVDYQQVLTGQATIGNKVALIGAGGIGFDMAHYLCESESSTLNPEKWLKQWGIDKQYQHAGGLAEPEVDNSDHRQVYLLQRKTSKMGQGLGKTTGWIHRLVLKQHDVKMKTGVNYDKFDNAGLHIRVGEQTEVLAVDNVILCAGQESNRTLVDEMKATGIPVHLIGGVDVAAELDAKRAIRQGAELAMRL

SEQ ID NO: 5077 - protein, 716 aa, Photobacterium profundum
MQLERAAFSDPFSFLGPQYQSKGIALRVWMPGAVSMVVEIENGEKFPLTREDESGFVLISKMDLTAAVYKLHISWPTGEQTIHDPYQFHGFMPSGDALVSPSKMHSEMGAQLISLNKGGQPISGVRFLTYAPNASAVSVIGEFNAWDGRRHPMQRLDDGLWGLFIPDLEDGTQYKFELKDSSGNSLPHKADPWGYSSEQYPSFTSIVYDQSRYQWQDKAWQTRPVSVKHQEALSFYELHAGSWRRNEQGDFLTYRELAEQLIPYLSEMGYTHLELMPVSEHPFYGSWGYQPIGLFSPTSRFGTPDDFKYFVDQCHLAGIGVVLDWVPAHFPSDDHGLANFDGTALFNDPDPRRGWHQDWKSYIYDYGRDHVRRFLISNALFWLEHYHIDGLRVDAVASMLYLDYSREHDQWIPNHDGGNQNYDAISLLRWMNEEVYSHYPNAMTIAEESTAFSGVSRPTDMGGLGFGFKWNMGWMHDSLSYIQEEPVHRKFHHNTITFPLIYAFSENYVLSLSHDEVVYGKGSLLDKMPGDEWQKSANLRTYMGYMYGQPGKKLNFMGAEIAQSAEWSHDGQLEWHWLEYPRHNGMKKLVSDLNHLYQDLPALHELDCSPEGFEWRVQDDAETSVLAHERFALNGDKVLVVSNFTPVPREGYTLGVPAEGEYEVLLNTDAEKYWGSGTPIQQTVKTQLLEKHGLAQSISLDLPPLSTVFLAFKQHA

SEQ ID NO: 5078 - protein, 159 aa, Glycine max
MDFRVMGLESPLFHTLQHMMDMSEDGAGDNKTHNAPTWSYVRDAKAMAATPADVKEYPNSYVFEIDMPGLKSGDIKVQVEDDNLLLICGERKRDEEKEGAKYLRMERRVGKLMRKFVLPENANTDAISAVCQDGVLSVTVQKLPPPEPKKPRTIQVKVA

SEQ ID NO: 5079 - protein, 484 aa, Streptococcus sinensis
CGVAILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIEAAVATAVSALKETAIPVSNKEAIAQVAAVSSRSEKVGEYISEAMEKVGNDGVITIEESKGMETELDVVEGMQFDRGYLSQYMVTDSEKMVADLDNPYILITDKKISNIQEILPLLESILKTNRPLLIIADDVDGEALPTLVLNKIRGTFNVVAVKAPGFGDRRKAMLEDIAILTGGTVITEDLGLELKDATIEALGQASKVTVDKDSTVIVEGSGNPEAIANRVVVIKSQIESTTSEFDKEKLQERLAKLSGGVAVIKVGAATETELKEMKLRIEDALNATRAAVEEGIVSGGGTAFVSVLGAVAALELTGDEATGRNIVLRALEEPVRQIALNAGFEGSIVIDRLKNSEAGTGFNAATGEWVNMIEAGIIDPVKVTRSA

SEQ ID NO: 5080 - protein, 493 aa, Cucumis melo
MGFHQTHETNQVLLSKIAISDGHGEDSPYFDGWKAYDNDPFHPENNPLGVIQMGLAENQLSPDLIVDWIRKHPKASICTDEGLLNFKDIANFQDYHGLPEFRNAIASFMGKARGGRVKFDPSRIVMGGGATGASETVIFCLADPGDAFLIPSPYYAAFDRDLQWRTRAQIIPVHCNSSNNFQITREALEVAYKKAEESNIKVKGLIITNPSNPLGTIYDRDTLKSLVNFVNDNNIHLICDEIYSATVFKSPSFTSIAEIIEEMDHCKKELIHILSSLSKDMGLPGFRVGILYSYNDTVVSIARKMSSFGLVSSQTQHLLAAMLSDEEFVDNFLVENSKRLAKRHARFTEELEKMGITCLNSNAGLFVWMDLRKLLKDQSFESEMELWRVIINEVKLNVSPGSSFHVTEPGWFRVCFANMDDNTVGVALDRIHSFVGKIDKKENSTIPMPPKKKHRENKLRLSFSFSGRRYEEGNVLKSPHMMSPHSPLVRAKT

SEQ ID NO: 5081 - protein, 445 aa, Zea mays
GREPPPFLHLPRNADAATSAPSPTRARHAGRRLRWRSGSGSQQRRGSPRLSGSLSPIALRPRSVPLLTGRFCVAIFSSIACSPTSQFRRLQFLDLSIKSRPYHFSQSCLMALAAAPASGDSQSGPQRNYQVVEMRKHRIVSLVAALLVLLALAAVSSTRSAQKESVADNAGMLAGGIKDVPANENDLQLQELARFAVNEHNQKAVWCRHVSPGVKMPKDYCYESGPRRWDPDPHVCRLGPRRWVYDLHVYRPDPAGRSRISVYVNWTLTRGVQDFKPAYTLGLCSGSNDRAARYRGGRSCHIDTRMVHTVTRMLLRHAVASQRRVRGQRHNGQPLAQAEYPLQCQQLASITINSCARQHGRSLHTSAYQTPLRSRFEPAERNALLGFEKLVKAKTQVVAGTMYYLTIEVKDGEVKKLYEAKVWEKPWENFKQLQEFKPVEEGASA

SEQ ID NO: 5082 - protein, 420 aa, Lotus corniculatus
MVLSNTASSGSESDLSIHSTFASRYVRTSLPRFKMPQESIPKEAAYQIINDELMLDGNPRLNLASFVTTWMEPECDKLIMASINKNYVDMDEYPVTTELQNRCVNMIAHLFNAPLGDSDTVGTVGSSEAIMLAGLAFKRTWQNRRKAEGKPHDKPNIVTGANVQVCWEKFARYFEVELKEVKLSEGYYVMDPQKAVDLVDENTICVAAILGSTLNGEFEDVKRLNDLLIEKNKETGWDTPIHVDAASGGFIAPFIYPELEWDFRLPLVKSINVSGHKYGLVYAGIGWVIWRNKEDLPEELIFHINYLGADQPTFTLNFSKGSSQIIAQYYQLIRLGYEGYKHVMENCRDNMLVLKEGLQKTGRFEIVSKDNGVPLVAFTLKDHTHYNEFQISDSLALRVDSAGIQHAPKYSARDRGPCSH

SEQ ID NO: 5083 - protein, 490 aa, Cucumis melo
MVLVSSNDNGNAKKVLSKLAKGNGHGEDSSYFDGWKAYDSDPFHPIINPRGVIQMGLAENQLSFEFVEKWMKNNPQASICSVEGIDEFKDIAIFQDYHGLPEFRNAVANFMGKVRGNRVKFDPDRVVMSGGATGAHETMAFCLADPGEAFLVPVPYYPGFDRDLRWRTGVEIVPVKCESSNNFKLTREALETAYEEAEKSNIRIKGLLITNPSNPLGTVYDRQTLETAVSFINEKNIHLVCDEIYAATVFSEPGFISISEVIDNMNDVECDRNLIHVVYSLSKDMGFPGFRVGIIYSYNDAVVACARKMSSFGLVSSQTQYLIASMLLDDVFVDNFLAGSAEKLAVRHRNFTKGLAQVGIGYLKGSGGLFLWMDLRHLLKEKTLEAEMALWKVIINEVKLNVSPGSSFHCSEPGWFRVCFANMDDSTMDISITRIRNFVLQNKEVTTKVKKQKFCWRQSSLELRLSSRRLEDVMSPHSPLPQSPMLRATT

SEQ ID NO: 5084 - protein, 1128 aa, Oryza sativa; identical to SEQ ID NO: 163

SEQ ID NO: 5085 - protein, 233 aa, Zea mays
MVQEGRMLLNYVTMNDIVIRKILKKYDKSPWLIELGAFHLNCDASDAYEGFHGVKSAPPEANNLYAQRFKWFVTFIDCYTCMTWIYMLKHKNEVLRCFKDFHNLVTNQFNAKFFEDFSSANESNCKGYKSDSEKGENGTQEGIINGRIPSLMDEIVIRLDDANERNDVHDNNLVVVVGTILCPRNYTGGNQDKEVRPDDMKANEKRVIVYQRRRYKNQGANDATKATITSSLV

SEQ ID NO: 5086 - protein, 482 aa, Arabidopsis thaliana
MDVSKVTTSDGGGDSMETKPSPQPQPAAILSSNAPPPFLSKTYDMVDDHNTDSIVSWSANNNSFIVWKPPEFARDLLPKNFKHNNFSSFVRQLNTYGFRKVDPDRWEFANEGFLRGQKHLLQSITRRKPAHGQGQGHQRSQHSNGQNSSVSACVEVGKFGLEEEVERLKRDKNVLMQELVRLRQQQQSTDNQLQTMVQRLQGMENRQQQLMSFLAKAVQSPHFLSQFLQQQNQQNESNRRISDTSKKRRFKRDGIVRNNDSATPDGQIVKYQPPMHEQAKAMFKQLMKMEPYKTGDDGFLLGNGTSTTEGTEMETSSNQVSGITLKEMPTASEIQSSSPIETTPENVSAASEATENCIPSPDDLTLPDFTHMLPENNSEKPPESFMEPNLGGSSPLLDPDLLIDDSLSFDIDDFPMDSDIDPVDYGLLERLLMSSPVPDNMDSTPVDNETEQEQNGWDKTKHMDNLTQQMGLLSPETLDLSR

SEQ ID NO: 5087 - protein, 235 aa, Oryza sativa
MAPRAATVEKVAVAPPTGLGLGVGGGVGAGGPHYRGVRKRPWGRYAAEIRDPAKKSRVWLGTYDTAEEAARAYDAAAREFRGAKAKTNFPFASQSMVGCGGSPSSNSTVDTGGGGVQTPMRAMPLPPTLDLDLFHRAAAVTAVAGTGVRFPFRGYPVARPATHPYFFYEQAAAVAAAEAGYRMMKLAPPVTVAAVAQSDSDSSSVVDLAPSPPAVTANKAAAFDLDLNRPPPVEN

SEQ ID NO: 5088 - protein, 273 aa, Lactobacillus gasseri
MKQLTLNNDVKIPIFGFGTYEISPDQTKQAVLSAFEEGYRLIDTAQYYQNEQQVGEAVKASGLNRDEVFITTKTMTDGYEDTKIGLDESLRRIGLDYFDLVLIHWPMGHDIDTWHALEAAYKAGKTRAIGISNFNSRQTLDLIHQSSVRPMVDQIETHLFLQQWKMHEFLEKENIVHESYSPLGNGQQNLISNPVLKEISEKYGKSPIQVILRYLVQNDVVTIPRSTNPAHIKSNIDIFDFELDNDDLKRLRVLDERKPIDGWPAEMREDEDY

SEQ ID NO: 5089 - protein, 334 aa, Erwinia carotovora
MKTLGEFIVEKQHDFSHATGELTALLSAIKLGAKIIHRDINKAGLVDILGASGISNVQGEVQMKLDLYANEKLKAALKARGEVAGIASEEEDEIVIFEGDKAENAKYVVLMDPLDGSSNIDVNVSVGTIFSIYRRITPLGTSVTEADFLQPGSQQVAAGYIVYGSSTMLVYTTGHGVHAFTYDPSLGVFCLSHEKVCFPEKGNMYSINEGNYIKFPSGVKKYIKYCQEQDEETQRPYTSRYIGSLVADFHRNLLKGGIYLYPSTASYPKGKLRLLYECNPMAFLAEQAGGKASDGKHRILDITPEKLHQRSPFFVGTESMVDDVERFIREFPDA

SEQ ID NO: 5090 - protein, 355 aa, Anabaena variabilis
MTHLFEPLRIREVTFRNRIALSPMCQYSSTNGFANDWHLVHLASRAVGGAGLVMTEAAAVEARGRISPQDLGIWSDAHIEALARTVSLIHNFGAVAAIQLAHAGRKASTSKPSKGGKFIDESQEGWRPVVSSSAIAFSKESPVPEALSIEGIQQVIQAFVQATKRSLQAGFKVIEIHAAHGYLLHQFLSPLVNQRQDDYGGSFENRTRLLREVVEAVREVLPESYPLFVRLSATDWVDKGWDIEQSIAISDKLKSLGVDLIDCSSGGVIPGINIPVKPGYQAQFAERIRKEANIPTGAVGLITSPEQADQIIRSGVADIVLLGRELLRNPYWPHLAAKELGHEKHWPVQYDRAWL

SEQ ID NO: 5091 - protein, 399 aa, Saccharomyces cerevisiae
SFVKDFKPQALGDTNLFKPIKIGNNELLHRAVIPPLTRMRALHPGNIPNRDWAVEYYTQRAQRPGTMIITEGAFISPQAGGYDNAPGVWSEEQMVEWTKIFNAIHEKKSFVWVNLWVLGWAAFPDNLARDGLRYDSASDNVFMDAEQEAKAKKANNPQHSLTKDEIKQYIKEYVQAAKNSIAAGADGVEIHSANGYLLNQFLDPHSNTRTDEYGGSIENRARFTLEVVDALVEAIGHEKVGLRLSPYGVFNSMSGGAETGIVAQYAYVAGELEKRAKAGKRLAFVHLVEPRVTNPFLTEGEGEYEGGSNDFVYSIWKGPVIRAGNFALHPEVVREEVKDKRTLIGYGRFFISNPDLVDRLEKGLPLNKYDRDTFYQMSAHGYIDYPTYEEALKLGWDKK

SEQ ID NO: 5092 - protein, 473 aa, Unknown
  Frankia sp. EAN1pec
MALHGRARGRRGDQAVEVRPHLVIPDEDGPVPRYRMPRSSMSAETAYQIVRDELMLDGNARLNLATFVTTWMDEHADRLMTECAAKNMIDKDEYPQTAELEARCVNMLADLWHAPDATDAVGCSTTGSSEACMLAGLAMLRRWRSTREPHRGEQGGGQRGTGARPNIVMGANVQVCWEKFARYWDVEPRLMPLAPGRTHLTAPEAVARCDENTIGVVAVLGSTFDGTYEPVAEIVAALDQLAASGGPDVPVHVDGASGGFIAPFCDPDLVWDFRLERVVSINASGHKYGLVYPGVGWALWRDARHLPAELVFDVDYLGGSMPTFALNFSRPGAQVVAQYYSLLRLGRAGYRHTARTCRDNARWLADEIAKLGPFELISDGSGIPAFAFTTRDAAEFSVFEVSEALRARGWLVPAYRFPPDLAELAVLRIVVRAEFSRDLAHLLVEDLHRVVGRLSGPRWRTAAGGADLASFHH

SEQ ID NO: 5093 - protein, 625 aa, Zea mays
MAGPEKTVVWFRRDLRIQDNPALAAAAKGGSVLPIFIWCPSDYGQYYPGRCSRWWLKQSLVHLGKSLELLGCPLVLIRAEDSTLAALLECVRSISATRVVYNRLYDPISLVLDNKIKNELPAHGISIQSFNGDLLYEPWDVYDENGQAFTTFNKYWEKCMSLPIEISQYLAPTRLVAAPGLANVRCCSIDDLGLESSKDVESSNALLSRAWSPGWRNAENMLEEFVSYGLLEYSEHGMKVGGSTTSLLSPYLHFGELSVRMIYQLVKMRQVKWQNEGKSEAEESVRLFLRSIGFREYSRYLCFNYPFTHERSFLGNLKHYPWLLDEGRFKSWRQGMTGYPLVDAGMRELWATGWTHNRIRVIVSSFAVKFLQIPWIWGMKYFWDVLLDADLESDILGWQYISGSLPDGHELSRLDNPEVQGQKYDPDGEYVRTWIPELARMPTEWIHSPWAAPNSILQVAGVELGFNYPKPIVELHMARECLDDAISTMWQLDTAAKLAELDGEVVDDNLNNIRNFDIPKVVLNKKLSPSTSSMEHRVLSTNGKDEKSQPTEVKALYKQIIRDDMMNDSNMDDTCSTANLKVTRKRSSSDSYFQKTADRDGTSKVEDNDSEDSGTSISRPSKKAA

SEQ ID NO: 5094 - protein, 293 aa, Brassica napus
  misc_feature (285)..(285): Xaa can be any naturally occurring amino acid
ISHSAGPRLLDRSDFPDDFIFGTATSAFQTEGATSVGGKSPTIWDYFSHTFPERTNMQNADVAVDFYHRYKDDIKLLKELNMDSFRFSISWARLIPSGKVEDGVNKEGLQFYNALIDELLAHGIRPSVTLYHWDHPQALEDEYGGFLSPQIIEDFRNFARVCFENFGDKVKLWTTINEPSVISIAGYDTGNKAVGRCSKWVNNKCQAGDSATEPYIVSHHLLLSHAAAVQEFRKCNKTSKDGKIGIVISPPWLEPYDFTSSADKHAVERGLTVEIDWHLDPGSLXGDYPKIMK

SEQ ID NO: 5095 - protein, 728 aa, Escherichia coli
MSDRIDRDVINALIAGHFADPFSVLGMHKTTAGLEVRALLPDATDVWVIEPKTGRKLAKLECLDSRGFFSGVIPRRKNFFRYQLAVVWHGQQNLIDDPYRFGPLIQEMDAWLLSEGTHLRPYETLGAHADTMDGVTGTRFSVWAPNARRVSVVGQFNYWDGRRHPMRLRKESGIWELFIPGAHNGQLYKYEMIDANGNLRLKSDPYAFEAQMRPETASLICGLPEKVVQTEERKKANQFDAPISIYEVHLGSWRRHTDNNFWLSYRELADQLVPYAKWMGFTHLELLPINEHPFDGSWGYQPTGLYAPTRRFGTRDDFRYFIDAAHAAGLNVILDWVPGHFPTDDFALAEFDGTNLYEHSDPREGYHQDWNTLIYNYGRREVSNFLVGNALYWIERFGIDALRVDAVASMIYRDYSRKEGEWIPNEFGGRENLEAIEFLRNTNRILGEQVSGAVTMAEESTDFPGVSRPQDMGGLGFWYKWNLGWMHDTLDYMKLDPVYRQYHHDKLTFGILYNYTENFVLPLSHDEVVHGKKSILDRMPGDAWQKFANLRAYYGWMWAFPGKKLLFMGNEFAQGREWNHDASLDWHLLEGGDNWHHGVQRLVRDLNLTYRHHKAMHELDFDPYGFEWLVVDDKERSVLIFVRRDKEGNEIIVASNFTPVPRHDYRFGINQPGKWREILNTDSMHYHGSNAGNGGTVHSDEIASHGRQHSLSLTLPPLATIWLVREAE

SEQ ID NO: 5096 - protein, 468 aa, Streptococcus suis
MSKTLPKDFIFGGATAAYQAEGATKTDGKGPVAWDKYLEDNYWYTAEPASDFYNRYPVDLKLAEEYGVNGIRISIAWSRVFPTGYGEVNRKGVEYYHNLFAECHKRGVEPFVTLHHFDTPEALHSNGDFLNRDNIDHFVAYAAFCFEEFPEVNYWTTFNEIGPIGDGQYLVGKFPPGIQYDLAKVFQSHHNMMVSHARAVKLYKDKGYKGEIGVVHALPTKYPYDPANPDDVRAAELEDIIHNKFILDATYLGRYSEKTMEGVQHILAANGGELDLREEDFSILEAAKDLNDFLGINYYMSDWMQAFDGETEIIHNGKGEKGSSKYQIKGVGRREAPVNVPKTDWDWIIYPQGLYDQIMRVKADYPNYKKIYITENGLGYKDEFVDGTVYDDGRIDYVKKHLEVISDAISDGANVKGYFIWSLMDVFSWSNGYEKRYGLFYVDFETQERYPKKSAHWYKKVAETQVID

SEQ ID NO: 5097 - protein, 308 aa, Triticum aestivum
  misc_feature (171)..(172): Xaa can be any naturally occurring amino acid
  misc_feature (253)..(254): Xaa can be any naturally occurring amino acid
  misc_feature (257)..(257): Xaa can be any naturally occurring amino acid
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKVTFVDPKLRGKYCVCFDPLDGSSNIDCGVSIGTIFGIYMIKNQDTVTLEEVLQPGKDMIAAGYCMYXXSSCTLVLSTGNGVNGFTLDPSLGEFILTHPNIKIPNKGKIYSVNEGNARNWDAPTAKYVERCKFPQDGSSPKSLRYIGSMXXDVXRTLLYGGYSVPADKKTQREALFVQGSMSSDGQPRQSSRKVPTSAQRSGHIE

SEQ ID NO: 5098 - protein, 268 aa, Arabidopsis thaliana
MEVTSQSTLPPGFRFHPTDEELIVYYLRNQTMSKPCPVSIIPEVDIYKFDPWQLPEKTEFGENEWYFFSPRERKYPNGVRPNRAAVSGYWKATGTDKAIHSGSSNVGVKKALVFYKGRPPKGIKTDWIMHEYRLHDSRKASTKRNGSMRLDEWVLCRIYKKRGASKLLNEQEGFMDEVLMEDETKVVVNEAERRTEEEIMMMTSMKLPRTCSLAHLLEMDYMGPVSHIDNFSQFDHLHQPDSESSWFGDLQFNQDEILNHHRQAMFKF

SEQ ID NO: 5099 - protein, 215 aa, Fagus sylvatica
MARRADEEYDYLFKVVLIGDSGVGKSNLLSRFTRNEFCLESKSTIGVEFATRTLQVEGRTVKAQIWDTAGQERYRAITSAYYRGAVGALLVYDVTKPTTFEQVWLKELRDHADSNIVIMLIGNKTDLKHSRAVRTEDAQGFMLRKKALSFIETSALKATNVEKAFQTILCLRFTGIISKKSLSSDEPAPSVIKEAVKHIVVGGSEANTKKPCCSN

SEQ ID NO: 5100 - protein, 505 aa, Yarrowia lipolytica
MIRADRHTYKVFNQEFTIDKRFQVTKELGHGAYGIVCAAKYTGTPDGPGVAIKKVTNIFSKNILCKRALRELKLLNHFRGHKNITCLYDMDIVDTNNFNELYLYEELMECDMHQIIRSGQPLTDAHYQSFVYQILAGVKYIHSADVLHRDLKPGNLLVNADCELKICDFGLARGFSSDDEKNAGFLTEYVATRWYRAPEIMLSFQSYTKAIDIWSVGCILAELLGGKPLFKGKNYVDQLNQILHYLGTPSEETLKRIGSPRAQEYVRGLPFMPKIPFSTLFPTANPEALDLLEKMLAFDPAERVTVEEALEHPYLKIWHDPRDEPVCPTPFDFSFEEVNDMEAMKQMILDEVVDFRAMVRKPVDEQTRIRDEQIEEQRREEEKQEVERQQKEAERQKQHQQEAERQQHQQQQHHPQQQDSPSTLSGFSDSDQSANPHFYEYAGFGVGSQTSDMGQPPVIQRKDSLGIPEEDFKYQDPPPKPQESGRQGDGDLELELEYGLDGWRS

SEQ ID NO: 5101 - protein, 328 aa, Papaver rhoeas
IGRGAYGIVCAAINSETREEVAIKKIGNAFDNRIDAKRTLREIKLLRHMDHENIIAIKDIIRPPQRESFDDVYIVYELMDTDLHQIIRSTQQLTDDHCQYFLYQLLRGLRYVHSANVLHRDLKPSNLFLNANCDLKIGDFGLARTTSETDFMTEYVVTRWYRAPELLLNCSEYTAAIDIWFVGCILGEILTREPLFPGKDYVHQLRLITELLGSPDDSSLGFLRSDNARRYVRQLPQYPKQHFSARFSQMSQGAIDLLEKMLVFDPSKRITVEEALCHPYLKSLHDINDEPICARPFNFDFEQPSFTEVNIKEPIWRESVKFNPDPTH

SEQ ID NO: 5102 - protein, 210 aa, Zea mays
  misc_feature (187)..(187): Xaa can be any naturally occurring amino acid
DARRFRSGIPGSTHASGRLLILQGSHGRAQPASSGLTDETAFSCCSDPDPSTKDFLLQQTMLRIKDPKKSLDFYTRVLGLTLLQKLDFPAMKFSLYFLAYEDKNDIPKDKSEKTAWTFSRKATLELTHNWGTEDDETQSYHNGNSDPRGFGHIGIAVPDVYSACKRFEELGVKFVKKPDDGKMKGLXAFIQDPDGYWIEILNPNKIATII

SEQ ID NO: 5103 - protein, 264 aa, Prochlorococcus marinus
MKWTLITPLPKETMLGKKSDFTIHPINVLQDNIVWVWVHNCNAVVVDPSISGPVEKWLLEKNLSLKAILQTHHHDDHIGGTQKLIKTWPEAKVVASKKEHKRIPFQTFSVDDNDIFNLMDAEIKVIEVHGHTDNHIAFYISKQNAKCNILFPGDTLFGGGCGRLLEGSPVQMFESLYKLNSLPENTEIYPAHEYTESNLKWALSLEPGNISIIERLKLIQKKLQKGMSSLPSTLSEERKTNLFLIAENVEKFTMLRKHKDRWKC

SEQ ID NO: 5104 - protein, 225 aa, Unknown
  Petunia x hybrida
MGRGKIEIKRIENNTNRQVTFCKRRNGLLKKAYELSVLCEAEIALIVFSTRGRVYEYSNNNIRAIIDRYKKATVETSNAFTTQELNAQFYQQESKKLRQQIQLIQNSNRHLVGEGLSSLNVRELKQLENRLERGIARIRSKKHEMILAESEDLQKREIQLEQENAFLRSKIAENERLQELSMMPAGGQEYNAIQQYLARNMLQLNMMEGVPSYPLPSDKKSLDLE

SEQ ID NO: 5105 - protein, 167 aa, Triticum aestivum
MAMMKMTHDDYVHLCLMALASVATGGDQAQAAKGQWLQTVTAAAPAASELRFRCSVCGKAFPSHQALGGHKASHRKRAALVLPLQSVSPAEETVASSTSSGVGGHRCSVCHRSFATGQALGGHKRCHYWDGLSVSLTASASRSGSGSSVRDFDLNLTPVPEKAVGGM

SEQ ID NO: 5106 - protein, 532 aa, Arabidopsis lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALCIHEKFTKQRHQRPLLVALTGNT

SEQ ID NO: 5107 - protein, 404 aa, Neisseria gonorrhoeae
MDKFPKSAKLDHVCYDIRGPVHKKALQLEEEGNKILKLNIGNPAPFGFEAPDEILVDVIRNLPTSQGYCDSKGLYSARKAIVHYYQNKGLRDITVNDVYIGNGVSELIAMSMQALLNDGDEILIPAPDYPLWTAAATLAGGTVRHYLCDEENGWFPNLADMEAKITSKTKAIVVINPNNPTGAVYSKEILLEIAELARKHGLIIFADEIYDKILYDGAVHYHIAALAPDLLTVTFNGLSKAYRVAGFRQGWMVLNGPKHHAKGYIEGLDMLSSMRLCANTPMQHAIQTALGGYQSINEFILPGGRLLEQRNRAWELVNQIPGVSCVKPMGAMYMFPKIDTEMYRIRDDMKFVYDLLVREKVLLVQGTGFNWIKPDHFRIVTLPYVHQIEEAMGRLARFLQTYHQ

SEQ ID NO: 5108 - protein, 632 aa, Escherichia coli
MVSYFYPSLKSPHSIKPVKNYRSINKYTQKPSPFSSISNRHYVFYFSTAKSLAHRAALRHFFNKQTQHAVNTRLTEKVMCSIFGVFDIKTDAVELRKKALELSRLMRHRGPDWSGIYASDNAILAHERLSIVDVNAGAQPLYNQQKTHVLAVNGEIYNHQALRAEYGDRYQFQTGSDCEVILALYQEKGPEFLDDLQGMFAFALYDSEKDAYLIGRDHLGIIPLYMGYDEHGQLYVASEMKALVPVCRTIKEFPAGSYLWSQDGEIRSYYHRDWFDYDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKKFLDVAMRINPQDKMCGNGKMEKHILRECFEAYLPASVAWRQKEQFSDGVGYSWIDTLKEVAAQQVSDQQLETARFRFPFNTPTSKEAYLYREIFEELFPLPSAAECVPGGPSVACSSAKAIEWDEAFKKMDDPSGRAVGVHQSAYK

SEQ ID NO: 5109 - protein, 409 aa, Rubrivivax gelatinosus
MAMELVSTMWNGAINGLAHGWLHATWWQVLLCTLVFTHVTIAAVTIYLHRSQAHRALDLHPAVAHFFRLWLWLSTGMVTKEWVAIHRKHHAKCETEDDPHSPQTRGIKKVLLEGAELYRAEAKNAETLSKFSHGTPDDWVERNLYTRYSWQGVGVMLLVNVFLFGAAGLTVWAVQMMWIPINAAGIINGLGHFWGYRNFEAPDASTNVSPWGVIIGGEELHNNHHTYPTSAKFSIKPYEFDIGWVYISVLVKCGLASVRKTAPKLALGTIRPVADSQTLEAIIAHRYELMAGYGRELKAACRVELARLKAEGQQHSPKWNQLHLAHRWLHRDDDRIPQAVRLQVETARAEHPVLDKLVTMREELRQLWTRTNVSAEQLVADLQAWCKKAEESGIAALQEFALRLRSAHA

SEQ ID NO: 5110 - protein, 277 aa, Staphylococcus aureus
MEVKTFYNGNTMPQIGLGTFRVENDENCMESVKYAIEQGYRSIDTAKVYGNEEQVGAGIRAGLESTGIAREDLFITSKLYFEDFGRENVAAAYEASLSRLGLKYLDLYLVHWPGTNEAVMVDTWKGMEDLYKNNKVKNIGVSNFEPEHLEALLAQVSIKPVINQVEYHPYLTQHKLKLYLAAQHIVMESWSPLMNAQFLNDETIKDIAQELGKSPAQVVLRWNVQHGVVTIPKSVTPNRISENFRIFDFELSDEQMTRIDGLNQDKRIGPDPKTFEG

SEQ ID NO: 5111 - protein, 109 aa, Ashbya gossypii
MSSSVPYDPYVPPEGAQSQSKAAALKAEIDDTVGIMRDNINKVAERGERLTSIQDKADNLAVSAQGFKRGANRVRKQMWWKDLKMRLCLVLVVVLLLIVIIVPIVVHFT

SEQ ID NO: 5112 - protein, 719 aa, Chlamydophila caviae
MVERIINSEDISLLISGRQSNPHKFLGIISESSSQDRIILFRPGAHFVAIELQGNIAQATHHHSGIFSLVTPKGTLPHDYRIYHQNGLLAHDPYAFSPLWGEMDSFLFHQGTHYKIYERMGAIPCDVGGILGVLFVVWAPHAQRVSVVGDFNYWNGLVNPLRKVSDSGVWELFIPGLDEGTLYKWELVTASGEVLIKTDPYGKGFDIPPQVTSRVINSDRYTWHDQKWMENRKNTKDQPLAIYEVHVGSWQWDNGRPLGYRELAKRLAQYCKELHYTHVELLPITEHPLNESWGYQVTGYYAPTWRYGSFQDFQFFVDHLHCEGIGVILDWVPGHFPTDSFALASFDGEALYESVDHKDPLHPHWHTYTFDYRCSEVVNFLIGSALFWLDKMHIDGLRVDAVTSMLYLDYGRKAGEWSPNIYGGNENLDAIEFIKHFNSVVHREFPAVLTFAEESTDFPKVTESVDSGGLGFDYKWNLGWMHDTFRYIKVDPIFRSYHHNDLTFSLWYAFNERYLLPLSHDEVVHGKGSLLQKIPGDTWTKFAHMRLLLSYQICQPGKKLVFMGGEFAQWKEWSPDNSLDWHLLDNPYHASLHKCVAKMNALYCELPYFWKGDHKQESFLWVDFKDTKNNVISYYRFSGEDRSSALLCIHHFSSEYFPSYVLHCQGIKTCELLFNSDDISFGGSGKGNRLPILCVDHNIPWGIAIELPPLATLIFQVSF

SEQ ID NO: 5113 - protein, 423 aa, Ashbya gossypii
MLRWIPTRICPRLCTRGFASSCARLAQGPAFFVKPITPNDLFVSCTVFNEKGAVTGVSERYPKLSFLRDRGLYPRDLRKLDTSSIEVIPSIVVKPTCILVNLLHIKAVIEKNRVYVFDTTSKEAAARLGVLMYDLESKLASHSSQPAQHYEHRALESILVNVMTCLETEFKHLSKQCGLVLNELEDQIDRDKLRDLLIHSKDLTSFYQKSLLIRDMLDELLESDEDLAAMCLSPAPGTVEADAAEVEMLLETYYKQCDEYVQQSGSLLQNIKSTEDVVNIILDANRNSLMLFELKVTIYTLGFTVATLLPAFCGMNLKNFIEESVWGFGGVLAVSAVAGLAVTASNFKALRNVARLTVMNSHSTSPGAKNISSARLHLDRDVPTLWMRLKTAFRTIWFGKSRPSRDGRQRDMIWKWLLDDTSK

SEQ ID NO: 5114 - protein, 492 aa, Raphanus sativus
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLVSKSGKVLFVKFHWKPTCGIKNLTDEEAKVVGGANHSHATKDLHDAISSGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPIPNKSYTGIRTKCIIKKENNFKQAGDRYRSWAPDRQDRFVKRWVEILSEPRLTHEIRSIWISYWSQADASLGQKLASRLNVRPSI

SEQ ID NO: 5115 - protein, 521 aa, Triticum aestivum
  misc_feature (36)..(36): Xaa can be any naturally occurring amino acid
  misc_feature (187)..(187): Xaa can be any naturally occurring amino acid
  misc_feature (286)..(286): Xaa can be any naturally occurring amino acid
  misc_feature (315)..(315): Xaa can be any naturally occurring amino acid
  misc_feature (406)..(406): Xaa can be any naturally occurring amino acid
  misc_feature (419)..(419): Xaa can be any naturally occurring amino acid
  misc_feature (434)..(434): Xaa can be any naturally occurring amino acid
  misc_feature (443)..(443): Xaa can be any naturally occurring amino acid
  misc_feature (455)..(455): Xaa can be any naturally occurring amino acid
  misc_feature (476)..(476): Xaa can be any naturally occurring amino acid
  misc_feature (478)..(478): Xaa can be any naturally occurring amino acid
MVLSHAASAGSSDESVHSTFASRYVRASLPRFRMPXNSIPKEAAYQIINDELMLDGNPRLNLASFVTTWMEPECNKLMMDSINKNYVDMDEYPVTTELQNRCVNMIAHLFNAPLGETETAVGVGTVGSSEAIMLAGLAFKRRWQNKMKAAGKPCDKPNIVTGANVQVCWEKFARYFEVELKEVKLSXGYYVMDPEKAVEMVDENTICVAAILGSTLNGEFEDVKMLNDLLVKKNEETGWDTPIHVDAASGGFIAPFLYPELEWDFRLPLVKSINVSGHKYGLVYAXGIGWCIWRSKEDLPDELIFHINYLGADQXPTFTLNFSKGSSQVIAQYYQLIRLGFEGYRNIMGHCQENAMVLKEGLERTGRFNIVSKDQGVPLVAFSLKDSSRHDEFEISEFLRRFGWIXVPAYTMPPNAQHXTVLRVVIREDFNRTXAERLLIDIXKCSTTRPLPSRXNGARPAHPTANCEREGLASNXVXSLWKKASRKKKTRVLTWHRSHLHMVNPISIPAVFKTFHNYKVS

SEQ ID NO: 5116 - protein, 196 aa, Neisseria gonorrhoeae
DPLAGIPAELKTIPMAVLVNSGSASASEIVAGALQDHKRAVIVGTQSFGKGSVQTLIPLSNGSAVKLTTALYYTPNDRSIQAQGIVPDVEVKDKERTFESREADLVGHIGNPLGGEDVNSETLAVPLEKDADKPAAKEKGKKKKDEDLSSRRIPNPAKDDQLRKALDLVKSPEQWQKSLGLAAKKPVSNKDKKDKK

SEQ ID NO: 5117 - protein, 778 aa, Pseudomonas fluorescens
MVQHPMDIKFTHRLSYKQARLTVLVGFILGTLLSLLQIGIDYASEDASINREILSLLEISHNPASRIAYNIDAELAQELTLGLLRSPAIISARLTDNNQTVLASVKRPELQSGYRMISDFLFGAKRQFEDRLYLDHLPNESLGTLSLEVDTFAFGSRFLRRAEVTLLNGFARSLILTGILLALFYVMLTKPLVRVIRELSGRDPRSAEPTTLECPGGHANDEIGVLVKVANQQFENIATEIQQRRNAENRLTDYLAQLEDIVSARTAELKAINARLSQSNQELEVARSTALDMAEARSAFLANMSHEIRTPLNGLLGMIALSLDGPLNAEQQQQLSIAHDSGKVLVELLNDILDLSKFDAGQLELEHIPFDLGSLIEDTANLLSQNAAPSVELTCLIDPHFPALVLGDPTRVRQIVSNLLSNALKFTRFGRVDVRLSTWKDGVRIEVCDTGIGIAQEAQVKIFQPFTQAGAGITRQYGGTGLGLALTYNLCEAMQGRLTISSEVGFGSQFCAELPLPCHTRAVIPPPLHGKVLAITNAVSGLAELLESLLPVWGLTYEQRTLDDPLLGLSPDVIITDCPECLFGLRPAVTAPILLVTAYGSFMPGEEATALAPLQQQARPLARNALYQNLRRTLQPDLTTIDRARLESVPSQRRGRVLLVEDNPVNQLVAKGMLGKLGCDVVVAAHGVEALDQLEHDEFDLVLMDCNMPVMDGYEASRQIRQSGRWPHLPIVALTANAMSEERERCRAAGMSDYLAKPFRREELAALLDQWIPTTTVL

SEQ ID NO: 5118 - protein, 537 aa, Streptococcus bovis
MAKDIKFSADARASMMRGVDILADTVKVTLGPKGRNVVLEKSFGSPLITNDGVTIAKEIELEDHFENMGAKLVSEVASKTNDIAGDGTTTATVLTQAIVREGLKNVTAGANPIGIRRGIESAVAVAVDELKAIAQPVANKEAIAQVAAVSSRSEKVGEYISEAMEKVGNDGVITIEESRGMETELDVVEGMQFDRGYLSQYMVTDNEKMVADLENPYILITDKKISNIQDILPLLEEVLKTSRPLLIIADDVDGEALPTLVLNKIRGTFNVVAVKAPGFGDRRKAMLEDIAVLTGGTVITEDLGLDLKDANMTALGQAAKVTVDKDSTVIVEGAGEASSIANRVNVIKSQLEATTSEFDREKLQERLAKLAGGVAVIKVGAATETELKEMKLRIEDALNATRAAVEEGIVAGGGTALVNVISKVAELELDGDEATGRNIVLRALEEPVRQIAFNAGYEGSVIIEHLKNSEVGTGFNAANGEWVNMVEAGIIDPVKVTRSALQNAASVASLILTTEAVVANHPEPAAPAPAAPGMDPS

SEQ ID NO: 5119 - protein, 403 aa, Pseudomonas fluorescens
MQFSKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSLQALLNNGDEVLVPAPDYPLWTAAVSLAGGNAVHYLCDEGADWFPDLADIKAKITPNTKAMVIINPNNPTGAVYSKEVLLGMLELARQHNLVVFSDEIYDKILYDDAVHICTASLAPDLLCLTFNGLSKSYRVAGFRSGWIAISGPKHNAHSYIEGIDMLANMRLCANVPSQHAIQTALGGYQSINDLVLPQGRLLEQRNRTWELLNDIPGVSCVKPMGALYAFPKIDPKVCPIHNDEKFVLDLLLSEKLLVVQGTAFNWPWPDHFRVVTLPRVDDLDMAIGRIGNFLKSYRQ

SEQ ID NO: 5120 - protein, 304 aa, Arabidopsis thaliana
MDPAVLDDIIRRLLDYRNPKAGTKQAMLNDSEIRQLCFVSREIFLQQPCLLELAAPVKICGDIHGQYSDLLRLFEYGGFPPAANYLFLGDYVDRGKQSLETICLLLAYKIKYPENFFLLRGNHECASINRIYGFYDECKRRFNVKLWKVFTDTFNCLPVAAVIDEKILCMHGGLSPELINVEQIKNIERPTDVPDAGLLCDLLWSDPSKDVKGWGMNDRGVSYTFGADKVAEFLIKNDMDLVCRAHQVVEDGYEFFADRQLVTMFSAPNYCGEFDNAGALMSVDESLMCSFQILKPVDRRSRFF

SEQ ID NO: 5121 - protein, 534 aa, Streptococcus intermedius
MAKDIKFSADARSAMVRGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIETAVATAVEALKANSVPVSNKEAIAQVAAVSSRSEKVGEYISEAMEKVGNDGVITIEESKGMDTELDVVEGMQFDRGYLSQYMVTDNEKMVADLDNPYILITDKKISNIQEILPLLENILKTSRPLLIIADDVDGEALPTLVLNKIRGTFNVVAVKAPGFGDRRKAMLEDIAILTGGTVITEDLGLELKDATIEALGQASKVTVDKDSTVIVEGSGDAEAIANRVAVIKSQIESVTSEFDKEKLQERLAKLSGGVAVIKVGAATETELKEMKLRIEDALNATRAAVEEGIVSGGGTAFVNVLDAVAALELEADEATGRNIVLRALEEPVRQIALNAGFEGSIVIDRLKNSEVGTGFNAATGEWVNMIEAGIIDPVKVTRSALQNAASVASLILTTEAVVASQPEPASPAPAMDPS

SEQ ID NO: 5122 - protein, 536 aa, Streptococcus mutans
MAKDIKFSADARSSMVRGVDILADTVKVTLGPKGRNVVLEKSFGSPLITNDGVTIAKEIELEDHFENMGAKLVSEVASKTNDIAGDGTTTATVLTQAIVREGLKNVTAGANPIGIRRGIETAVATAVDELKAIAQPVSGKEAIAQVAAVSSRSEKVGEYVSEAMEKVGNDGVITIEESRGMETELDVVEGMQFDRGYLSQYMVTDNEKMVADLENPYLLITDKKISNIQDVLPLLEEVLKTNRPLLIIADDVDGEALPTLVLNKIRGTFNVVAVKAPGFGDRRKAMLEDIAVLTGGTVITEDLGLELKDTTIDALGQAARVTVDKDSTVIVEGSGGKEAVANRVNLIKSQIETATSDFDREKLQERLAKLSGGVAVIKVGAATETELKEMKLRIEDALNATRAAVEEGIVAGGGTALINVIEKVAALDLTDDAATGRNLVLRALEEPVRQIAKNAGYEGSVIIDKLKNSSAGTGFNAANGEWVDMIDAGIIDPVKVTRSALQNAASVASLILTTEAVVADHPAPEAPAAAPAMDPS

SEQ ID NO: 5123 - protein, 532 aa, Arabidopsis lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPGLSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALCIHEKFTKQRHQRPLLVALTGNT

SEQ ID NO: 5124 - protein, 593 aa, Schizosaccharomyces pombe
MVKRHKNTIGVWRLGKTLGTGSTSCVRLAKHAKTGDLAAIKIIPIRYASIGMEILMMRLLRHPNILRLYDVWTDHQHMYLALEYVPDGELFHYIRKHGPLSEREAAHYLSQILDAVAHCHRFRFRHRDLKLENILIKVNEQQIKIADFGMATVEPNDSCLENYCGSLHYLAPEIVSHKPYRGAPADVWSCGVILYSLLSNKLPFGGQNTDVIYNKIRHGAYDLPSSISSAAQDLLHRMLDVNPSTRITIPEVFSHPFLMGCTSLSSMDSTTPPTPSLSIDEIDPLVVDCMCVLWKKSSSKKVVRRLQQRDDNDEKYVYKVLSEILRDDMLKKQRFDENKYLSLYDLIHDNNLFTKASISTTSLVKSNVSTNSRKSSNFEDELARRVSSPLSALNQMSQSPIPIRVSSDKDYDSYACHEVVSNPSTLDDDYNYMFVCPPEEYTYSTDNVRTDSLDLQSLPTPTLEQLESVPFNRYGYVRIFPSTTLSSTASGYYTPDSLSTPEPSIDGLTNLDDVQVGGFVQGSGNQNRRPISFPVISNMQPNITNVRSASAPLCSSPVPSRRYSQYATNARYTPRKVSSGSVLRKISSFFRKD

SEQ ID NO: 5125 - protein, 322 aa, Zea mays
  misc_feature (14)..(14): Xaa can be any naturally occurring amino acid
  misc_feature (90)..(90): Xaa can be any naturally occurring amino acid
  misc_feature (112)..(112): Xaa can be any naturally occurring amino acid
  misc_feature (117)..(117): Xaa can be any naturally occurring amino acid
  misc_feature (132)..(132): Xaa can be any naturally occurring amino acid
  misc_feature (146)..(146): Xaa can be any naturally occurring amino acid
  misc_feature (167)..(167): Xaa can be any naturally occurring amino acid
  misc_feature (210)..(210): Xaa can be any naturally occurring amino acid
  misc_feature (215)..(215): Xaa can be any naturally occurring amino acid
  misc_feature (248)..(248): Xaa can be any naturally occurring amino acid
  misc_feature (271)..(274): Xaa can be any naturally occurring amino acid
  misc_feature (283)..(283): Xaa can be any naturally occurring amino acid
  misc_feature (304)..(304): Xaa can be any naturally occurring amino acid
  misc_feature (319)..(319): Xaa can be any naturally occurring amino acid
SRDTLLDADLESDXLGWQYISGSLPDGRELDRIDNPQFEGYKFDPHGEYVRRWLPELARLPTEWIHHPWDAPESVLQAAGVELGSNYPRXIVELDAANSRLQDALSEMWELXAASRXAAMENGMEEGLGDSXSDEPPIDFPQELRXEVDRQPVQPAIHAPGVTGRRXEDQMVPSMTSSFIRAETELTADFGHTSEDSRPEVPSNIHHLQXRPERXETVDGGTGNAVRVHGNHHQQNLQNNMHRVLGIXPSISEASSSWTGRDGGVVPVWSXXXXASGHSDSYXADEADISSRGYLDRHPQSHTXMNWSQLSQSLTTGWXVDN

SEQ ID NO: 5126 - protein, 201 aa, Clostridium thermocellum
MVIKCLPIGLFASNCYIVGQNGEGVVIDPGCSPQMIVDAAKENNLEIKYIIITHGHIDHLMSVDEVRKKTGAEVLIHEKDADKLTDPNLNDPVGVGLGRKCKAADRLLKDGEVITVGGLDFEIIHTPGHSAGGICIKVGDVVFTGDTLFCMGIGRTDFPDGDLSTLLDSIKNKLMKLDDNVVVYPGHGEPTTIGRERKEFS

SEQ ID NO: 5127 - protein, 504 aa, Neisseria gonorrhoeae
MTTSKCPVTHLTMNNGAPVADNQNSLTAGPRGPLLTQDLWLNEKLADFVREVIPERRMHAKGSGAFGTFTVTHDITKYTRAKIFSEVGKKTEMFARFTTVAGERGAADAERDIRGFALKFYTEEGNWDVVGNNTPVFFLRDPRKFPDLNKAVKRDPRTNMRSATNNWDFWTLLPEALHQVTIVMSDRGIPASYRHMHGFGSHTYSFWNEAGERFWVKFHFRSQQGIKNLTNEEAAKIIADDRESHQRDLYEAIERGEFPKWTMYIQVMPEADAEKVPYHPFDLTKVWPKKDYPLIEVGEFELNRNPENFFADVEQSAFAPSNLVPGIGASPDKMLQARLFNYADAQRYRLGVNFRQIPVNRPRCPVHSNQRDGQGRADGNYGSLPHYEPNSFGQWQQQPDFAEPPLKINGDAAHWDYRQDDDDYFSQPRALFNLMNDAQKQALFDNTAAAMGDAPDFIKYRHIRNCYRCDPAYGEGVAKALGLTVEDAQAVRATDPALGQAGLL

SEQ ID NO: 5128 - protein, 532 aa, Arabidopsis lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKLFTKFAQTQSLATRSSGGSGLGLAISKRFVNLMEGNIWIESDGLGKGCTAIFDVKLGISECSNESKQSGIPKVPAIPRHSNFTGLKVLVMDENGVSRMVTKGLLVHLGCEVTTVSSNEECLRVVSHEHKVVFMDVYLPGVENYQIALCIHEKFTKQRHQRPLLVALTGNT

SEQ ID NO: 5129 - protein, 1234 aa, Magnaporthe grisea
MTVDHWESIVQIRRSPIVAEHPAGRNPIRSFAWLLRVFMVIVVIAVSLVCLPYDGHSSPSREGYHANLQQPSSNVATQRSSRRPSSHDHQNQHQPQEHSPPIASQSNSPMSSRAAIASPVAVAPAGAPEYYQPTSSDRRRHHAPIAPPRTSSSHQTSAPVNGAQTSRRPVSASHQPQNSSSRRAPDHHGSSADQQTDQSSSSRRRDRHHAPATGDYPPQRQGSTRDPRTATTTTMPIRTNTGGSATASSSKQPSREASEILNSMLVSQPEVDIEREKERLALAQPTSSAHDASEVASPPVVPTQRSRQDHSSKREKHTKFGEYILGNTIGEGEFGKVKLGWKSEGGVQVAIKLIKKDALGSNPNRMQKIMREVSILKQLTHPNIVRLHKMEESERHFGIILEYASGGELFDYILNNRYLKDNAARRLFAQLVSGVGYLHKKGIVHRDLKLENLLLDRNRNIIITDFGFANTFDPALELTEEEEAGLSNREFVKRLGLDKIGANGSRKGDLMQTSCGSPCYAAPELVVSDSLYTGRKVDVWSCGVILYAMLAGYLPFDDDPANPEGDNINLLYKYIVSTPLTFPEYVTPHAKDLLRRILVPDPRRRADLFEVARHSWLSEYAHVVEFITSSTTTHTEIQNTTVPAEDSENPNLARSASVREASRRTPVSPTIGGLASKQGGIDQETEYAARQQKDNKRRTVQVEYVAPTTQTQRGEPAQQQATSGKTRARSGSEGPVEVDPRLSSDKPLPRDPPVSKESYSKPSVRGDPRKPPSSHRNQPSISRPPQSGRVPSDSYVTTMAPGSRPGTSGSMNTAGARPVAGASRSSYGQPLPPTVAGTNVHGRIQQPTDQQSEFGRPSAGGVPSKFAHVPGVAGHDQPDSREGSAKGHRRSNTLGEITGKMFGRSGSIFGNKNRKSSKVDQPQTPTEAKNRDSRKYPPVSMSAAPNPNGEYEPRKSVDSKRSRRSFSFGLGPRKKSGSIHNGSQTSVDKQNKRFSFIPGSISLKAIGIGKETPPGSTQGGGNDSQVDLGYQQEHLREPYRPDSQQQHQRQQSHYVDQRVNEQDLEAAGMDGMYAQLHSPSAPTFSTQQPHQQQQQQHYPAHYTSGQYGDRQMATAVPGYMQSGAHLQTSESESSVNMLSPEQQQFQAHGLRSVSVDHHQKLMEAQGGLGPAGRTGSSVGADGRQARVLQKNKRFVDAYDTDHSGGADHAGSSGAARRVMDFFRRRGKARGGDDR

SEQ ID NO: 5130 - protein, 641 aa, Bordetella pertussis
MCGIVGIWGPLRDKANVLAESCRRIRHRGPDSNGYWEDAEADLALAHVRLAILDLTEAGHQPMVSACGRYVIVLNGEIYNHMELRERLQQDGLAPAWRGHSDTETVLACFAGWGIEQTLQAAVGMFAIVLWDRAERKLALMRDRMGEKPLYYGYSQANLLFGSELKAFMPVPGFGRELDRNALASFMRHNYIPAPQSIYAGIRKLPPGAWVEIDAAQMRRGELPEPQVYWSARRAADQGLGDRRRFESDAQAIDALEQVVSQAVRGQMLSDVSLGAFLSGGIDSSTVVALMQAQSAQPVRTFAIGFHEKGYNEAEHAKAVAAHLGTEHTELYVTAEDGLAVVPSLADMYDEPFADSSQIPTSLVTRMARQHVTVALSGDGGDELFGGYSRYFRVDNWWRKCAAMPGPLRHLAGAALRGSAALPGAGAWRGKVGKLGELLGADTRGEFYRLFVSYWADPGRVVIGGTEPLSPFEQPMEGSTFDAMMKLDTVTYLPDDILVKVDRAAMAVSLETRVPLIDHRVYEFAWQLPFEYKVRGGTGKWLLRQLLYRHVPQAMVDRPKRGFAVPLAAWLRGPLRDWAEALLDPARLRQEGWFEPEPILRKWREHLSGHRNWDSHLWGVLMMQAWLDRYRAGAGDEAGRR

SEQ ID NO: 5131 - protein, 274 aa, Listeria innocua
MNLKDTVKLANGVEMPRLGFGVWKVQDGDEAVNSVKWAIEAGYISIDTAAAYKNEEGVGQAIKESGVKREDLFVTTKLWNAEQGYESTLAAFDESLRKLELDYVDLYLIHWPVEGKFKDTWRAFEKLYKDKRVRAIGVCNFHEHHLKELMEDAEIAPMVNQIELHPQLTQEPLRKFCAENNIVVEAWSPLGNGKLLANPEIKAIADAHGKSVAQVILRWDLQIGVVTIPKSVHQERIIQNADIFDFELSDEEVAKISGLNKDERTGPDPDNFNF

SEQ ID NO: 5132 - protein, 623 aa, Ustilago maydis
MTRNILIALLRNDLRLHDHPILHVCSEPTPSTANFTQPITHVLPVYVFDQRHVEVSGFPRLEKARKDGGGKGSGEYAKTRELGLWRTGIHRIKFINESVFDLRDRLRRLGSDLAMFAGTPESVIASLIHQIRAHGDTVEAVYLSREINTEEVNIQKRLQRMLSDVQCRMHMFETKSLIHSRDLGFPVSKLPDVFTHFRKQVERNRIWRAPLASPDRLKPFAEVPVEDAAGVYSLSANKQHGLDRKNAVEKCLLQPLLDNPVLAHNELLARVMCKRGQVDVAHSAFPYRGGETEALARLDHYFDRSDSCPAASYKQTRNQMLGTDYSTKFGAALALGLLSPRLIAQKATELDNATHDATHNASNKGGGYWIIFELLWRDYFYFVGWKFGSKLFSLRGIEDDISARSAPSKASEWKSSASLSDRDDGFVRWCTAQTGVPLIDANMVEMVQTGFMSNRGRQNVASFLTKDLGWNWRHGAEFFESWLVDYEPNSNWGNWQYVAGVGNDPRSSRQFNPIKQGNDYDANGEYVATWLPLLSDMPPQYRHHPWTCPDAAWAEQAHSAHYPPTPIVEQQMWRKHYSNPEGAPPAHHKPDHVATGRRSANANANRRGARRRSRSTRASTQQS

SEQ ID NO: 5133 - protein, 350 aa, Photobacterium profundum
MTANLFQTYALNKTLSLKNRILMAPLTRCMADDELIPTQDMADYYGRRGEAGLIISEAVIIRPDGQGYPNTPGLFTPAQIDGWRTVTNAVHQNGGKIFAQLWHTGRVAHPHFYQTTGSQDVMAPSAVGVEGSVPRKRELTYQIPKAVSVEEIALLVSDYSQAAANAIDAGFDGVEIHGANGYLIDQFLHHDSNRRSDQYGLTPENMSRFALEVVDAIVARIGNDRTALRVSPGAYFNMAGDSRDRDVFDYLIPELEKRDLAFLHIGIFDDAMEFDYLGGRASSYVRSIYSKTLVGVGSFTAETGSKAIADDKFDLLAIGRPFIANPDYVERVRDGKDLVEYSDEMLTSLI

SEQ ID NO: 5134 - protein, 581 aa, Glycine max
MCGILAVLGCSDDSRAKRVRVLELSRRLKHRGPDWSGLHQHGDCFLAHQRLAIVDPASGDQPLFNEDKSVIVTVNGEIYNHEELRKQLPNHNFRTGSDCDVIAHLYEEHGEDFVDMLDGIFSFVLLDTRDNSFIVARDAIGVTSLYIGWGLDGSVWISSEMKGLNDDCEHFECFPPGHLYSSKERGFRRWYNPPWFSEAIPSAPYDPLVLRHAFEQAVIKRLMTDVPFGVLLSGGLDSSLVASITSRYLANTKAAEQWGSKLHSFCVGLEGSPDLKAAKEVADYLGTVHHEFTFTVQDGIDSIEDVIYHIETYDVTTIRASTPMFLMSRKIKSLGVKWVISGEGSDEIFGGYLYFHKAPNKEEFHRETCRKIKALHQYDCLRANKSTFAWGLEARVPFLDKAFINAAMSIDPEWKMIKRDEGRIEKWILRRAFDDEEHPYLPKHILYRQKEQFSDGVGYSWIDALKAHPPKHVTEKMMLNAGNIYPHNTPKTKEAYYYRMIFERFFPQNSARLTVPGGASAACSTAKAVEWDAAWSNNLDPSGRAALGVHISAYENQNNKGVEIEKIIPMDAAPLGVAIQG

SEQ ID NO: 5135 - protein, 140 aa, Brassica napus
STPASETKQLLQKEATEDAQFRSQFGTRWTRPQSSTLTKNLQDRLNRFAANLKQAGESDVKIERSVRENSALMSILDRRPIEAAVPTLARPMMSLDATEDTILGNLKQILRQLENLGAQQAGLENMLKEMKRKDDILPKL

SEQ ID NO: 5136 - protein, 482 aa, Hordeum vulgare
MAATVAVDNLNPKVLKCEYAVRGEIVIHAQRLQEQLKTQPGSLPFDEILYCNIGNPQSLGQQPVTFFREVLALCDHPDLLQREEIKTLFSADSISRAKQILAMIPGRATGAYSHSQGIKGLRDAIASGIASRDGFPANADDIFLTDGASPGVHLMMQLLIRNEKDGILVPIPQYPLYSASIALHGGALVPYYLNESTGWGLETSDVKKQLEDARSRGINVRALVVINPGNPTGQVLAEENQYDIVKFCKNEGLVLLADEVYQENIYVDNKKFHSFKKIVRSLGYGEEDLPLVSYQSVSKGYYGECGKRGGYFEITGFSAPVREQIYKIASVNLCSNITGQILASLVMNPPKASDESYASYKAEKDGILASLARRAKALEHAFNKLEGITCNEAEGAMYVFPQICLPQKAIEAAKAANKAPDAFYALRLLESTGIVVVPGSGFGQVPGTWHFRCTILPQEDKIPAVISRFTVFHEAFMSEYRD

SEQ ID NO: 5137 - protein, 533 aa, Zea mays
GIDSRRSDGCATLRVPLCSSRPAGVPKPHRLNCFAFDCGRRRRTKNQKMTPCALTVDSLNPKVLALADHLGDNAIARRAQCIQNEIEAEPGSHPFREIIDCSLSNPQSMGQRPNKFFREVLALCDYPHLLEQSGTNSLFSSGAIARAREILDLFPGRATGGYSHSQGTEGLRDIIAAGIAARDNFPCNADDIFLTDGAAPPVHMMMHLLIRDQKDGILCPVPSHSLYTSAMLLQGATLVPYFLDESRGWGVSMSDLKKQLDSARSMGVFVRGLVVINPGNPTGHVLVEENQREIVDFCRNEDLVLLADEVYQENIYADEKGFHSFKKIARSMGYGEGDISLVSFHSVSNGYYGECGRRGGYMEVTGFNSDVKKQVYKVVSLSSCSNISGQILMSLVMNPPQVGDESYASYHAERHGVLSSFARCAEAMVRSFNGLEGVTCSEAEGAVFVFPSVRLPKKAVAAAEASNTQPDAFYALRLLETTGIVVVPGSVFGQMHGTWHFRCTVLPHEEKKMTVIISSFVAFHRAFMEEFRD

SEQ ID NO: 5138 - protein, 315 aa, Digitalis purpurea
MAEEIRFFKLNTGAKIPSVGLGTWQSSPGDAAQAVEVAIKCGYRHIDGARLYENEKEIGVVLKKLFDDGVVKREDLFITSKLWSTDHAPEDVPVALDKTLEDLQLDYIDLYLIHWPVRLKKGSVGLDPENFIPTDIPGTWKAMEALYDSGKARAIGVSNFTLKKLSDLLDVARIPPAVNQVGCHPSCAQTKLRAFCKSKGVHLSGYSPLGSPGTPWVKHDVLENPILVDVAEKLGKTPAQVAIRWGLQMGHSVLPKSVHESRIKENIDVFSWCIPDDLFAKFSEIEQVSPGKPEFPVHPEISQYKTVEEMWDGGI

SEQ ID NO: 5139 - protein, 315 aa, Digitalis purpurea
MAEEIRFFELNTGAKIPSVGLGTWQSSPGDAAQAVEVAIKCGYRHIDGARLYENEKEIGVVLKKLFDDGVVKREDLFITSKLWSTDHAPEDVPVALDKTLEDLQLDYIDLYLIHWPVRLKKGSVGLDPENFVPTDIPGTWKAMEALYDSGKARAIGVSNFTLKKLSDLLDVARIPPAVNQVGCHPSCAQTKLRAFCKSKGIHLSGYSPLGSPGTPWVKHDVLENPILVDVAEKLGKTPAQVALRWGLQMGHSVLPKSVHESRIKENIDVFSWCIPDVLFAKFSEIEQVSPGKPEFPVHPEISQYKTVEEMWDGGI

SEQ ID NO: 5140 - protein, 383 aa, Unknown
  Acinetobacter sp. ADP1
MTIEYSKLFESFALTPDIELRNRIIMAPMTTWSANPDGTVSEQELNYIRQRVNCVGLVITGCTHVQENGIGFTNEFAAFDDRFIASLKELAQAAKSGGAPAILQIFHAGNKAIPDLIPNADLVSASALIKTPTGSFVDSQMMTRALSHEEILEVIHAFGETTRRAIEAGFDGIELHGAHGFLIQNFFSPLFNQREDEWGGSLEKRMRFSLEIVKEVKSVIKQYAKKPFALGYRISVEEYDENGLRIGDSLQLIDRLIDSGIDYLHVSLTDILNSKPVDSTDEKLTIQRVIDHVNYRISLISAGKIRTPHQALQALALGLPLVAIGKALVINPDWVILVANHQADQISTELELEKDAELHIPDHLWDEIKIRKGWFPMRQIEQV

SEQ ID NO: 5141 - protein, 368 aa, Erwinia carotovora
MSDDILFSPFTVKGLTLPNRIVMAPMTRSMAEEGIPGPANAEYYRRRAEGGVGLILTEGTVVDRPASRNMPGIPFFHGEAALAGWDAVAKAVHAAGGRIGPQIWHTGSTHGRGWEPDAPVESPSGLVGPDEPRGVVMTEEDIADTVAAFARAAADAKRLGFDTLELHGAHGYLIDQFFWPGTNKRSDAFGGATIRERSHFAAEVIRAVRAAVGEDFPLILRVSQWKQQDYSARLATSPQEMTDWLAPLVEAGVDILHCSQRRFWDPEFPEVDGAEGLNFAGWAKKLTGAATISVGSVGLTSDFFAAFGGEGSGTAALDNLYARMEREEFDLIAVGRVLLSDAQWVQKVRTGQTDKLRGFDAADLAVLA

SEQ ID NO: 5142 - protein, 199 aa, Oryza sativa
MGRGKIVIRRIDNSTSRQVTFSKRRNGLLKKAKELSILCDAEVGLVVFSSTGRLYEFSSTNWACCKPRMGQRGQIAADANSIWQREAASLRQQLHNLQESHKQLMGEELSGLGVRDLQGLENRLEISLRNIRMRKGSLIHQENIELSRSLNVMSQQKLELYNKLQACEQRGATDANESSSTPYSFRIIQNANMPPSLEL

SEQ ID NO: 5143 - protein, 634 aa, Carica papaya
MESCDCIDTPCPGEELLVKYQYISDVLIALAYFSIPLELIYFVQKSAFFPYRWVLMQFGAFIVLCGATHFINLWTFSMHSKAVAVVMTIAKVACAAVSCVTALMLVHIIPDLLSVKTRELFLKNKAEELDREMGLILTQEETGRHVRMLTHEIRSTIDRHTILKTTLVELGRTLGLEECALWMPSRSGLNMQLSHTLNYHIQVGSTLPTNLPIVNEVFNNARAMRIPYTCPLARIRPLVGRYVPPEVVAVRVPLLHLSNFQINDWPDHSAKSYAIMVLILPTDSARKWRDHELELVEVVADQVAVALSHAAILEESMRARDQLMEQNVALNLARQEAEMAIHARNDFLAVMNHEMRTPMHAIIALSSLLLETELTPEQRVMIETVLKSSNLLATLINDVLDLSRLEDGSLKLDSETFNLQGIFREVINLIKPITSVKKLSMTLIMAPDLPACAVGDEKRLMQAILNVVGNAVKFTKEGYVTIVASVAKPDASRDWPECYPVSSEGHFHLCVQVKDSGCGIHPQDIPHLFTKFAQPRSGSSRKNGSAGLGLAICKRFVNLMGGHIWIESEGADKGCTATFIVKLGICNSPTDPSERKVGTKGQTTHGSGDLTRHKPLYRDNNGSTSSNPRYQRSF

SEQ ID NO: 5144 - protein, 383 aa, Nicotiana tabacum
EEKDADPKKQTDSDRWKGLVQDFSDDQQDITRGKGMVDSLFQAPTGTGTHHAVLQSYEYVSQGLRQYNLDNKLDGFYIAPAFMDKLVVHITKNFLKLPNIKVPLILGIWGGKGQGKSFQCELVFRKMGINPIMMSAGELESGNAGEPAKLIRQRYREAAEIIRKGNMCCLFINDLDAGAGRMGGTTQYTVNNQMVNATLMNIADNPTNVQLPGMYNKQENARVPIIVTGNDFSTLYAPLIRDGRMEKFYWAPTREDRIGVCTGIFRTDNVPAEDVVKIVDNFPGQSIDFFGALRARVYDDEVRKWVSGTGIEKIGDKLLNSFDGPPTFEQPKMTIEKLLEYGNMLVQEQENVKRVQLADKYLKEAALGDANADAINNGSFFAS

SEQ ID NO: 5145 - protein, 141 aa, Triticum aestivum
  misc_feature (55)..(55): Xaa can be any naturally occurring amino acid
PDLPDELIFHINYLGADQPTFTLNFSKGSSQVIAQYYQLIRLGFEGYRNIMDNCXRENAMVLKEGLERPGWFNIASQDQRVPLARLPLRDSSATRTTARSRSVMRPRRSGAGPSGTTMTTPNGSDAGRRASGQTGTAPAPR

SEQ ID NO: 5146 - protein, 440 aa, Arabidopsis thaliana
  misc_feature (132)..(132): Xaa can be any naturally occurring amino acid
MNRPKVQRRVGKYEVGKTLGQGTFAKVRCAVNTETGERVALKILDKEKVLKHKMAEQIRREICTMKLINHPNVVRLYEVLASKTKIYIVLEFGTGGELFDKIVHDGRLKEENARKYFQQLINAVDYCHSRGXVYHRDLKPENLLLDAQGNLKVSDFGLSALSRQVRGDGLLHTACGTPNYAAPEVLNDQGYDGATADLWSCGVILFVLLAGYLPFEDSNLMTLYKKIIAGEYHCPPWLSPGAKNLIVRILDPNPMTRITIPEVLGDAWFKKNYKPAVFEEKEEANLDDVDAVFKDSEEHHVTEKKEEQPTSMNAFELISMSRALDLGNLFEEEEGFKRETRFAAKGAANDLVQKIEEASKPLGFDIQKKNYKMRLENVTAGRKGNLRVATEIFQVSPSLHMIEVRKTKGDTLEFHKFYKKLSTSLNDVVWKSGESSGLSK

SEQ ID NO: 5147 - protein, 363 aa, Rhodopirellula baltica
MGHEFQFTLVLTMSTSEAPAPPESAKRDKLVCDESNDYGSGAVPTEAMAVGETGIDPQRLPRPEETQPLRIMWQYVIVLSLVHLVALAAFVPAWFSYLFTWSGLIAGIAGHFIFGMFGITIGYHRLLTHRGFKCPKWMEHTLAILGMCNLQDSPARWVAIHRMHHQHSDHQPDPHSPLVNFLWGHMGWVVCRHKDLDKTSHYERYVRDLLRDRFYLKLERKDGWFFVFLIHGIIISLIGGAVGYAVSGGDWAVAYRYLLSWTVWAVAIRTVFVLHGTWSVNSLSHVFGYRNYDTRDHSTNNWLVALISHGEGWHNNHHATPRSARHGHKWYEFDMSWGIIRVWEMMGLITDVQRPTKASVAGK

SEQ ID NO: 5148 - protein, 216 aa, Arabis pumila
MSSFSAFSEMFGSDYESMISSVGDYSPTLATSCPKKPAGRKKFRETRHPVYRGVRQRNSGKWVSELREPNKKTRIWLGTFQTAEMAARAHDVAAIALRGRSACLNFADSVWRLRIPESACAKDIQKAAAEAALAFQNELMSDTATTDHGLDMEETLVEAIVTAEQIDTFYIDEETMFGMPSLMANMAEGMLLPLPSIQWINNYDVEGDADMPLWSY

SEQ ID NO: 5149 - protein, 192 aa, Arabidopsis thaliana
MEEKKTESTNKNVKKANLLDHHSIKHILDESVSDIVTSRGYKEDVRLSNLKLILGTIIIVVALVAQFYNKKFPENRDFLIGCIALYVVLNAVLQLILYTKEKNAILFTYPPEGSFTSTGLVVSSKLPRFSDQYTLTIDSADPKSISAGKSVQLTKSVTQWFTKDGVLVEGLFWKDVEALIKNYAEEEPKKKK

SEQ ID NO: 5150 - protein, 135 aa, Haemophilus ducreyi
MRILHTMLRVGNLERSIKFYTEVLGMRLLRTSENEQYKYSLAFLGYADESENAVLELTYNWGVDHYDLGNAFGHIALGIDNIYTTVEAVRLAGGKITREPGPVLGGKTVIAFAEDPDGYKIEFIENKNAQVALGN

SEQ ID NO: 5151 - protein, 454 aa, Malus sylvestris
FNSHGEDSSYFLGWQEYEKNPYHEVLNTNGIIQMGLAENQLCFDLLESWLAKNPEAAAFKKNGESIFAELALFQDYHGLPAFKKAMVDFMAKIRGNKVTFDPNHLVLTAGATSANETFIFCLADPGEAVLIPTPYYPGFDRDLKWRTGVEIVPIHCTSSNGFQITETALEEAYQEAEKRNLRVKGVLVTNPSNPLGTTMTRNELYLLLSFVEDKGIHLISDEIYSGTAFSSPSFISVMEVLKDRNCDENSEVWQRVHVVYSLSKDLGLPGFRVGAIYSNDDMVVAAATKMSSFGLVSSQTQHLLSAMLSDKKLTKNYIAENHKRLKQRQKKLVSGLQKSGISCLNGNAGLFCWVDMRHLLRSNTFEAEMELWKKIVYEVHLNISPGSSCHCTEPGWFRVCFANLPERTLDLAMQRLKAFVGEYYNVPEVNGGKQPFKPLKKTVAHKVGFPAILR

SEQ ID NO: 5152 - protein, 327 aa, Idiomarina loihiensis
MKRLLPTLRADQTSESLISVINTIQIAAKEISFRLHQGALAGVLGSTLDENIQGETQKKLDVVANQLLKTLLLESPNVHAVASEEEDSIVESPNSGHYLVAFDPLDGSSNIDINGGVGTIFSILRKPEGEETSENMFLQPGKAQVAAGYVLYGPATMLVMTTGKAVRIYTLDQTVGEFLLTHEKAEIPKDTKEFAINMSNRRHWADPIRAYISDLLEGEEGPRGKNFNMRWNAAMVSDVHRVISRGGLFTYPWDARKPEKPFKLRLLYEAAPMAMLVEKAGGKATDGYSRLMEIVPEHIHQRVSVVMGSANEVDVCMDYHKQHPKPY

SEQ ID NO: 5153 - protein, 183 aa, Eucalyptus grandis
MGRGRVELKRIENKINRQVTFAKRRNGLLKKAYELSVLCDAEVGLIIFSNRGKLYEFCSSSSMLKTLERYQKCNYGALEPNVSARESLELSCQQEYLRLKARYEGLQRTQRNLLGEELGQLCSKELESLERQLDGSLKQIRSRRTQYMLDQVTDLQHREQVVHEANRTLNQRLMEGYQVMRSS

SEQ ID NO: 5154 - protein, 245 aa, Eucalyptus grandis
  misc_feature (151)..(151): Xaa can be any naturally occurring amino acid
MGRGKVELKRIENKINRQVTFAKRRNGLLKKAYELSVLCDAEVALIIFSNRGKLYEFCSSSSMMKTIEKYQKCSYGSLETNCSINEMQNSYQDYLKLKARVEVLQRSQRNPPWEELGPLNSKELEQLEHQLENSLKQIRSAKTQFMFDQLXHLQHKEQMLVEANRELWKKLEESNTRIPLRLGWEAEDHNNISYSRLPTQSQGLIFQPLGGNPTLQIGYNPAGSNELNVSAADQHPNGFIPGWML

SEQ ID NO: 5155 - protein, 549 aa, Ralstonia solanacearum
MFIHFYVPNVRPRLMRTSLKNISLIAIGLVTGVLATLQLSATAQNATVGPLPLEKLRLMADIFGQIKREYVEPVDDDKLLTEAIKGMVASLDPHSAYLDKKDFQELQEGTQGRFAGLGIEISQEEGLVKVINPIEDTPAFRAGVQPGDLITRIDDKPVRGMPLEQAVKRMRGAPGTKVTLTIYRKKEERTFPLTITRAEIQVQSVKAKLLGDGIAWVRITSFQERTVPDLAKKLNDLAHQDARLKGVILDLRNNGGGVLQAAVGVSAAFLPPDVTVVSTNGQVPDAKRVYKTSFANYRLSNFDTDPLVSLDPEFKTVPIVVLTNAYTASASEIVAGALQDHHRAKVMGKTTFGKGSVQTVRPLSNDTGIKLTIAYYYTPSGKSIQAKGIRPDVPVDQSPEGDPDDALITREIDTERHLHNKQESEEPEMTDREKRRVEELRRLEEETAKKTPEQREKERNKKPIEFGSTDDFMLQQAVAELKGQPVKRSKSVLEAAAAVPDKATKSPAAKESSAPAKLPKGKAAPASEPAAPSGPASGVIPAPEPTGAR

SEQ ID NO: 5156 - protein, 751 aa, Cryptococcus neoformans
MGPNTRPAPQAPTHYSRHRPQSITGNNAPQSRTKPRIGQYIVERTLGTGSFGKVKLATHAVTGHQVALKLINRSKITTPDMNARVKREIQYLKVLRHPHIIKLYEVITTPTDVIMVMEYAGEELFNYIVQKGKHGMTEDEARRFFQQMIGAIEYCHKHHIVHRDLKPENLFLDSRRNIKIGDFGLSNLMTDGDFLKTSCGSPNYAAPEVISGKLYSGPEIDVWSAGVIMFVLLCGKLPFDDEHIPTLFKKIENGVFHIPSHVSEPARHLLKRMLEVDPLKRCTIAEIRQMPFFQENLPRYLQPLPELADMERYPSLTMDDMTTLLLINEGQADPKKVAEDKGLVFSEDLGVIDPDIVEELLEKITTYSEGMVWEALKMPGDNQVKVAYQLVRDHRRILKDSNAYEDEDSSAMEEFMASSPPAWNADIAPPIDVQQNGADEYPDLEDVDLEIQDIPNAHFDVLDSSLPGWMTPPSSSTSAMSTPTTTHPTSAQNSANPSFSSVTSDTTASGSTAEEAARALLSPAPSSASQSVTSFSSPTPQPQPQRRLDKSMTKPKWHFGIRSRSPPMEVMLEIYRTLNVLGMQWRLKDIPLPDIGGAPPGGYSEEVELVLEDLKEKNGERPVMGRKPPSKKDAMAQEKLAQGLYHVETRARYGDVMVRMDLQLYRVDDQHYLVDFRNLGYYMVSEKDMSLPDVSRQGHSHEEGASNAGGSVPSATSATAAGAKEAGIGGVSGPFHFLEMACQLIAELASG

SEQ ID NO: 5157 - protein, 192 aa, Larix decidua
DEHREVVAEMRRPDLEPYLGLHYPATDIPQASRFLFMKNRVRMICDCCAPPVKVIQDKRLRQPLSLCGSTLRAPHGCRGQYMVNMGSIASLVMSVTTNENGDDSEDIGQRQPQKGRRLWGLVVCHHTSPRVIPFPLRYACEFLMQVFGIHLNKEVELAAQLREKHILRVQTVLCDMLLRDAPVGIVSQTPNI

SEQ ID NO: 5158 - protein, 155 aa, Manihot esculenta
LEEYKFDGFRFDGVTSMLYHHHGINMAFTGDYNEYFSEATDIDAVVYLMLANSLIHNILPDATVIAEDETGMPGLGRSVSEGGIGFDYRLAMAIPDKWIDYLKNKSDEEWSMKEISWSLTNRRYTEKCVAYAESHDQAIVGDKTVAFLLMDKEMY

SEQ ID NO: 5159 - protein, 85 aa, Manihot esculenta
KVIVFERGDLVFVFNFHPENTYDGYKVGCDLPGKYRVALDSDAWEFGGRGRVGHDVDHFTSPEGIPGVPETNFNNRPNSFKILSA

SEQ ID NO: 5160 - protein, 191 aa, Larix decidua
DDHGEVISEIRRSDLEPYLGLHYPATGIPQASRFLFMRNGVRMICDCCAPPITVIQDKRLPRDLSFCGSTLRAPHGCHAQYMANMGSIASLVMAVVISEKEEDADSDGQIQQKGRRLWGLVVCHHTSPRYVPFPLRYACEFLMQVFGIHLNKEVELAVQMSEKRILRTQTLLCDMLLRDAPLGIVSQKPNI

SEQ ID NO: 5161 - protein, 210 aa, Haemophilus somnus
MNIEIVPVTAFQQNCSIIWDNNKNAAIIDPGGEATKLIKRIEELCLNLELILLTHGHIDHVGAALKLKQYFNVEIWGSNEKDDFLFNSLPQQSEQFGLLFETEVFKPDRWLNQEYEIVRIGEMNFEVLHLPGHTPGHVGFIEYSKKIAFTGDVLFQNSIGRTDFPRGNHAELIQSIRDKLWKLDDDMIIIAGHGNYTTIGKEKKYNPYIR

SEQ ID NO: 5162 - protein, 467 aa, Listeria monocytogenes
MLYSEDDKRKQESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKDMSYLGTSTVGSSEACMLGGLAMKFRWRNHAEKRGLDIQAKRPNLIISSGYQVCWEKFCVYWDVDMRVVPMDKEHLSIDVDKVFDLVDEYTIGIVGILGITYTGKFDDIQLLDEKVEAYNEANEHQLVIHVDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTALYLAKSVEKSGYFEIINDGANLPIVCYKMKEGLDVEWTLYDLADQLLMKGWQVPAYPLPADLSDTIIQRFVCRADLGYNVAEEFAVDFADALHNLEHARVLYHDKERNDSYGFTH

SEQ ID NO: 5163 - protein, 370 aa, Unknown
  Shewanella sp. ANA-3
MTQLFSPFRLKDITLKNRIAVAPMCQYQAHDGLSNDWHQVHYTSLARGGAGLVVVEATAVSPEGRITPRCLGLWNEEQAAGLANIASAIKGAGAVAGIQIAHAGRKASANIPWEGDDHIEGDEGWQTLSPSAVAFGANLGKVPTAMTIDDIQRVKADFVAAAKRALEAGFEWLELHFAHGYLAQSFFSTYANQRTDEYGGDAQGRGRFLIETVEAVRAVWPEHLPLTARFGVIEFDDKDEQTLSESIALVKQFKRAGLDMLNVSICFSTPTANIPWRPAFLAPIAERVRREVGFPVATSWGMDNPHHAEQAIQDQQMDLVMIGKAFLANPHWPYQAAQTLKVSRPSWVLPSSYAHWLERYSTVKAESSID

SEQ ID NO: 5164 - protein, 244 aa, Unknown
  Zantedeschia hybrid cultivar
GIEPIIMSAGELESENAGEPGRLIRERYRTASQVVQNQGKMSCLTINDIDAGLGRFGNTQVTVNNQIAVGTLMNLSDNPTRVSIGQKWRESDVTHRIPVIVTGNDFSTLYAPLIRDGRMEKFYWQPTHEDIINIVQRMYEKDGISRDAVESIVDSFPNQALDFYGALRSRTYDKSTLKWIDEIGGYENLSDKLLRERKEGKLPTFVPPKQTLEALLESGHSLIEEQELIMNTKLSKEYMKNMDD

SEQ ID NO: 5165 - protein, 192 aa, Macrozamia communis
DDHGEVVAEIRRSDLEPYLGLHYPATDIPQACKFLFMKNRVRMICDCCPAPVRVVQDKKLARDLTLCGSTLRAPHGCHSQYMSNMGSIASLVMAVIINEKEEEEGDNGDQQQLKGRRLWGLVVCHHASPRFVPFPLGYACEFLMQVFGIQLNKEVELAAQLREKHILRTQTLLCDMLLRDAPIGIVTQSPSI

SEQ ID NO: 5166 - protein, 446 aa, Triticum aestivum
  misc_feature (180)..(180): Xaa can be any naturally occurring amino acid
MAAAAGRGGGPRRTTRVGPYELGKTVGEGSFAKVKIAKDTRNAATCAIKVLDRNHVLRHKMVEQIKREIATMKLIRHPNVVQLHEVMASKSKIYMVLEFVEGGELFDKIVNSGKLGEDEARRYFHQLINAVDYCHSRGVYHRDLKPENLLLDSYGALKVSDFGLSAFSPQTKEDGLLHTXCGTPNYVAPEVLADKGYDGMAADVWSCGIILFVLMAGYLPFDDPNLMTLYKLISRANVSCPPWFSTGARNLIKRILDPNPHTRITIAQILEDEWFKKDYKPPHSEHNEDVSLEDVDAAFDSSEEHLVAERREKPESMNAFALISRSEGFNLGNLFEKEMMGMVKRETSFASQRTPQEIMSKIEEACGPLGFNVRKQNYKMKLKGDKTGRKGHLSVATEVFEVAPTLHMVELRKTGGDTLEFHSFYKNFSSELKDIVWKTESNTIAK

SEQ ID NO: 5167 - protein, 675 aa, Haemophilus somnus
MKLPQQLRYLLCLLFGFVLSLNYAVAVEPKLKLTDLVIPQITQENQLATKRTAARLVHSHYQAVELNDEFSQRIFDRYLKALDFNRNTFLQSDIDNMRAMYADKIDDVLNEGNLDIAFDMYELLMKRRYERYRYALSLLDEEPDLNGNDQIEIDREKADWPKNETEANKLWEHRVKNDVINLKLKGKKWSEIQTRLVKRYNLAIQHLSKVKSDDIVQLYLNAFAREIDPHTSYLAPRKAKNFNENMNLSLEGIGATLQSEDGETTIKSLVPGAPADRSKKLKAGDKIIGVGQATGEIEDVVGWRIDDVVDKIKGKKGTKVRLEIEPAKGGKSQIITLVRDRVRLEDQAAKLTVETVAGNKIAVIKIPGFYNGLTEDVRKLLVEVEAKKAEALIIDLRGNGGGSLPEAIELTGLFITDGPVVQVRDAHQRIRIYDDPDTEQVYSGPLLVMIDRFSASASEIFSAAMQDYNRAIILGQNTFGKGTVQQSRSLNFVYDSNSMAPLGLLQYTIQKFYRINGGSTQLKGVAPDIIFPSSIDDEEYGEEKEDNALPWDKIPSASYSEVGNARLPVDILNQKHLERIAKDPEFIALDEDLKIRDERKERKFLSLNFAQRKAENDKDDEKRLKDLNARFKREGKKPLKDLDALPKDYEDPDFYLKEAQKIAVDLIEFNKKMAE

SEQ ID NO: 5168 - protein, 474 aa, Rubrivivax gelatinosus
MAGWIVVGAVAGALTTMQLTATARNPSAALPLEELQQLAAVFGMVKSDYVEPVDEKKLITDAIGGMVAGLDPHSQYFDKKTFKEFREGTSGRFVGVGIEIGMEDGLVKVVSPIEGSPAFRAGVKSGDLITKIDDSFVKGLTMDQAVKKMRGEPNTKVVLTVFRKAESRSFPVTITREEIRVQSVRAKMIEPGYAWLRVSQFQDRTVEDFATKLADLYKQDPNLKGLVLDLRNDPGGLLEASVAISAAFLPKDVTVVSTNGQIAESKAVFKANPEFYSRRGSDPLKKLPEGLKSVPLIVLVNEGSASASEIVAGALQDHKRATVMGSQTFGKGSVQTVRQLSPDTALKITTARYYTPSGRSIQATGIVPDVWLDETAEGNVFAAIRTREADLEKHISSGQGPEVKDPAREKAREEALKKLEEANGKDKDKAPKPLPEFGSAEDFPLQQALNRLKGKTVLASKTQTERKPEDTKTN

SEQ ID NO: 5169 - protein, 552 aa, Anabaena variabilis
MAKPIEFTLFAPYNKGAALIASFSDWQEIPMQKGDDGYFRATIELEDGTYQYKFRVQTRSWFFEEDQWVDVTDPYATDIDESSGKDNGIIKIKDGEKIVDTYVWQHDDKPLPADHELVIYELHVGDFSGGEDDLYARGKYKHVIEKLDYLCELGINAIELLPVKEYPGDYSWGYNPRYFFATESSYGSTADLKKLVDECHQRGIRIIMDGIYNHSEASSPLTQIDHDYWYHHEPRDPDNNWGPEFNYEHYDENLETYPARKFIGDTVRYWVGEYHLDGIRYDAARQIANYDFMHWIAQEAKKTAGAKPFYNVAEHIPETTSITNLDGPMDGCWHDSFYHTIKAHICGDTFDLESLKDVIDPKRQGFLGATNVVNYLTNHDHDHIMVELGNREIFHDEAFRRAKLGTAILMTAVGVPLIWMGEEFGEYKPKQQDQSKIDWTLLGNDLNRSLFDYYRGLIGLRKNNHALYTENIDFIHENPEAKVLAYSRWNDEGSRVVVVTNFSEDFLAGYHVPNFPSGGTWHEWTGDYDVEAGDDGIITDIGPYEAKVFVWQ

SEQ ID NO: 5170 - protein, 541 aa, Unknown
  Nocardioides sp. JS614
MPKILEFDEHARRALERGVDALANAVKVTLGPKGRYVVLDKKWGAPTITNDGVTVAREVELDDPFENLGAQLTKEVATKTNDIAGDGTTTATVLAQAMVHEGLRAVTAGANPMGLKRGMDAAAEAVGDALKEAAREVESREDMASVATISSRDSVIGDLLAEAFDKVGKDGVITVEESNTMGTELEFTEGMQFDKGYISQYFVTDPERMEAVLEDPYILLHQGKISAVAELLPLLEKVIQSGKPLFILAEDVEGEALSTLVVNKIRGTFNAVAVKSPAFGDRRKAMMQDIATLTGGQVVAPEVGLKLDQVGLEVLGQARRVVVTKDDTTIVDGAGDPKDVEGRVNQIKAEVENTDSDWDREKLQERLAKLAGGVCVIKVGAATEVELKEKKHRIEDAVSATRAAIEEGIVAGGGSALVHAVSVLSDDLGLTGDEALGVRVVRKAADEPLRWIAENGGVNGYVVTTKVRELGLGNGFNAATEEYGDLVAQGVLDPVKVTRSALVNATSIAGMLLTTETLVVDKPEEEEPAAAGHGHGHGHGH

SEQ ID NO: 5171 - protein, 512 aa, Aspergillus nidulans
MGQSHSKGNSGAGDSLQSYPSFSKSDTKESLRSFRGSIRSKIRSSDSPRASTSALNQSDDKSDAGSMKSVGSRRSSTNLSRPASADSSAASPTDAPDPPPSPTMSSSLKRGHQDVAAMKQSGEVDHVSDAPPSAAPPPGSQAKVGESILIKREDTSNPILDFIMKTPLHSDASSSSPGMGMGALKSIDLDDMITRLLDAGYSTKVTKTVCLKNAEITAICTAARELFLSQPALLELSAPVKIVGDVHGQYTDLIRLFEMCGFPPVSNYLFLGDYVDRGKQSLETILLLLCYKLKFPENFFLLRGNHECANVTRVYGFYDECKRRCNIKIWKTFVDTFNCLPIAATVAGKIFCVHGGLSPSLSHMDDIRNIARPTDVPDYGLLNDLLWSDPADMDEDWEPNERGVSYCFNKNVIMNFLQRHDFDLVCRAHMVVEDGYEFYQDRILVTVFSAPNYCGEFDNWGAVMSVSGELLCSFELLKPLDSAALKSHIKKGRKERNSLINSPPAVVSAQSF

SEQ ID NO: 5172 - protein, 304 aa, Zea mays
LRKWLQDHPRFVMNPLYIAGDSYSGLIIPTLALEIDRSIELGEKIFSGLKGYIAGNPLTGGQFDTDSQIPYFHAMGLVSDELYKNARENCGGKYSAPLNAVCAEAVQAINNCTRDINKQYILDPACPDDDLLSPKTVAETDGTSRLMLESADFLLDSKCAEALYILSYAWGNDDTVQESLGIRKGTIGAWKRYSHALPYNYDIQSAVDYHSRLATKGYRALIYSGDHDAVVPHVGTQAWIRYLNLTIVDDWRPWYVGDQVAGFTRSYASGLTFATVKGAGHVAPLYKTLECQKMFITWISGNPL

SEQ ID NO: 5173 - protein, 468 aa, Streptococcus pyogenes
MTKTLPKDFIFGGATAAYQAEGATHTDGKGPVAWDKYLEDNYWYTAEPASDFYNRYPVDLKLSEEFGVNGIRISIAWSRIFPTGKGEVNPKGVEYYHNLFAECHKRHVEPFVTLHHFDTPEALHSNGDFLNRENIEHFVNYAELCFKEFSEVNYWTTFNEIGPIGDGQYLVGKFPPGIQYDLAKVFQSHHNMMVSHARAVKLFKDSGYSGEIGVVHALPTKYPFDANNPDDVRAAELEDIIHNKFILDATYLGKYSDKTMEGVNHILEVNGGELDLREEDFVALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDDGRIDYVKKHLEVISDAISDGTNVKGYFMWSLMDVFSWSNGYEKRYGLFYVDFETQERYPKKSAYWYKKVAETQVIE

SEQ ID NO: 5174 - protein, 462 aa, Arabidopsis thaliana
MSEEQPHANLAVPAFKTEKEPITQTRNGQSSVWRFGGSDKAAKASTVTLRGVIYMLFDNCGKDVNKTILPLGHGDPSVYPCFRTCIEAEDAVVDVLRSGKGNSYGPGAGILPARRAVADYMNRDLPHKLTPEDIFLTAGCNQGIEIVFESLARPNANILLPRPGFPHYDARAAYSGLEVRKFDLLPEKEWEIDLEGIEAIADENTVAMVVINPNNPCGNVYSHDHLKKVAETARKLGIMVISDEVYDRTIFGDNPFVSMGKFASIVPVLTLAGISKGWVVPGWKIGWIALNDPEGVFETTKVLQSIKQNLDVTPDPATIIQAALPAILEKADKNFFAKKNKILKHNVDLVCDRLKDIPCVVCPKKPESCTYLLTKLELSLMDNIKDDIDFCVKLAREENLVFLPGDALGLKNWMRITIGVEAHMLEDALERLKGFCTRHAKKTETETESLQALKLSDNNLEM

SEQ ID NO: 5175 - protein, 681 aa, Burkholderia fungorum
MPYPHLLAELDLGFTRLRNRVVMGSMHTGMEDRFWNYPKLAAYFRERAKGGVGLIVTGGISPNRQGWLLPFGGTLNSVFDLRNHRQLTESVHAEGSKIALQILHAGRYGYQPFVVSASALKSPISKFKPRALSIAGIAKTVRDYARCARLAQRAGYDGVEIMGSEGYLLNQFLCPRTNRRTDAYGGSIENRMRLAREIVERVRAECGERFIVMYRISLIDLVEGGNTWDETVQVARALEAAGVTMFNTGIGWHEARVPTIVTSVPRAAFAALSARLRAAVKVPVIVSNRINTPDVAEELLAQGAGDLVSMARPLLADPEFVVKTAEGRTHEINTCIACNQACLDHTFRNQRATCLVNPRAGRETELIYRPVAGPQAARSVAVVGAGPAGLSAATVAASRGHRVTLFDASATIGGQFNLAMRVPGKEEFSETIRYFQSQLQRHRVDVRLDTRVDPALLAAGAYDDVIVATGIVPRRPAIAGIDGANVLSYVDVLRGAPVGQRVAVIGAGGIGFDVSEFLLHRAGDPLPMPRDAWLDEWGVDLAVQERGGLKPPAPAQPPRQIWLLQRKAGKLGMGLGKTSGWVHRATLARNGVKMLGGVSYLEISARGLKIAREDVEEWLEVDTIVVCAGQESLRDLHSQPEAGQAHRAGGPRYHLIGGAKVATELDAKRAIREGAEVAAAL

SEQ ID NO: 5176 - protein, 384 aa, Vigna unguiculata
MVTATATAAATAPSHQAIPLLTPYKMGKFNLSHRVVLAPLSRERSYNNVPQPHAVVYYSQRTSNGGLLIAEATGVSDTAQGYPNTPGIWTKEQVEAWKPIVDAVHAKGGIFFCQIWHVGRVSDSSYQPNGQAPISSTDKPLPPTPRANGLGYIEHTPPRRLTTEELPGIVNDFRIAARNAIEAGFDGVEVHGAHGYLLDQFLKDQANDRTDQYGGSLENRCRLPLEVVEAVVNEVGADRVGIRLSPFADFNDCGDSNPLQLGLYMVNALNKYNILYCHMVEPRMGSVGGPDENLTPMRKVFNGTFIVAGGYDREDGIKAIAEDRADLVAYGRLFLANPDLPKRFALNAPLNQYNRKTFYHEDPDPLVGYIDYPFLDEESNGVAS

SEQ ID NO: 5177 - protein, 283 aa, Oenococcus oeni
MVLSRSVPNIVLNDGHSLPAIGLGTYLVRGGQGVDQILSAIEDGYRLIDTSTNYDSEGAVGEAIRRSGIPRSEFIVTSKLPGKYHHYQDALMMIQESIFRMGIDYLDLYLIHWPLPKRDHYVKAWKALVDAQKLGLIRSIGVSNFLPEHLDRIINESGVTPAVNQIEVHPYWVQEDMLAANKSRGIVSEAWSPLGRGSAALKEDIIKNLADKYGKNTGQIILRWHTQRGIIPLPKSSSLIHQRSNIDIFDFSLTSSEIEQINALNRSDGRVDGQDPNTYEEFD

SEQ ID NO: 5178 - protein, 774 aa, Synechococcus elongatus
MTGTTPLPSSSLSVEQVNRIASNQEQNPFDILGPHPYEHEGQAGWVIRAYLPEAQEAAVICPALRREFAMHPVHHPHFFETWVPEETLEIYQLRITEGERERIIYDPYAFRSPLLTDYDIHLFAEGNHHRIYEKLGAHPCELENVAGVNFAVWAPSARNVSILGDFNSWDGRKHQMARRSNGIWELFIPELTVGAAYKYEIKNYDGHIYEKSDPYGFQQEVRPKTASIVADLDRYTWGDADWLERRRHQEPLRQPISVYEVHLGSWMHASSDAIATDAQGKPLPPVPVADLKPGARFLTYRELADRLIPYVLDLGYSHIELLPIAEHPFDGSWGYQVTGYYAATSRYGSPEDFMYFVDRCHQNGIGVILDWVPGHFPKDGHGLAFFDGTHLYEHADSRQGEHREWGTLVFNYGRHEVRNFLAANALFWFDKYHIDGIRVDAVASMLYLDYNRKEGEWIPNEYGGRENIEAADFLRQVNHLIFSYFPGALSIAEESTSWPMVSWPTYVGGLGFNLKWNMGWMHDMLDYFSMDPWFRQFHQNNVTFSIWYAFSENFMLALSHDEVVHGKSNLIGKMPGDEWQKFANLRCLLGYMFTHPGKKTLFMGMEFGQWAEWNVWGDLEWHLLQYEPHQGLKQFVKDLNHLYRNAPALYSEDCNQAGFEWIDCSDNRHSIVSFIRRAHESDRFLVVVCNFTPQPHAHYRIGVPVAGFYREIFNSDARSYGGSNMGNLGGKWTDEWSCHNRPYSLDLCLPPLTTLVLELASGPESLSEAANSPL

SEQ ID NO: 5179 - protein, 149 aa, Nostoc punctiforme
MLFRYNSAQDFNTLESYINGLLGDTRVPSTQFEKGSVKVPAAELQETDDAIYLKLELPGLEAKDLDIQVTEDAVHISGERKSETQIQNNGTTKSEFYYGKFQRVIPLSARVQNTNVTADYKNGILNLTLPKSEREKNKVVKVNLEQTTA

SEQ ID NO: 5180 - protein, 187 aa, Macrozamia communis
DEHGEVVAEIRRSDLEPYLGLHYPATDIPQASRFLFMQNRVRMICDCRATPVRVIQAAELRQPLCLVGSTLRAPHGCHAQYMANMGSIASLVMAVVINGNDEAGGSGRSSMKLWGLVVCHHTSPRAVPFPLRYACEFLMQAFGLQLNMELQLAAQLTEKHILKTQTLLCDMLLRDAPIGIVTQSPSI

SEQ ID NO: 5181 - protein, 189 aa, Macrozamia communis
DDHGEVVAEIRRSDLEPYLGLHYPATDIPQASRFLFMRNRVRMICDCSSPPVKVVQDKRCPKPLSLCGSTLRAPHGCHAQYMANMASIASLVMAVTINDDDDDIGSSGQQKGRRLWGLMVCHHTSPRFVPFPLRYACQFLMQVFGIQLNREVELAAQLREKHILRTQTVLCDMLLRDAPDGIVAQTPNI

SEQ ID NO: 5182 - protein, 472 aa, Escherichia coli
MTTHLVWFRQDLRQHDNLALAAACRNSSARVLALYIATPRQWAAHNVSPRQAELINTQLNALQIALAEKGIPLLFREVDDFAASVEIVKQVCAEYRVTHLFYNYQYEVNERARDVQAERTLRNVVCEGFDDSVILPPGAVMTGNHEMYKVFTPFKNAWLKRLREGMPECVAAPKVRSSGSIEPAPSITLNYPRQSFDTAHFPVEEKAAIAQLRQFCLNGAGEYEQQRDFPAVEGTSRLSASLATGGLSPRQCLHRLLAEQPQVLEGGPGSVWLNELIWREFYRHLMTYYPSLCKHRPFIAWTDRVQWQSNPAHLKAWQEGKTGYPIVDAAMRQLNSTGWMHNRLRMITASFLVKDLLIDWREGERYFMSQLIDGDLAANNGGWQWAASTGTDAAPYFRIFNPTTQGEKFDREGEFIRQWLPELRDVPGKAVHEPWKWAEKTGVTLDYPQPIVDHKEARLRTLAAYEEARKGA

SEQ ID NO: 5183 - protein, 550 aa, Rickettsia prowazekii
MTTKLIKHVQKAREQMLEGIDILADAVKVTLGPKGRNVLIEQSFGAPKITKDGVTVAKSIELKDKIKNAGAQLLKSAATKAAEVAGDGTTTATVLARALAREGNKLVAAGYNPMDLKRGMDLAVNAVVEEIKRSSKKINSQEEIAQVGTISSNGDKEIGEKIAKAMEEVGKEGVITVEEAKNFSFDVEVVKGMMFDRGYLSPYFVTNSEKMVAELENPFILLFEKKLSNLQPMLPILEAVVQSQRPLLIIAEDVEGEALATLVVNRLRGGLKVAAVKAPGFGDRRKAMMEDIAILTKGELITEDLGMKLENVNIKNLGTAKRVTISKENTVIVDGNGDKKNIEDRVLQIKSQIAETTSDYDKEKLQERLAKLSGGVAVLKVGGATEVEVKERKDRVEDALAATRAAVEEGVVAGGGVTLLHASQTLTKLKVQNKDQQAGIEIVIEALKDPLKQIVKNAGENGGVVVGKLLEHNDKNYGFNAQDMQYVDMIKAGIIDPAKVVRTALQDAASVASLIITTETLIVDEPSDKEEPMPMRGGMGGMGGMGGMDF

SEQ ID NO: 5184 - protein, 154 aa, Zea mays
  misc_feature (9)..(9): Xaa can be any naturally occurring amino acid
  misc_feature (132)..(132): Xaa can be any naturally occurring amino acid
RVCALTRPXARAADHPPSAFLLLLLLLGCASLAIGGADMARHVLLGVKENLPAANSGEGGGLCRFSGGEHNRHENALMEVLRLGEAKEQVEGCTLHHLTLEAVEAGRKKLYKAKGWVKPWLDFKELQEFRHXGGATVFTNDRLGAKQGGHDPAW

SEQ ID NO: 5185 - protein, 775 aa, Photorhabdus luminescens
MTKYSLRIRMMSLILVPILLVGMFFSISFLCYHYRELENQIVRSGISIIEPLSIASEIGINLHNRESVNSLITRLHRRNSEIVRAIAIFNDDNQLFDISNYKYNSAQLQISPDMPLPTTLTKTEVKNSIILRMPIISEHHLSQNQPHSDTPSLRPIGYIAIDLDLRSAHLQQYKEIVIFILLLLICLGWASLFAYHLVRKITKPISDIVSTVDRIRQGQLNSRVSGKYFGELDMLKNGINAMAKSLSSYKEEMQNDIDQATSDLRETMEQFEIQNVELAIAKKRAQDAARIKTEFLANMSHELRTPLNGVIGFTRQTLKTPLTIQQTEYLYIIERSANHLLNIINDILDFSRLEADKLVLENVPFLLQDTIDEVMVLLTLSAKSKNIQLTHHVDPQIPNLVVGDPTRLQQIFTNIIGNAIKFTDQGSVEIKINLLQQKHHKINLEITVSDTGIGISPEQQPHLFQAFHQANASISRHYGGTGLGLVITRKLIQEMGGNISFTSEPKKGSVFRFDLWLGKDDFILTGSVVPQKTLIHPPRLPMTVMAVDDNPANLKLIGSLLDEIVEKTVLCNSGEEALQSAASHHFDLILMDIHMPGMDGICTSNHIHQLPQHYSTPIIAVTAYTCRPKSDTHSPFEDFLTKPLDEHRLRVVLDRYVKTPKSQHINWPLALQQATGKEPLAIDMLQMLVDLLPTIKTITEKVLSGETVENYQQQIHKLHGSCCYSGVPQLKALCQLIEQQLQQGVQLTDIEPELLELTDEIDHVLTAAQKILSRG

SEQ ID NO: 5186 - protein, 407 aa, Candida albicans
MTIESTNSFVVPSDTKLIDVTPLGSTKLFQPIKVGNNVLPQRIAYVPTTRFRASKDHIPSDLQLNYYNARSQYPGTLIITEATFASERGGIDLHVPGIYNDAQAKSWKKINEAIHGNGSFSSVQLWYLGRVANAKDLKDSGLPLIAPSAVYWDENSEKLAKEAGNELRALTEEEIDHIVEVEYPNAAKHALEAGFDYVEIHGAHGYLLDQFLNLASNKRTDKYGCGSIENRARLLLRVVDKLIEVVGANRLALRLSPWASFQGMEIEGEEIHSYILQQLQQRADNGQQLAYISLVEPRVTGIYDVSLKDQQGRSNEFAYKIWKGNFIRAGNYTYDAPEFKTLINDLKNDRSIIGFSRFFTSNPDLVEKLKLGKPLNYYNREEFYKYYNYGYNSYDESEKQVIGKPLA

SEQ ID NO: 5187 - protein, 148 aa, Candida glabrata
MCCCTFPDFLLMLLAFIFPPAAVVIRSGIASSDLVLNMLLTMCGFVPGCIHAIYYISMTSPLRNDDYSTRYQQGWIDSERLVSSNSDTRPVPLATHDPTPQVESSQGETPQATNDEVSRGYDVQTPLLNDPGYIVDNKKGGMPPPYSP

SEQ ID NO: 5188 - protein, 496 aa, Zea mays
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 5189 - protein, 548 aa, Idiomarina loihiensis
MAAKEVKFGNTARQKMLKGVNILADSVKVTLGPKGRNVVLDKSYGSPVITKDGVSVAKEIELEDKFENMGAQMVKEVASKANDEAGDGTTTATVLAQAIVNEGLKSVAAGMNPMDLKRGIDKAVIAAVEELKKISQPCADSKAIAQVATISANADHTIGEIIAQAMDKVGQEGVITVEEGQALTDELDVVEGMQFDRGYLSPYFINNQESGSVELDNPFILLIDKKISNIRELLPVLEGVSKAGKPLLIIAEDVEGEALATLVVNNMRGIVKVAAVKAPGFGDRRKAMLQDIAVLTGGTVVSEEIGMELEKTQLEDLGTAKRVVITKDNTTVVDGNGDDTAIDGRVNQIKQQMEDTTSDYDREKLQERLAKLAGGVAVIKVGAATEMEMKEKKARVEDALHATRAAVEEGVVPGGGVALVRAASKLAELRGDNEEQNVGIRLALRAMEAPLRQIAMNAGAEGSVVANNVRAGEGNYGYNAGNDTYGDMLEMGILDPTKVTRSALQFAASVGALMITTEAMIADIPQDDNAGGMPGGDMGGMGGMGGMM

SEQ ID NO: 5190 - protein, 290 aa, Streptomyces violaceoruber
MHVPSTAPPPATAAPLFGPFTVGSLALENRIVMAPMTRELSPGGVPGPEVAAYYARRARNGVGLIITEGAAIGHPSSERRAAVPRIHGADALAGWTRVTQAVHAAGGRIAAQLMHVGLDPLLWGMTPAEMDAASPAGFELLSPSGVDPSQPAAATVGREMSDVDISSVIDAYARAAAEARQAGFDAIELHAAHGYLIDQFFWAVTNRRKDRYGGDLSARTRFGADVVRACRHAVGEDFPIFLRFSQWKVGHYAARLADSPDELAAVLGPLVQAGVDAFHCSTRRFWQPEF

SEQ ID NO: 5191 - protein, 282 aa, Oryza sativa
GEFEDVKLLNNLLTEKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYKNIMQNCMETPAILREGIEATGRFEILSKEAGVPLVAFSLKASGRYTVFDISEHLRRFGWIVPAYTMPANAEHVAILRVVIREDFSRSLAERLVSDIVKILHELDAHSAQVLKISSAIAKQQSGDDGAVTKKSVLETEREIFAYWRDQVKKKQTGIC

SEQ ID NO: 5192 - protein, 301 aa, Ralstonia solanacearum
MIEESVMLRQHNLRLRKYDYVLGRLFVALPIGGLVVAVLLLFADWRVGRFELAMCLAMYLFTMMGIEVGFHRCFAHRAFKAGTGLQWVLAVAGSMGGHGPLIWWVTTHRRHHRFVDTDQDPHTPNKDLRGPWRNFKSFLYGYVGWTMDTDVKLQEGWQRYGVDLYKNSILFKVHARFALIALLGLLLPTVAGALFHRTAEGALLGLLWGGLVPICLTQHLFWMINAFGHRIGAKPFSGRIVGDSRNCWWLALPTFGQGWHNNHHADPGCATTRKTWWQLDPGAWLIRLFERLGWASAVKWK

SEQ ID NO: 5193 - protein, 379 aa, Photobacterium profundum
MSTTKPPLLWLNVFIFSFSLAVAAIGTPLYAYFIGFDWTQVAMLVVAFSYCGLSITAGYHRLWSHKTYEANAVMRFIFAIGGAFALQNSILHWSSDHRVHHRHVDNNDKDPYSAKMGFFYSHIGWMLREYQASRYTDYSNCRDLQKDKIVMWQDKYYGILAIVTNFGFPLIFGVVHGDIWGALLLVGVVRLVLSHHTTFFINSLAHVWGSQPYSDKNTARDNGILAYLTFGEGYHNYHHIFENDYRNGIRWWQFDPTKWLIKSCSYFGFTRKLRVSPEDRIEKARAKMQLVRLQAKLTATSNANNCDVQARIRLLEEEYELLMSKISDYYAAKKRMVELKKKHLTKHYENFEFMQQYNDMKLHLQEQRKSWKMLTAQYA

SEQ ID NO: 5194 - protein, 467 aa, Listeria monocytogenes
MTSVMWFRRDLRVNDNKALYHACKEDDLLLLFQVNPAQFITGSPSHQAFFASVAHFKQEIDKTAHLQIMFGEPIECFQQLKDSLPSWDKVYFNRDETGYGAKRDEAAQAFFDEQKIEVQAFHDSYLHSAEEVKKSPTEYYKIFTPYYKKWREEIKETPFKVTLKHENIRKESLFLKYEEQFAEMTSDLPILDIGERAANTRLANFIKHDVADYDKARDFPELDKTSHLSRYLRTGEISIRTIWQTLQETEATEGRATFEKELCWRDFYNMIYVSFPNQKNEPIQENYRFIEWENNREYFKAWQEGKTGFPLVDAAMRQLKETGWMHNRLRMITASFLTKDLLIDWRFGEKYFQQMLIDYDPASNIGGWQWAASTGTDAVPYFRIFNPTTQSQKFDSTGKFIRKYVKELANLPDKYIHQPEKMSETEQKEHGLLLGKDYPFPIVDHKERRKLAIARYEFSKEHSRGNI

SEQ ID NO: 5195 - protein, 155 aa, Arabidopsis thaliana
MSLIPSFFGNNRRINNNIFDPFSLDVWDPFKELQFPSSSSSAIANARVDWKETAEAHVFKADLPGMKKEEVKVEIEDDSVLKISGERHVEKEEKQDTWHRVERSSGGFSRKFRLPENVKMDQVKASMENGVLTVTVPKVETNKKKAQVKSIDISG

SEQ ID NO: 5196 - protein, 466 aa, Oryza sativa
MGEFCGEERLRSRSKSCYAVDRPAEIAPRVQNPIFSVWPVEDLEADPQGRASTPTNFLGKKLKKQVTSAVNYHGKSSNINRFKVMAKELDEGKQTDQDRWKGLAYDISDDQQDITRGKGFVDSLFQAPTGDGTHEAVLSSYEYLSQGLRTYDFDNTMGGFYIAPAFMDKLVVHISKNFMTLPNIKVPLILGIWGGKGQGKSFQCELVFAKMGINPIMMSAGELESGNAGEPAKLIRQRYREAADIIKKGKMCCLFINDLDAGAGRMGGTTQYTVNNQMVNATLMNIADNPTNVQLPGMYNKEDNPRVPIIVTGNDFSTLYAPLIRDGRMEKFYWAPTRDDRVGVCKGIFRTDNVPDEDIVKIVDSFPGQSIDFFGALRARVYDDEVRKWVSDTGVENIGKRLVNSREGPPEFEQPKMTIEKLMEYGYMLVKEQENVKRVQLAEQYLSEAALGDANSDAMKTGSFYG

SEQ ID NO: 5197 - protein, 272 aa, Lactococcus lactis
MKLNNQIEIPELGLGVFQIPNDETADVVKNAIVNGYRLIDTAKIYENEEGTGQGIKEGLAMTGLSRDDLFITSKLWGDNHSYEETVQNFEKSLKKLDLDYLDLYLIHWPGTHYAYKEAWNAMEDLYKAGKIKAIGVSNFQKSHLEELLSYAKITPVLNQIELHPKLSQEELRNFLELHDIKVQAWSPLMQGQLLDNEVLKKIADKHGKSVAQIILRWDIQQDILVNVKSIKSERMIANRQIFDFSLDSEDMKAINSLNEELRVGPDPEHFNF

SEQ ID NO: 5198 - protein, 710 aa, Rhodobacter sphaeroides
MAEDKPAARSGSFENLVSDYGAGGEFHQHAGEGDERLTTAQGVTIADNQNSLRSGAPGPTALEDFILREKIFHFDHERIPERVVHARGFGAHGLFECTKAIPEITRAAPFQKEGKITETFVRFSTVAGSKGSVDLARDVRGFAVKFYTDEGNWDLVGNNIPVFFIQDAIKFPDLIHSVKPEPDRGFPQAQSAHDNFWDFISLTPESMHMVMWQMSDRAIPRSFRFMEGFGVHTFRFINAEGQSSFVKFHWKPKLGMQSVLWDEALKINGADPDRHRRDLWEAITAGDFPEWELGLQIFDEEFANRFDFDVLDPTKIIPEELVPLTIVGTLTLDRVVDNFFAETEQVAFCTQNVVPGIDFTDDPLLQGRNFSYLDTQLKRLGSPNFTKLPINAPRGCPVHNFQQDGHMQTSNRKGRVNYEPNGWGKGPRAHPLEGYVSYAVRNEGEKRRLRPESFADHYSQARQFFLSQTPVEQGHIRDALVFELSKCQEIEIRARIVAHLLNIDGALAQAVADGLGLTEMPEPAPAARPTRTDLPPSDALSMLKNPPPNFAGRTVGVLAGNGVEAELLTELRSILQAEGAMMKLVAPRVGGVTDSAGTLHPADEKLGGGPSVIFDAVAVLPGSDAAMLAANPAAQDFLTDAHAHCKFIAHHGAGPLIEACALGAKMDEGWIEIGSSSDIDGFVAACRGMRHWPREATLGGNPPLARTFSP

SEQ ID NO: 5199 - protein, 545 aa, Enterobacter aerogenes
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIVNEGLKAVAAGMNPMDLKRGIDKAVVAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGDEAAIQGRVTQIRQQIEEATSDYDREKLQERVAKLAGGVAVIKVGAATEVEMKEKKARVEDALHATRAAVEEGVVAGGGVALIRVASKIAGLKGQNEDQNVGIKVALRAMEAPLRQIVLNCGEEPSVVANTVKAGDGNYGYNAATEEYGNMIDMGILDPTKVTRSALQYAASVAGLMITTECMVTDLPKSDAPDLGAAGGMGGMGGMM

SEQ ID NO: 5200 - protein, 550 aa, Wolbachia endosymbiont
MTNVVVSGEQLQEAFREVAVMVDSTVAITAGPRGKTVGINKPYGAPEITKDGYKVMKGIKPEKPLHAAITSIFAQSCFQCNDKVGDGTTTCSILTSNMIMEALKSIAAGNDRVSIKNGMQKAKDAVLEGITSMSRTIPLEKMDEVAQVAIISANGDKDIGNSIADAVKKVGKEGVITVEESKGSKELEVELTTGMQFDRGYLSPYFITSNEKMIVEFDDPYLLITEKKLSIIQPLLPILEAVVKSGKPLLIIAEDIEGEALSTLVINKLRGGLKVTAVKAPGFGDRRKEMLEDIAALTGAKYVIKDELGIKMEDLTLEDLGTAKNVKVTKDNTTIVSGSSDSDRVKARVEQIKSQIETSTSDYDKEKLRERLAKLSGGVAVLKVGGVTEVEVKERRDRVEDALHATRAAIEEGIVPGGGVALLYASSALDKLKGGSDEEQIGINIIKKVLSAPIKRLVKNAGLESAVIIDHLTKQNDKELIYNVEAMNYANAFTAGVIDPAKVVRIAFETAISVASVLITTESMIVDVPNKEENASSSMGAGGMGGMNGF

SEQ ID NO: 5201 - protein, 766 aa, Vibrio fischeri
MTFRLKTIIGISIIQCIMLLILVFSSVKFISDSNEQRLIARANASVHMFSNAIKDSILNNQYDKVASLMDDFITLEKICYIRIFREDGSLIVEGGPKLHEVANPDSSILHNASDGTYDVILPIITNDKTLGKVEIGFGTHGENTFLSQAKSWIYAIASIELIFVIGLSFLLGNALTRNLHKLKKAVNTVASQGPGAQVDISSIGDLGDVAQAFNNMSLKLEQNYQDLQQARNEAEAANKSKSRFLASMSHEIRTPMNAVLGLLAILKDTTLKPNQKELVNTATDSSELLLSIINDILDFSRMEANTFYLENHIFNIHKSLNSVLKTFHPQAQNKQLELSLFIADNVPTYVQGDAHRLRQILLNLVGNSLKFTDDGQVQILVNAEEHEGRIQLHCSVQDSGIGIQQEQLEYLFDEFTMADNSFSRTHEGSGLGLAICQRLVHMMDGTITVNSQYGLGSEFSFNIQLDKATTKEINYLLSKEKIEQQKDIEQQKNCVFSDANILVVEDNHANQIVIKNTLNYAGYSIDIAQNGKEAITKAINTQYDLIFMDISMPEMDGMTATKKIRSLSDTHQNMPIIALTAHALSGDKERFIEAGMTDYLSKPFNRSDLLECLAKYLFKQGKQDPSFCQECDLCEFNESTEEPKSMDNELLLVDEQIIQQIIADTDASVMPELIRFYIIESKERVETISNAAKNKDLYALEFEAHTLGSSALTLGNVALSTLAREIEIHCINQQFDDALEKTAHLPDLATLSLDALEKRNKQGFSK

SEQ ID NO: 5202 - protein, 188 aa, Triticum aestivum
  misc_feature (26)..(26): Xaa can be any naturally occurring amino acid
  misc_feature (93)..(93): Xaa can be any naturally occurring amino acid
MSTSSGAKEAPANNPGLQAEADPATXKGYIMQQTMFRVKDPKVSLDFYSRVMGMSLLKRLDFPEMKFSLYFLGYEDLSAAPADPVQRTGWTFXQKATIELTHNWGTESDPEFKGYHNGNSDPRGFGHIGVTVDDVYKACERFERLGVEFVKKPDDGKMKGIAFIKDPDGYWIEIFDLKRIGEVTATAS

SEQ ID NO: 5203 - protein, 947 aa, Arabidopsis thaliana
MDGVTGGGTNIGEAVTAPPPRNPHPATLLNANSLPPPFLSKTYDMVEDPATDAIVSWSPTNNSFIVWDPPEFSRDLLPKYFKHNNFSSFVRQLNTYGFRKVDPDRWEFANEGFLRGQKHLLKKISRRKSVQGHGSSSSNPQSQQLSQGQGSMAALSSCVEVGKFGLEEEVEQLKRDKNVLMQELVKLRQQQQTTDNKLQVLVKHLQVMEQRQQQIMSFLAKAVQNPTFLSQFIQKQTDSNMHVTEANKKRRLREDSTAATESNSHSHSLEASDGQIVKYQPLRNDSMMWNMMKTDDKYPFLDGFSSPNQVSGVTLQEVLPITSGQSQAYASVPSGQPLSYLPSTSTSLPDTIMPETSQIPQLTRESINDFPTENFMDTEKNVPEAFISPSPFLDGGSVPIQLEGIPEDPEIDELMSNFEFLEEYMPESPVFGDATTLENNNNNNNNNNNNNNNNNNNNTNGRHMDKLIEELGLLTSETEHYRSNISRSNAANPGVVFVCNRFLCVIERNDQRKLSGKVMMKSSVNFRQNLSVALVRIVSVLLVSSISVVTTDSPPSWGLTEENLLFLEAWRTIDRAYIDKTFNGQSWFRYRETALRNEPMNTREETYMAIKKMVATLDDPFTRFLEPGKFKSLRSGTQGAVTGVGLSIGYPTASDGPPAGLVVISAAPGGPANRAGILPGDVIQGIDNTTTETLTIYDAAQMLQGPEGSAVELAIRSGPETRLLTLTRERVSVNPVKSRLCELPGSGSNSPKIGYIKLTTFNQNASSAVREAIETLRGNNVNAFVLDLRDNSGGSFPEGIEIAKFWLDKGVIVYICDSRGVRDIYDTDGSNAIATSEPLAVLVNKGTASASEILAGALKDNKRALVYGEPTYGKGKIQSVFELSDGSGLAVTVARYETPAHTDIDKVGVTPDHPLPKSFPKDEEAFCGCLKDPTAACYLNQGLLFSR

SEQ ID NO: 5204 - protein, 262 aa, Cucumis sativus
MSKHYQSPLTRMIKEEGKGKLQIKGMFQNQEEKMSDSPQRKMGRGKIEIKRIENTTNRQVTFCKRRNGLLKKAYELSVLCDAEVALIVFSSRGRLYEYANNSVKATIDRYKKASSDSSNTGSTSEANTQFYQQEAAKLRVQIGNLQNSNRNMLGESLSSLTAKDLKGLETKLEKGISRIRSKKNELLFAEIEYMRKREIDLHNNNQMLRAKIAESERNVNMMGGEFELMQSHPYDPRDFFQVNGLQHNHQYPRQDNMALQLV

SEQ ID NO: 5205 - protein, 194 aa, Phyllocladus trichomanoides
DDHGEVISEIRRNDLEPYLGLHYPATDIPQASRFLFMKNKIRMICDACASPVRVIEDKRLPRELSMVKSTLRAPHACHAEYMYNMGSIASLVMAVVVNEREEDDDGQQQIQSVQARRRLWGLVVCHHSSPRFVPFHLRYACEFLMQVFGIQLNKEVELTALGMEKQILRTQTLLCDMLLRGDKPMGIVTRRPNI

SEQ ID NO: 5206 - protein, 229 aa, Cucumis sativus
MGRGKIEIKRIENTTNRQVTFCKRRNGLLKKAYELSVLCDAEVALIVFSSRGRLYEYSNNSIKTTIERYKKACSDSSATSSVTELNTQYYQQESAKLRQQIQMLQNSNSNLVRHLMGDSLSALTVKELKQLENRLERGITRIRSKKHEMLLAEIEYLQKREIELENENVCIRTKIAEVERVQQANMVSGQELNAIQALANSRNFFSPNIMEPAGPVSYSHQDKKMLHLG

SEQ ID NO: 5207 - protein, 251 aa, Brassica napus
  misc_feature (211)..(211): Xaa can be any naturally occurring amino acid
MGRGRVELKRIENKINRQVTFAKRRNGLLKKAYELSVLCDAEVALIIFSNRGKLYEFCSSSNMIKTLERYQKCSYGSIEVNNKPAKELENSYREYLKLKGRYESLQRQQRNLLGEDLGPLNSKELEQLERQLDGSLKQVRSIKTQYMLDQLSDLQTKEQMLLETNRALAMKLDDMIGVRSHHMGGGGGGDWEGNEQNVSYAHHQAQSQGLXQPLECNPTLQMGYDNPVCSEQITATTQAQAQPGYIPDWML

SEQ ID NO: 5208 - protein, 161 aa, Oryza sativa
MSLIRRSNVFDPFSLDLWDPFDGFPFGSGGSSSGSIFPSFPRGASSETAAFAGARIDWKETPEAHVFKADVPGLKKEEVKVEVDDGNILQISGERNKEQEEKTDQWHRVERSSGKFLRRFRLPDNAKPEQIKASMENGVLTVTVPKEEAKKPDVKSIQISG

SEQ ID NO: 5209 - protein, 187 aa, Pseudotsuga menziesii
DEHGEVVAEIRRSDLEPYLGLHYPATDIPQASRFLFMQNRVRMICDCMATPVKLIQSEELMQPLCLVGSTLRAPHGCHAQYMANMGSVASLVMAVIINGNDDEGGGSGRNSMKLWGLVVCHHTSPRAVPFPLRYACEFLMQAFGLQLNMELQLAAQLTEKHILRTQTLLCDMLLREPQWNVTQSPSI

SEQ ID NO: 5210 - protein, 195 aa, Podocarpus neriifolius
DDHGEVISEIRRNDLEPYLGLHYPATDIPQASRFLFMKNKIRMICDACASPVRVIEDKSLPRELSLVGSTLRAPHECHTQYMYNMNSIASLVMAVVISEREEEERDTDGQQQPQEAVRRLWGLVVCHHTRPRFVSFHLRYACEFLMQVFSIQLNKEVELAAQVREKQILRTQTLLCDMLLRGVAPLGIVTRRPNI

SEQ ID NO: 5211 - protein, 600 aa, Neocallimastix patriciarum
MLSARSLICKSMIKSGFRRAVAPSVAMAASSMTLTARRNYSSKYKDIIFAQEGRDKLAKGVNVLAKAVSVTLGPKGRNVLIEQEFDPPKITKDGVTVAKSVELEDKFENLGARIVQDVAIKTNDEAGDGTTTATVLARAIFAEGLKNVSAGVNPVELRRGVQKAVDVVVDFLKEQAHPISTFEEIAQVGTISANGDKHIGGLLAEAMKKVGKDGVINIHEGKTLEDELTITEGMKFDNGFLSPHFITDNKGKKCELENPYILITEEKISAVQDIVPALEIAANNRRPLLIIADDVEGDALATCVLNKIRGQVQVCCIKAPGYGDHRKNNLGDIACLTNGTVMSPNVELTLDKVTEELLGSCERITVTRDDTVFLNGAGDKAKIAERCNQIRSIIKTADLSIYEKEKHEERLAKLTGGVAVIKVGGVSEVEVGEKKDRFVDALHATRAAIEEGIVPGGGTALLKASKVLTNLKADTFDQQLGVDLVKKAIQEPCKTIVNNAGGEGAVVVGRLYNSFEVKGVEDKAVSKKDYKPFTYGFDAYKGEYCDMIKAGIIDPVKVVRTAIVDASGVASLLTTSECMIVDGPDDEPPAPPAGMPMGMM

SEQ ID NO: 5212 - protein, 191 aa, Triticum aestivum
  misc_feature (132)..(132): Xaa can be any naturally occurring amino acid
ELHSFVVGLEGSPDLKAAREVADYLGTIHHEFHFTVQDGIDAIEEVIYHDETYDVTTIRASTPMFLMARKIKSLGVKMVLSGEGSDELLGGYLYFHFAPNKEEFHRETCRKVKALHQYDCLRANKATSAWGXEVRVPFTRSHNVRWHGPEWKCPQELGRSRMGQRKGPHDSTYCQDISTGEEIMTGKWLPI

SEQ ID NO: 5213 - protein, 190 aa, Huperzia selago
DEHGEVVAEIRRSDLEPYLGLHYPATDIPQASRFLFMKNRVRMICDFSDPPVNVVQDKDLRQPISLAGSTLRAPHGCHSKYMRNMGSIASLVMAVVINDSEETQNERTQKPKGRKLWGLVVCHHTLPRAVPFPLRSACEFLMQVFGLQINMELELAAQFKEKHILRTQTLLCDMLLQDAPIGIVSQSPNI

SEQ ID NO: 5214 - protein, 179 aa, Daucus carota
MERADQQARGFQGYRKIHQQQQLPASGTASTGTDNNPAAGDQDCLVREQDRFMPIANVIRLMRKSIPSHAKISDDAKELVQESVSEFISFVTSEANYRCQKEQRKTITAEDVLWAMSSLGFDDYVEPLTFYLDRFREADGGERTALRGEPLVKKSGEHGHRGFLQHLHHGTIWGRIMRF

SEQ ID NO: 5215 - protein, 83 aa, Daucus carota
WPMAKLGFEDYIEPLKVYLARYREMEGDTKGSGKGAEGSSRKEGVQPVHQGQLVHQGSYPQGVIYGNSQQQTQHMMVPMQGPQ

SEQ ID NO: 5216 - protein, 62 aa, Daucus carota
WAMGTLGFEDYIEPLKVYLARYREMEGDTKRSGKGAEGSSRKEVYNRFIRDSLFIKVHIHRV

SEQ ID NO: 5217 - protein, 61 aa, Daucus carota
DPLKAYLARYRELEGDTKGSARGEGSAKKDQVGAHISNQQYAHQGSYSQGMSYVKLTHLLC

SEQ ID NO: 5218 - protein, 401 aa, Unknown
  Shewanella sp. MR-4
MKQLIRNIVCLGLGLSLGLSISLSSQENAKSYQSDFDYPLLQDVLETVETYYVKTVSKDELVQAAIKGIFEHLDPYSSFLNHQELLDLKDSNRGEYFGFGFEVASDKDHISIIAPFANSPAEQAGIQAGDIIIKLNNTPTTETNLADILNQIKQHSINNQSIRLTLKHRNDAVEFEVSLKPSTITIQSVASKLLDGNIGYIRLSSFQENSTEDMVRSLSQWQNAHLTGLILDLRNNPGGLLDQAIKIADLFLAKGRIVSTSGRFFDANSDYYASPQTMLTNVPMLVLINKGSASASEVLAAALQENGRAKLLGETSFGKGTVQSLIPILNDGNAIKLTIAQYNTPRGENIHDIGIVPDIKVTTETGSNQKNMAIIDAISARTDVSQDSLVTSAIAWIQHHD

SEQ ID NO: 5219 - protein, 547 aa, Cochliobolus heterostrophus
MQSSNEGPADIIAKVAGVTQGGKREDDGPYFTNNEGIPWPDAEHSKTIGGIPVASDVFLFQKQQTFNRSKNLERMVHPCGSGAFGYFETTKDVTHLTKADFLKTVGEKTPIFIRFSTVTPGREYPDEARNPRGFAIKFYTGEGNYDIVGLNFPVFFCRDPIQGPDVIRSQWRNPKNFLFDYDAIFDLLANTPEGNHAGLMFFSDHGTPQGWRFNHGYGCHTFKWVNKDGQFVYIKYHFVAEHGQKQFTQEQATQMCGEDPDYSKRDLYETIENGEEVVWKAHVQVMSPEEADPDKLGFDPFDVTKVWPRKQFPMQEFGRLVLNKNPENFHRDVEQAAFSPGSMVPGVEDSPDPLLQFRMFFYRDAQYHRIGVNLHQIPVNCPFMAKSFASLNFDGQMRVDANHAGNKPYAPNSFAHKFRPDVAEAPYQVNDNIMSRKSHYWHEGKKNEYDQAKELWSRVMSVQEKQNTIKNTANMLKFVRYPEIQQYNIGTDLSRGIYDLLPKPAFDFSEVEELSHTAHEWYKEKKFRSIDGERLTGFPPSMPVYNY

SEQ ID NO: 5220 - protein, 740 aa, Cochliobolus heterostrophus
MASEILGNVTEKAKDLAGSKSTKMAQLAEVTKDVHDDKWRITSDYGVKQNNTDDWLKVATDDQTGPMLLEDQFAREKIHRFDHERIPERVVHARGSGAFGKFTLFESASDVTSAGILTDTSRETPVFLRFSTVLGSRGSADTVRDVRGFAVKFYTEEGNWDIVGNNIPVFFIQDSMKFPDVIHAGKPEPDCEVPQAQSAHNNFWDFQYMHPEATHMFMWAMSDRTIPRSYRMMQGFGVNTYTLINAKGERHFVKFHFTPELGVHSFVWDEALKIAGQDPDFHRKDLWMAIDSGAYPKWKFGIQVIPEAKEHDFEFDILDATKVWPEELVPVRYIGELELNKNPDEFFTQTEQVAFCTSHIVPGIGFSNDPLLQGRNFSYQDTQLSRLGINWEELPINKPVCPVMNFNRDGAMRHTITKGKVNYWPNRFQTVPPATEKEGGYVEFPEKTAGIKVRMQSKKFREHKSQAELFYNSMSENEKMHMKAAFAFELDHCDDPVVYERLCERLCEIDLELAQSVAEMVGGEQPTKQTRPKHNKTAKGLSQMDFQPEKPTIATRMVAILIADGYDKAAYTGMKAALTAAGALPFTISPRRNKIFADGEDRSGSGVVADHHLEGQRSTMYDSVFVPGGARSIETLSKNGRAVHWVREAFGHLKAIGGTGEAVSFIKQAVDLPGMEFSTSGDVVNSYGVVTATAVQPESFKEAVNMVKEAKDFASAYMYAISQHKNFERETAGLNAMVAY

SEQ ID NO: 5221 - protein, 227 aa, Lycopersicon esculentum
LSFDLLESWLAQNPDAAGFKRNGESIFRELALFQDYHGLPDFKNALVQFMSEIRGNKVTFNPNKLVLTAGATSANETLMFCLANPGDAFLLPTPYYPGFDRDLKWRTGAEIVPIQCTSSNGFRITQSALEESYKLAKTRNLRVKGILVTNPSNPLGTTLTRNELELLVSFVAEKGIHLISDEIYPGTVFNSPKFVSVMEVLIENNYMYTEVWDRVHIVYSLSKDLGL

SEQ ID NO: 5222 - protein, 251 aa, Erwinia carotovora
MNLISIPALQDNYIWLLSNKANRCVIVDPGEASPVLNALDQNALLPEAILLTHHHNDHVGGVSEILNHYPNLPVFGPKETAKCGATYLVEEGNTVSLLNSEFSVIEVPGHTSGHIAYYNAPFLFCGDTLFSAGCGRIFEGTPKQMYESIQKIAELPDDTVVCCAHEYTLSNLRFSNDIWPEDPDIESYLHKISQIREKSQSSLPTTLGLERRINLFLRCHEIDLKRKISNEPENIENWQVFKMLRSKKDCF

SEQ ID NO: 5223 - protein, 226 aa, Yarrowia lipolytica
MSELKDDAIYAAIAHGDTILCQHDFAKRDPKEVVQLVLAKISPGESKKASLMYQDLSIHYITTQATSDTPEGVTFILITKESCGRKAPFLCLLELEKKFNQQYSLQTIGSASKDSLNKFEGEMVTLVNSGKYEDVAKVAQSEINKVRDIMVENVEQILERGERISLLVNRTDEMTNNAVAFRKRSTQAKRNLWWKNVKMGALLGTGVAGLVYVAIGSVCGFGFQCV

SEQ ID NO: 5224 - protein, 154 aa, Oryza sativa
MSMIRRSNVFDPFSLDLWDPFDGFPFGSGSGSLFPRANSDAAAFAGARIDWKETPEAHVFKADVPGLKKEEVKVEVEDGNVLQISGERIKEQEEKTDKWHRVERSSGKFLRRFRLPENTKPEQIKASMENGVLTVTVPKEEPKKPDVKSIQITG

SEQ ID NO: 5225 - protein, 397 aa, Unknown
  Burkholderia sp. 383
MLNSLLDFLSHGLLHFSWWQVALFALAVTHVTIIGVTVYLHRCQAHRALELHPIASHFFRLWLWMTTGMLTGQWAAIHRKHHAKCETEEDPHSPQTRGIWKVFLEGAELYRAEAKNEETMRKFGHGTPSDWVERNVYSKYPILGISLMMVIDVALFGVIGLTVWAVQMVWIPFWAAGVVNGFGHFWGYRNFNSTDASTNLFPWGIVIGGEELHNNHHTFATSAKLSNKWYEFDIGWMYIRIMSAFGLAKVKKVAPTPRLNKPKTVLDQETLQAVLSNRYEVMARYGKAVKRAYRQELAHLKEIGGEKYQMMRGARKWFHKDADGLDEPQKKLLPEIFANSQKLQTYFQLRQDLAAIWDRSTASREQLLAQLQDWCHRAEQSGIKALQEFATRLRRYA

SEQ ID NO: 5226 - protein, 190 aa, Huperzia selago
DEHGEVVAEIRRSDLEPYLGLHYPATDIPQASRFLFMKNRVRMIVDCTAAPVKVIQDKELRQPLSLAGSTLRAPHGCHSQYMSNMGSTASLAMAVIINDNDEERSSAVSVQKGRKLWGLVVCHHSTPRAVPFPLRSACEFLMQAFGLQLNMEVELSAQVKEKHILRTQTPLCDMLLRDAPIGIVSQSPNI

SEQ ID NO: 5227 - protein, 358 aa, Ustilago maydis
MADFVKLSIFGTVFEVTTRYVDLQPVGMGAFGLVCSANDQLTSTSVAIKKIMKPFSTPVLSKRTYRELKLLKHIRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAVDVWSAGCIFAEMLEGKPLFPGKDHVNQFSIITELLGTPPDEVIKTICSENTLRFVQSLPKRERVPFSQKFKNADPMALDLLEKMLVFDPRTRISAAEALAHPYLAPYHDPTDEPEAEEAFDWSFNDADLPVDTWKVMMYSEILDFHNIDNSGQDEGPVPPVNN

SEQ ID NO: 5228 - protein, 161 aa, Oryza sativa
MSLIRRSNVFDPFSLDLWDPFDGFPFGSGSRSSGSIFPSFPRGTSSETAAFAGARIDWKETPEAHVFKADVPGLKKEEVKVEVEDGNVLQISGERSKEQEEKTDKWHRVERSSGKFLRRFRLPENTKPEQIKASMENGVLTVTVPKEEPKKPDVKSIQVTG

SEQ ID NO: 5229 - protein, 338 aa, Listeria monocytogenes
MSKLFSEYKLKDVTLKNRIVMSPMCMYSVENKDGIATDFHFAHYVSRAAGGTGLVILEATAVQEVGRISEFDLGLWNDEQVPALKKLVDGLHYHGAKAGIQLAHAGRKAVLPGEIVAPSAIAFDEKSDKPVELTKEAIKEVVADFKRAAYRAKEAGFDVIEIHAAHGYLIHQFLSPITNRREDNYGGPAGNRYKILSDIIKAVKEVWDGPIIVRVSATDYAHGGLQLEDHIPFAKWMKADGVELIDVSTGGLVNVAPPVFPGYQVPFADEIRRGAGIATGALGLITRGEQAEEILCNERADLIIVGRELLRNPYFAKDAAKQLGETIEGPKQYSRAWK

SEQ ID NO: 5230 - protein, 159 aa, Oryza sativa
MSLIRRGNAFDPFSLDLWDPVDGFPFGSGGSSSSSGSLFPRANSDAAAFAGARIDWKETPEVHVFKADVPGLKKEEVKVEVDDGNILQISGERSREQEEKSDKWHRVERSSGKFLRRFRLPENTKPEQIKASMENGVLTVTVPKEEPKKPDVKSIQISG

SEQ ID NO: 5231 - protein, 683 aa, Colwellia psychrerythraea
MQKFCRIALAVSLSLGLSVSAIAFEKPITPEELPVLMPESQHATASKRITARFTRAHYKKVIIDDALSGEVFDRFIKQLDYARNIFLATDIDDFQKYRLEFDTVLTRGKLATAYDIYNLNMQRRLERYEYAVSLLNSKGDKNPFNFTKEEIYSFDREEAPWPVSEAELNELWRLKVKSDVLNLTLTKKEWPKIKEVLTKRYEYAIKRLKQSESEDAFQLVMNSFARVVEPHTSYLSPRNAERFQVDMNLSLEGIGAELRSIEDYTVIHRVVTGGPADKSKQLKSKDRIVGVAQGDKDFEDVIGWRLDDVVELIKGAKGTTVRLQILSGDSDDEANIKVVSIVRDIIKLEDRAAKSEVYLENPDVADSKKLGVITIPSFYNNLSKDVKKEIAKLKEQEVEGIIVDLRGNGGGSLSEATLLTGLFIDKGPVVQIRDGANRIQVNSDRDGVSFFDGPLTVMVDRYSASASEIFSAAIQDYGRGVIIGEHTFGKGTVQQHRGLGRVYDLYEKPLGSIQYTIAKFYRINGGSTQHRGVLPDISFPAAVNPEDWGESKEENALPWDQIQKAKYSPLNELNTDIEYLSSLYQQRIKENPEFNYLLEDISIYQAEKDDKTISLNLATRKSEREERKSKRLVRVNEQLVLLGKEKVTDLDDLSDELDDLDPFLDEAARITFDFVSLGKIAKK

SEQ ID NO: 5232 - protein, 456 aa, Rickettsia sibirica
MLLRLIITLFFIINSICAFAEGEKETENKISNQEAYKQFQDVFERIEKAYVQVPDRQKMIDEAINGMLNSLDPHSSYYTDEDLEDIFTFTKGEFGGIGVEIMYDSGAIKIISPIDDLPAFKAGLKGGDYIVGVDDELVSTLGPNKAIKEMRGTPGTKVKLLIIKEEEAKPQELELTREIVKIKPIKAHLEKNNIAYIRITTFNESTISELKAAVKKLKTESKDDLKGIILDLRNNAGGILDQAIAVSDYFIDSGVIVTTKGRTTSSNSEIKANEFSLKAPKVPMIVLINGNSASASEIVAGALQDHKRAIILGTKSFGKGSVQALTQINSRAAVKLTISKYYTPSGRSIQAEGIEPDILIEPAKVEYPEVKKIDKRFSESSLKNYLKNDNEKNKDNASKNKDSQKETKAKNNKQEENELSELYKKDYQFARAYDVITGLIINKKLETKERVKQEDK

SEQ ID NO: 5233 - protein, 190 aa, Marattia laevis
DDHGEVVAEIRRSNLEPYLGLHYPATDIPQASRFLFMKNRVRMICDCSAPPVKVIQDKKLGQPLSLTSSTLRAPHGCHSLYMGNMGSIASLVMAVVINDNEDDIIKNGHAYQGRRLWGMVVCHHTSPRFVPFPVRSACEFLMQVFGLQLNMEVGMAAQLREKHILKTQTVLCDMLLRDAPIGIVSKSPNI

SEQ ID NO: 5234 - protein, 571 aa, Triticum aestivum
  misc_feature (477)..(477): Xaa can be any naturally occurring amino acid
  misc_feature (484)..(484): Xaa can be any naturally occurring amino acid
MALLAAATLNPTTHLSLRSRAGRNSENLWLRSAASSQKSKGRFCNLTIRAGTPSKPAEPIGPVFTKLKPWQIPKRDWFDKDFLFGASTSAYQIEGAWNEDGKGPSTWDHFCHTYPERISDRTNGDVAANSYHLYEEDVKALKDMGMKVYRFSIAWSRILPDGTGKVNQAGIDYYNKLINSLIDNDIVPYVTIWHWDTPQALEDKYGGFLNRQIVDDYKQFAEVCFKNFGDRVKNWFTFNEPHTYCCFSYGEGIHAPGRCSPGMDCAVPKGDSLREPYTAGHHILLAHAEAVELFKACYNKHGDSKIGMAFDVMGYEPFQDSFLDDQARERSIDYNLGWFLEPVVRGDYPFSMRSLIGDRLPKFTKEEQEKLASSCDIMGLNYYTSRFSKHIDISSDFTPKLNTDDAYASSETKGSDGNDIGPITGTYWIYMYPKGLTDLLLIMKEKYGNPPIFITENGIADVDSDPTMTDPLDDWKXRLDYLQXRHISAVKDAIDQGADVRGHFTWGLIDNFEWSLGYSSRFGLVYIDKKDGNKRKLKKSAKWFAKFNSVPKRLLKTTNNNATVTVTSVSV

SEQ ID NO: 5235 - protein, 190 aa, Marattia laevis
DEHGEVVAEIRRSDLEPYLGLHYPATDIPQASRFLFMKNKVRMICDCTIPPVGVIQHKGLRQPLSLAGSTLRAPHGCHTQYMENMGSIASLVMAVLVNDNDEESSKSSYHTKYRKLWGLIVCHHTKPRAVPFPLRSACEFLMQVFGLQLNMEVELAAQMREKHVLRTQTLLCDMLLRDAPIGIVSRSPNI

SEQ ID NO: 5236 - protein, 421 aa, Arabidopsis thaliana
MVIKGMRVGKYELGRTLGEGNSAKVKFAIDTLTGESFAIKIIEKSCITRLNVSFQIKREIRTLKVLKHPNIVRLHEVLASKTKIYMVLECVTGGDLFDRIVSKGKLSETQGRKMFQQLIDGVSYCHNKGVFHRDLKLENVLLDAKGHIKITDFGLSALSQHYREDGLLHTTCGSPNYVAPEVLANEGYDGAASDIWSCGVILYVILTGCLPFDDANLAVICRKIFKGDPPIPRWISLGAKTMIKRMLDPNPVTRVTIAGIKAHDWFKHDYTPSNYDDDDDVYLIQEDVFMMKEYEEEKSPDSPTIINAFQLIGMSSFLDLSGFFETEKLSERQIRFTSNSLAKDLLENIETIFTEMGFCLQKKHAKLKAIKEESTQKRQCGLSVTAEVFEISPSLNVVELRKSHGDSSLYKQVMMHSCNIS

SEQ ID NO: 5237 - protein, 375 aa, Arabidopsis thaliana
MNRRQQVKRRVGKYEVGRTIGEGTFAKVKFARNSETGEPVALKILDKEKVLKHKMAEQIRREIATMKLIKHPNVVQLYEVMASKTKIFIILEYVTGGELFDKIVNDGRMKEDEARRYFQQLIHAVDYCHSRGVYHRDLKPENLLLDSYGNLKISDFGLSALSQQVRDDGLLHTSCGTPNYVAPEVLNDRGYDGATADMWSCGVVLYVLLAGYLPFDDSNLMNLYKKISSGEFNCPPWLSLGAMKLITRILDPNPMTRVTPQEVFEDEWFKKDYKPPVFEERDDSNMDDIDAVFKDSEEHLVTEKREEQPAAINAFEIISMSRGLNLENLFDPEQEFKRETRITLRGGANEIIEKIEEAAKPLGFDVQKKNYKYIT

SEQ ID NO: 5238 - protein, 250 aa, Photorhabdus luminescens
MELISIPALSDNYIWLLCDENRHVVIVDPAESQPVLDTLESRGWIPDAILLTHHHHDHVGGVPGIIDRFPELLVYGPAETQSKGATIIVCGGDSINFGHFSFQIIDVPGHTLGHIAFYQAPYLFCGDTLFSGGCGRLFEGTAEQMYTSIGKIAELPDDTLICCAHEYTISNMKFAHAVLPNQTISEYQQKVIRMRENNQPTIPTTLQTEKKINIFLKCDDIDLQRNIGITPNSQPLSAVFHQLRRQKDQF

SEQ ID NO: 5239 - protein, 414 aa, Archaeoglobus fulgidus
MTIDDVLSLLEKAESEDLNPRTGRLFAYVYETGDENIRKVAEKALVRFAEKNLLDFTVFRSAVFFEKEVVGFARNLMHGDAAVGSFTFGGTESIMLAVKAARDYYRKKEGTAEVPEILAPISIHPAFLKAADYLGLKVVRLPVKDAKGDVDAFAEAVSGKTALIALSAPNWPFGTIDPVEEIAEIAAERNVLLHVDACLGGFILPFFEMLGEKIPKFDFRVEGVTSISLDAHKYGYAPKGASVVLFRDAELKKCSMFVDVTSPGYVFVNQAVLSSRPEGPLAAAFAVIKYLGVEGYKELASKILSARDKIYRGLKSLGFESVGEVESSVLAMTNPDVDLMGFVNNMKKLGWQLHLQKGLKEYDIPDNIHLTLSPVHDGVAEKFVEDAAKALEMEPELTLSRFTQWLKGGSLPKS

SEQ ID NO: 5240 - protein, 426 aa, Pichia pastoris
MSGDHKSFTVFNQEFIIDRDFELIKALGQGAYGVVCSAQYKGNEDGGKVAIKKVTNIFSKKILAKRALREIKLLRHFRGHKYITCLYDLDVIPDQNNNFNEIYLYEELMECDLHHIIKSKQPLTDSHYQSFIYQILGGLKYIHSADVLHRDLKPVNLLVNSDCELKICDFGLARGYSSDAEKNAGFLTEYVATRWYRAPEIILSFQTYTKAIDIWSVGCILAELLGGRPIFRGRDYVDQLNLILSTLGTVSEETLQSIRSERAQDYVRSLPFMPKIPFSQLFPGANPEAIDLLDRMLTVDPTHRITVTEALEHPYLKVWHDPNDEPVCSSKFDFSFEVVDDIETMKQMIVDEVLSLREFVRRPIQEQQLPFTEPDKHFDVSFDQPQIEPPAENYRDDHLPRPHELESQILDLEHELQYGLDRYGTQ

SEQ ID NO: 5241 - protein, 633 aa, Lactobacillus plantarum
MCGFAGCLTDRTKADNAAYDQTIHEMTKMIVHRGPDDDGYFADDNITMGFRRLSIIDLAGGHQPLSYDNERYWMTFNGEIYNYVELREQLKQEGYEFKTSSDSEVILAMYAKYHADATKYLRGMFAFVIWDKQEKTLFAARDQFGIKPFYYAISGDDFYYASESKAIYKILKDKTFDKNALQDYMTFQFVPEPETLTKEIKMLAPGCSLTKKLGSAPRIDRYYHREFHPVERSEDEYAQKIKDALIDSVKIHMRSDVPVGSFLSGGIDSSIIVAIAKNFNPNLETISVGFEREGYSELDVAQETAEKLGVKNYSMTITPEAFMKAFPHFVWSMDDPLADPAAVPQYFLAKEAVKHVKVCLTGEGADELFGGYTIYHEPESLKPFRYTKPINGALKRIALMMPEGMRGRSFLLRGTTPLENRYVGNAFIFGEQEKQAFFKNYNQNHPFQSITQPLYDESVDYDPISRMQFIDMHTWLNGDLLHNADRTTMAHSLELRTPFVDREVYNLAAEIPADLRISHGTTKYILRKAVEDIVPAHVLHRKKLGFPVPIRFWLKDEMYDWAKQIINDSQTDQYFNKDYFLKLLDDHKAGVRDNSRKLWTVLTFMMWHRLYVESDHLMDSPEANAVAEKVEEF

SEQ ID NO: 5242 - protein, 749 aa, Oryza sativa
AREINSPFCSRTIRVTSAALVSNAGGHGQIRVSSGKARRIPPPPPLTPRGGKGRSCLPPLQPLNITRRSLDEWPRAGSDDVGEWPNPTTPGASKAEGAGSAKPGEGLRLDLSSLRSQGRKDQIAFFDKECSKVADHVYLGGDAVAKNRDILRKNGITHVLNCVGFVCPEYFKSDLIYRTLWLQDSPTEDITSILYDVFDYFEDVREQGGRVFVHCCQGVSRSTSLVIAYLMWREGQSFDDAFQLVKAARGIANPNMGFACQLLQCQKRVHAIPLSPNSVLRMYRMAPHSPYAPLHLVPKMLNEPSPAALDSRGAFIVHVLSSIYVWVGMKCDQVMEKDARAAAFQVVRYEKVQGHIKVVREGSEVPEFWDAFSSAPVNSDSNTKISKDQIDSASKTGPGNRRVESYDADFELVYKAITGGVVPAFSSSGAGDETHLPARESTWSSLRRKFISRSLARVYSDSALIRDLDPRVDRVQHLAAEASTSPPFLSPSSLSSDSSISSKYSSDSPSLSPSTSSPTSLGLSPASSNFSHTLVPSSRSPLHQSSNEEPSKSGLGSIRSPSKTSSIAERRGGFSSLKLPSFQKDLVLPPRVPTSLRREEEVTDKSNNNSVKQLTGVCCPEKCTGNTSTVHTKTGITERTDSISEACGNLQLLVYRWPSKEKLTTFTRKDLDPKSVLIFVTPEDSRSEAVKTVHIWVGGEYESSKCVDTVDWQQVVGDFFHLKELGNTLPVKVFKEHETENLLEVLNAR

SEQ ID NO: 5243 - protein, 730 aa, Cochliobolus heterostrophus
MVRSNVLTAIAAICHVAHAVCPYMDDQPLARREGATAMSTDDFMKQYEIDDSKAYLTSPVGGPQPDQESLSAGERGPSLLEDQILRRKIMSFDHERVPERAVHARGAGAHGTFKSYGDWSNITGASFLANSEKETPVFIRFSTVAGSRGSADTARDVHGFAVRFYTDEGNFDIVGNNIPVFFIQDAIKFPDLIHAVKPKPDREIPQAATAHDSAWDFFSQQPSTMHTLLWAMSGHGTIRSYRHTDGWGVHTFRFVRDDGKSKLVKFRFRSLQGKASLLWEEAQTTAGMNADMHRQDLFESIENGYYPEWIFEAQIMEESDQLRFGFDVLDPTKIVPEDIVPFTPLGKLTLNRNPRNYFAETEQIMFQPGHLVRGIDVSDDPLLQGRMFSYLDTQLNRNGGPNFEQIPINQPRVPVHNNERDGAGQMYIPLNTAAYSPNTLNGGYPKQATQAEGRGFFTAPSRSVSGNLVRTVSSTFADNWSQPRLFYNSLSAVEQQFVINAIRFETSQLQSEVVKQNVLIQLNRISHDIATRVATALGMTAPAPDDKFYHNNKTIGVNPAGEPLLKIEGLKVGYLTSAGSTGDKGKALKAALKDEKVSLTVVAEHLGAGIDQTYSATSAVNFDAIIVDGSASALFAPAGSLANSNSTAAKGRSTLYPAGRPLEILQTGYQFGKPVGVLGASNSTLSAAGVVAGTPGVYSFDSASDMAAVVTKITEGLRTFKFLDRYPLDN

SEQ ID NO: 5244 - protein, 822 aa, Leptospira interrogans
MNMRFLLLYIIFLFHYSLMAESLSPVSGKISQLQKDSSLSFFVYYFSSDSDENFRERIFAKDSSLSFQNIPAEVFSLGFTSNTAWFYIPLKNDTKKDYRGEFEIFNPYLEEVDIFYRYGSKDSIHEILAGTSRVYEKSFPALNFYLRPGEEIQIVCKIKSGTPMRIPIVLESEENFNFTKLFRAILFGLTLGFGIAMGLYNFSLYMFFRTRSYLYYFIMILFSTVYLTSWDGLISPLFKPNYGRYYLPFILVLFYTSALFLFLFSMEFLYPEKKERYVKIIIFLYVVVNLLLIPLSIFYPTHLNRISYYLGLVNNLIIVYFCIVRIRGGFKSAKNFLIIHLVFPVAGILTNLSTFGAISIDYLSLHLLKLAFISQSVLFSVMLVQRIKELEFRLKDGLQSEIHKNIVLLKKEIQQRRETEWELIQAKEVAEKASKVKSNFLANMSHEIRTPMNGVLGMVQLLGTTKLNDEQKEYVEVLSVSAKSLLQIINDILDFSKIEAGKVILEREVFSIRSVLDEIHDLLYPLAKQKEINFRLEGKLEIQEYVYGDPLRLRQILWNLAGNGIKFTSRGEVVLKVTQKNISKSSVSIEFTVMDSGIGIPLEKQKQVFEAFSQNDTSTARKFGGSGLGLSITKQLVELQGGVLKLESKDGEGSKFTFTIDYDIPSALEIEKILEAEKTKDLEKSFQDVVAKSTRILVAEDNETNCLLIERALKKLGYDPTVVHNGREVIERMQLEAFDIILMDIHMPEVDGIEATKWIRSKNQNSEFPIIIALTADAIESSKEKYISKGMNDCLTKPLDLPILKSTLDLWSNRVDVSHWKL

SEQ ID NO: 5245 - protein, 204 aa, Zea mays
VKSTIERYKKANSDTSNSGTVAEVNAQSLYEVQSHAQTAYILQCSLFILAFYGHDYVVDLKTTPHKHYQQESSKLRQAIDSLQNANSRTIVGDSIHTMGLRELKQMEGKLEKAINKIRARKNELLYAEVEYMQRREMDLQTDNMYLRSKIAENNNETGQPAMNMIGVPSTSEYDHMASFVDSRNFLQMMKLRIFGQQSMHASTQ

SEQ ID NO: 5246 - protein, 466 aa, Escherichia coli
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 5247 - protein, 530 aa, Lactococcus lactis
MCGFLFMETSDLTIEEFKSNLELIEHRGPDDQQHVRDTLGNDFGFCRLSIMDLSDLGRQPFGLNGKRVMCNGEIYNFLSLRKFLETKGYKFTGDSDCEVLLPLFETTGIETMVKMLDAEFAFVLVDENTAEIFAARDPFGIRPLFYGYNKVTGKISFSSEAKALISTCNDVTPFPPGYYYANGEFHVFNDIAEVSTIVEEPLAEISGHIRRKLERAVKKRLHADAPMGYLLSGGLDSSLVCAIAAKELESPIKTFAIGMETDPIDLKYAREVADFLRTDHTEILMTKEDVLSAVREVIWHLETWDITTIRASIGMYLICKYIHENTELKVLMTGEVSDEMFGYKYTDFAPSAGAFQKEAQKRVHELYMYDVLRADRCLAAHSLEARVPFADLDFAAYVMSINPSRKLNTYGKGKYLLRHAFEGTELLPDEILFREKAAFSDAVGHSMVDYLKEFADEKYSDEDLAKASEKYPKHTPFTKESLMYREIFEEFYPGYEDWILDFWMPNRDWVGAEVTDPSARVLSNYGDSGK

SEQ ID NO: 5248 - protein, 906 aa, Cryptococcus neoformans
MSNFLPIPTKAATPLPSFAKHLLDYISAHFRDTHSEAFRKDVDVLVGMRKDWVEAKLEAHPEIIRAFMRYHAQLAFLSTKFPSDINLPFAYYLPFPATFSLSPDAPISLSSLTFERACVLFNMTALYASMAAAERRAEAEGIKRALGYLTVVHQAAAGVLEYLITSVLPTLRSELSSPQAAGYDMTESFLGTLKEFVLAEAQECYWQQAVLQGTYKNGLIGKLSMKVSEYYKAALASMNGTDYPSSSYFPLNWTAHMNVKQMHFEAAAQFRLSQEDLEKSRYGEEIGRLKVAESLAKKGLDAARKGVADSVVSDLKQLHAAIKSSLERAVRDNDLVYVQPIPPANQLAPIVGVGMVKVNVPAEVAEPVAWLMGGKAGMEPLFSGLVPYGVHLALSIYDDRKDTLVRDLDGKREELDGLAASTLQSLNLPGSIQALDRPVGLPPSLLKKSEEVASSGGIERIRSLLDEVNRLAHANVQSLNEAMDILDQEATENESLIARQPELQQTRQPSHVANQPLIQMAEQYEATIKQAGGSDATVRAKWEEWARLVGILAAGEMEMEDYVPGTTSPSGSLPPSVRPLRASLEELDDRIAHRARLVREARQISAADDIRPEVLKEAAKLAHGGSGDVKTEWFEDLFEKGLEKYMGVKREMDEEVAKHDELLEQIRTQNESFLSERKDDPIIKERERRLQDMDLAYWKWREIVDNAEEGIKFYNSFAEMLHGFKAACGQFLNTRRIDVGQMTTQFQQQMNVSEPQQQPEPRYQSPSPQSFQPSFSPSPSHFQPSAPSSFSSSPVRSPAPSAPARRESPPKTLSFLPHPSSSAWQPASVDFLPPPPPPPILRSGGIQSQPKVAPPVTPSITAIRDQTQGTPRRMTRAAAAAAERDEATERNKYSSGGPRRKGGGVV

SEQ ID NO: 5249 - protein, 372 aa, Idiomarina loihiensis
MSSAFDDFELKGHKLENRFVVAPMTRTSADKKGKPTELMGEYYERFAKGGWSMIISEGVYTDRQASQGYENQPGITDAPQTDAWKEIVERVHKHDCKFIMQLMHAGAQFQHNEYTDTPIAPSEVKPKGEPLDLYGKTDGWPEVKAMDETDFDAVMNGFVGAVNRAKEAGFDGVELHAANGYLLNEFLSDYFNQRPDQWGGDMAKRMHFLELVVKAAKSAAGDDFIVGVRLSQITVTDSDYQWPEGEDAMIKVVKAMEKAGVDYIHTTDTDVMRKPFKGGSNKSLGDIVQEFSDIPLIVNGGISEKNYEHVAGHYPNALLAMAKTSLANPDFPIRIKSSEPIRQLDFAMLQPTATLENEWKWRDENDAHIELD

SEQ ID NO: 5250 - protein, 677 aa, Arabidopsis thaliana
MANKYVSSVLKSLLVLLHLVFLSKQHVDSASIVKSLPGFEGQLPFELETGYIGVGEEEEVQLFYYFIKSERNPKEDPLILWLTGGPGCSAISGLLFENGPLTMKLDVYNGTLPSLVSTTYSWTKTSSIIFLDQPVGTGFSYSRTQQFNKPSDSGEAKRIHEFLQKWLGKHQVFSSNPFYVAGDSYSGLVVPATVQEISKGNYECCNPPINLQGYVLGNPLTDYTTGSNSRIPFAHGMALISDELYESLKKTCKGEYTNVHPRNTQCLKFVEEFNKCTNRIFQQLILDPLCETETPDCYIYRYLLTTYWANDATVREALQINKESIGEWVRCYYSIPYNNDIKSSMPYHVNNSISGYRSLIYSGDHDFEVPYLGTQAWIRSLNYSIIDDWRPWMVKNQIAGYTRTYANKMTFATIKGGGHTAESKPEEASIMFQRSFVEAPLGQWLTKGSLMLLQQDVWGSSPNYCDLLVDLQINGGKCAGDLQRCTIMDLIRKKKTKRSFSSILDWIKGMANNYVSSVLKSLLLLLHLVFLILLLSSIFFLVSLCARNRVCFQSLCVIKSVYIGANEEEEVQLFYYFIKSDRNPKEDPLILWLTGGPGCSAISGLLFENGPLAMKLDVYNGTLPFLVSTTYSWTKTSSIIFLDQPVGTDQPVSIPLERHAKVSKRDIPVGSEVKNLP

SEQ ID NO: 5251 - protein, 451 aa, Triticum aestivum
MATAHQSDGAAAANGKSNGHAVPPAANGESNGHAEAAPVNGESNGHAAAAAAEPEEAVEWNFAGGKDGILATTGAKMSIRAIRYKISASVQESGPRPVLPLAHGDPSVFPAFRTAVEAEDAVAAALRTGQFSCYPAGVGLPAARSAVAEHLSQGVPYKLSADDIFLTAGGTQAIEVIIPVLAQTAGANILLPRPGYPNYEARAAFNKLEVRHFDLIPEKGWEVDIDSLESIADKNTTAMVIINPNNPCGSVYSYDHLAKVAEVARKLGILVIADEVYGKLVLGCAPFIPMGVFGHTTPVLSIGSLSKSWIVPGWRLGWVAVYDPRKILEETKISTSITNYLNVSTDPATFIQAALPQILENTKEDFFKGIIGLLKESSEICYREIKENKYITCPHKPEGSMFVMVKLNLHLLEEIHDDIDFCCKLAKEESVILCPGRTAFSHLSTEIKCME

SEQ ID NO: 5252 - protein, 258 aa, Oryza sativa
KREIKILRLFIHPHIIRLYEVIYTPTDIYVVMEYCKFGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVDPMKRITIREIREHQWFQIRLPRYLAVPPPDTAQQAKMVLCVTFLTSCSLMYQTLYTNIIFLRYTYRV

SEQ ID NO: 5253 - protein, 891 aa, Schizosaccharomyces pombe
MEYRTNNVPVGNETKSAALNALPKIKISDSPNRHHNLVDAFMQSPSYSTQPKSAVEPLGLSFSPGYISPSSQSPHHGPVRSPSSRKPLPASPSRTRDHSLRVPVSGHSYSADEKPRERRKVIGNYVLGKTIGAGSMGKVKVAHHLKTGEQFAIKIVTRLHPDITKAKAAASAEATKAAQSEKNKEIRTVREAALSTLLRHPYICEARDVYITNSHYYMVFEFVDGGQMLDYIISHGKLKEKQARKFVRQIGSALSYLHQNSVVHRDLKIENILISKTGDIKIIDFGLSNLYRRQSRLRTFCGSLYFAAPELLNAQPYIGPEVDVWSFGIVLYVLVCGKVPFDDQNMSALHAKIKKGTVEYPSYLSSDCKGLLSRMLVTDPLKRATLEEVLNHPWMIRNYEGPPASFAPERSPITLPLDPEIIREMNGFDFGPPEKIVRELTKVISSEAYQSLAKTGFYSGPNSADKKKSFFEFRIRHAAHDIENPILPSLSMNTDIYDAFHPLISIYYLVSERRVYEKGGNWNRIAKTPVSSVPSSPVQPTSYNRTLPPMPEVVAYKGDEESPRVSRNTSLARRKPLPDTESHSPSPSATSSIKKNPSSIFRRFSSRRKQNKSSTSTLQISAPLETSQSPPTPRTKPSHKPPVSYKNKLVTQSAIGRSTSVREGRYAGISSQMDSLNMDSTGPSASNMANAPPSVRNNRVLNPRGASLGHGRMSTSTTNRQKQILNETMGNPVDKNSTSPSKSTDKLDPIKPVFLKGLFSVSTTSTKSTESIQRDLIRVMGMLDIEYKEIKGGYACLYKPQGIRTPTKSTSVHTRRKPSYGSNSTTDSYGSVPDTVPLDDNGESPASNLAFEIYIVKVPILSLRGVSFHRISGNSWQYKTLASRILNELKL

SEQ ID NO: 5254 - protein, 291 aa, Haloarcula marismortui
MSKSLDISTTEAEQTVTEVIDTIVATTPDVRRAVADYRGQSNSVNPTGDDQLAADLRADELFEQRVLGIDGVASYASEERADVKTTDGRLHVAMDPLDGSSNLEPNSGMGTIFGIYSEQPPTVGTNLLAAGFVIYGPITSMVVARDGSVREYILEDGDKRVVDDDVTVPEDPTVFGFGGGVDSWTDEFESYAEAVRHELKLRYGGAMVADINQVLTYGGIFSYPALESRPEGKLRVQFEGHPMAYILESAGGRSSDGDQSLLEIEPDELHERTPLYLGNDDLIDRLEANID

SEQ ID NO: 5255 - protein, 610 aa, Pseudomonas aeruginosa
MCGLAGWVDYTRKLDDEFPAIFAMTDTLALRGPDAEGIWKHRNALLGHRRLAVIDLSGGVQPMSYRFPTGQEVTLVYTGEVYNHDALRERLRRAGHEFRTRSDTEVVLHAYLQWGERCCEYLTGMFAFAVFDGRDGHLLLVRDRLGIKPLYYARHREGLLFGSEIKSILAHPEFAARLDAVGLVDLLTLSRGTSQTPFREVQELLPGHLLSWRPNSQAKLRRYWEVRRQEHADDLQSTVQRTRELVTRALGAQLHADVPVCSLLSGGLDSTALTGIAQRIAKAEHGGDINSFSVDFVGQAEQFRSDDLRPDQDQPFALLAAQYIGSRHRTVLIDNAELVCERAREEVFRAKDVPFTFGDMDTSLHLMFGEIRRHSTVAISGEGADELFGGYGWFRDPQAVAAARFPWASRVRLPAGFIDAGFNRRCDLLQYQQASYDDGLRQVEHLAGDSPEERRMREFSHLHLKRWMVLLLERKDRLSMCNGLEVRVPYTDHELVEYVYNVPWSIKSRDGEEKWLLKRACADYVPEAVLKRRKSPYPTSANLGYERFLRGSVRRLLEDAVNPVFGIVSREFLAAELEHPEGYFNTQVSRHNLETALALEGWLRLYGLSA

SEQ ID NO: 5256 - protein, 189 aa, Osmunda regalis
DEHGEVVAEIRRSDLEPYIGLHYPATDIPQASRFLFMKNRVRMICDCTLPPVKVIQDRNLAQPLSSTGSTLRAPHGCHAQYMGNMNSIASLVMAVIVNDTAEVDANGRAYQGTRLWGLVVCRHTSPRAVPFPLRSACEFLMQVFGLQLNMEVGMAAQVREKHILRTQTVLCDMLLRDAPIGIVSQSPNV

SEQ ID NO: 5257 - protein, 616 aa, Listeria monocytogenes
MCNNYANTDGTLSDTSLAYYKERALGGFGLITFEATVVDVRAKGGANKACLYSDHQIASFKRVIDVCHDAGAKISVQLQHAGPEGNSKVSGYPLRAASAIASAAGRNTPEAISREELYELIELYGEAALRAKKAGADAVEVHCAHGYLVSSFLSARTNKRVDEFGGCFENRMRLPRLIIESIRKRVGHSIAILCRINSTDGVEGGLSVQDSATVAAYLEDCGLDGLHVSRSVHIRDEYMWAPTVLHAGFSSDLVTQIKRAVSIPVITVGRFTEPHYAELMVREGRADLVAFGRQSLADPETPNKAAAGKLDELLPCIACLQGCVANMYAGKPITCLVNPLLGRESEAYSPKTPSKKVVVIGGGVGGLYAGWMAGSRGHDVTVYEASDMIGGQMRLAAYPPGKGDLTNMVRSYIKKCEQFDVEIKTNTPVTPELIQEVAPDAVIIATGATPLVLPIPGIEDAGLIHAVDLLDGKEKCGQKVLVVGGGMVGSETAAFLGEAGHDVTVVELRDEVGADVISEHRKFLMRDFDEYKIKSVTNAKVTSFFEDGVTYSLADNKEHRIDGFDSVVLAMGSRAYNPLEEAIKKMVPETYVIGDAIRARRALDATKEALDAVLQL

SEQ ID NO: 5258 - protein, 543 aa, Unknown
  Malus x domestica
MGCYSSKENAPKPGSKGFGSSQPYQQPQTAAQPQKVSSQQPHNPPPPPRPQPQQRAQPAPQPRAQYQQPSPPPAKPAPQPNSILGKPFDDIKQYYTLGKELGRGQFGITYLCTENSTGHSYACKSILKRKLVSKNDRDDIKREIQIMQHLSGQPNIVEIKGAYEDRYSVHLVMELCAGGELFDRIIAQGQYSERAAAAILRDIVNVVHICHFMGVLHRDLKPENFLLSSKDEKAMLKATDFGLSVFIEEGKVYRDIVGSAYYVAPEVLRRSYGKEIDIWSAGVILYILLSGVPPFWAETERGIFDAILEGVIDFDSQPWPSISDSAKDLVRKMLTQDPRKRITSAEVLEHPWLRVGGVASDKPLDSAVLSRMKQSRAMNKLKQLALKVIAENLSEEEIKGLKTMFTNMDTDKSGTITYEELKTGLARIGSRLSEAEVRQLMDAADVDGNGSIDYIEFISATMHRQRLERDEHLYKAFQYFDKDSSGYITRDELEAAMKEHGMGDDNTIREIISEVDADNDGRINYSEFCAMMRSGAQQPAKLF

SEQ ID NO: 5259 - protein, 187 aa, Osmunda regalis
DEHGEVVAEMRRSDLEPYLGLHYPATDIPQASRFLFMKNRIRMICDCCASPIQVIQDEKLRQPLSLAGSTLRAPHGCHSQYMVSMGSVASLVMAVIVNNNDEEPSSRSYQTKLWGLVVCHHTTPRAVPFPLRSACEFLMQVFGLQLNMEVKLSAQMREKHILRTQTLLCDMLLRDAPIGIVSQSPNI

SEQ ID NO: 5260 - protein, 395 aa, Rickettsia typhi
MLNKLNKPALFALIFYPILIISLVVKYSFDYGIGLLEIIFIIASYYINNITVGIGLHRLWSHNAYKINKYAEFVLVMLSAGTLQGPALSWASNHYKHHAKTDTDQDPHSPLKFDNKVLGFLWSHIGWMLVGSGSYKFIDRITWAKLGKNNLLKWQLKYYWKIAAFMNIVVPLFTGYLIGGTIQSAYAGFLFIGLGRFLQQQATFSVNSLCHFVGSKKYYRGTAGDIWWMALFLLGENWHNYHHAFPSDYRNGVKWYHFDVHKWIIFLMSKIGLASELERTTKVRIQAKMQETLSYLSEKQKQKLSLMQTKIDNLLENLCLKSKEIEESSLIIKEQLKKSFVEIQESLKNLAEQVSSATQITEKPSEKLLKIVNKKIIDAEQSIYKLYNQLNTLKV

SEQ ID NO: 5261 - protein, 190 aa, Polypodium vulgare
DEHGEVVAEIRKSDLEPYLGLHYPATDIPQASRFLFMKNRVRMISDCRAIPVKVIQDRGLRQPLGLAGSTLRAPHGCHSQYMANMGSAASLGMAVTVNDNEGESSSRDHQPKQRKLWGLVVCHHTTPRAVSFPLRSACEFLMQVFGLQLNMEVELAAQMREKHILRTQTLLCDMLLRDAPIGIVSESPNI

SEQ ID NO: 5262 - protein, 469 aa, Arabidopsis thaliana
VIKCEYAVRGEIVNIAQKLQEDLKTNKDAYPFDEIIYCNIGNPQSLGQQPITFFREVLALCSYTALLDESATHGLFSSDSIERAWKILDQIPGRATGAYSHSQGIKGLRDAIADGIEARDGFPADPNDIFMTDGASPGVHMMMQLLITSEKDGILCPIPQYPLYSASIALHGGTLVPYYLDEASGWGLEISELKKQLEDARSKGITVRALAVINPGNPTGQVLSEENQRDVVKFCKQEGLVLLADEVYQENVYVPDKKFHSFKKVARSMGYGEKDLALVSFQSVSKGYYGECGKRGGYMEVTGFTSDVREQIYKMASVNLCSNISGQILASLIMSPPKPGDDSYESYIAEKDGILSSLARRAKTLEEALNKLEGVTCNRAEGAMYLFPCLHLPQKAIAAAEAEKTAPDNFYCKRLLKATGIVVVPGSGFRQVPGTWHFRCTILPQEDKIPAIVDRLTAFHQSFMDEFRD

SEQ ID NO: 5263 - protein, 445 aa, Arabidopsis thaliana
MASNGVTNCNANANVWRFKGNGATSDAAAVTLRKLAFGMFKNCTMNSGKTILFPTPGEPSAHSNFRTCPEAEEAVAAAARSGMANSYAPSPGVFKARRAVAEYLNGELPTKLKAEDVYITGGCNQAIEIVIDSLAGNPSANILLPRPGYPHYDARAVYSGLEIRKYDLLPESDWEINLDGLEAAADENTVAMVIINPNNPCGNVYTYDHLNKVAEMARKLGIMIISDEVYDHVVYGDKPFIPMGKFASIAPVITLGSISKGWVNPGWRVGWIAMNDPNGIFVSTGVVQAIEDFLDLTPQPSFILQEALPDILEKTPKEFFEKKIKAMRRNVELSCERLKDIPCLFCPKKPESCSYLWLKLDTSMLNNIKNDFDFCTKLVSEESLILIPGVALGAENWVRISIGTDESVVQEIFDRLKGFYDRHAISKEAIKLSGHAINQIVVSVN

SEQ ID NO: 5264 - protein, 372 aa, Arabidopsis thaliana
MPEIEIAAGSGDNNDALFGKYELGKLLGCGAFAKVFHARDRRTGQSVAVKILNKKKLLTNPALANNIKREISIMRRLSHPNIVKLHEVMATKSKIFFAMEFVKGGELFNKISKHGRLSEDLSRRYFQQLISAVGYCHARGVYHRDLKPENLLIDENGNLKVSDFGLSALTDQIRPDGLLHTLCGTPAYVAPEILSKKGYEGAKVDVWSCGIVLFVLVAGYLPFNDPNVMNMYKKIYKGEYRFPRWMSPDLKRFVSRLLDINPETRITIDEILKDPWFVRGGFKQIKFHDDEIEDQKVESSLEAVKSLNAFDLISYSSGLDLSGLFAGCSNSSGESERFLSEKVAGDVGGGSGGVCERGESEDEEEEGGRVWV

SEQ ID NO: 5265 - protein, 64 aa, Oryza sativa
QALLEFEKLVSVKQQVVAGTVDYFTIEVKEGDAKKLYEAKVWEKPWMDFKELQEFKPVDASANA

SEQ ID NO: 5266 - protein, 253 aa, Bartonella quintana
MLIEQFICREDNFGVLIHDERSGYTAAIDAPESKAICSALKRRNWTLQTIFVTHHHHDHIEALAELKQIYKAVVIGPEAEKEKIGHLDQALQPDESLFFGTHTLLALSTPGHTLGSLSYYFPQENLLFSGDTLFSLGCGRLFEGTPAQMLNSFKKLRQLPDETLLYCGHEYTKTNALFALTLDSHNQKLHQRVEDVFLLRAKNAMTLPVTLGQEKATNPFLRWDDRTLRKNLAMEKETDEEVFAEIRKRKDNF

SEQ ID NO: 5267 - protein, 373 aa, Vibrio fischeri
MNHKTLFEKTYLKNITLQNRIVMAPMTRARTSQPGNIPNDMMATYYKQRATAGLIISEATQISDDSQGYSFTPGVYTDEHVKGWQPITSAAHKEGAAIFCQLWHVGRVSHPIFQKGGLPIAPSALAPVETKVWISDEEGNGKMVDCIQPRAMTQDDIDRVIQDFAYSAKRAIEAGFDGIEIHGGNGYLIDQFLRTNSNHRTDKYGDTRENRIRFLLEVVDAVSKEIGSDKVGVRLAPFITFKDMDCPDIVPTILDASRELQSRNIAYLHLSEADWDDAPVIPENFRIELRKLFSNTIIVAGSYTQERANEILNKGYADLVAFGRPFVSNPDLVSRLKNNYELAALDGNTLFGGNAKGYIDYPVYNTKVLEVEV

SEQ ID NO: 5268 - protein, 368 aa, Debaryomyces hansenii
KHCTTNKQHSENAYIRCTIFDSKGDIVVHGKDIRRLQFMKTHNLVPRDFRKITRHYHGSNMSSMNNINVDIVPSIVTRGNSILLNLSNIKALIKSDTVVIFDSLSKNSGSGMNKSHSHGSFLKDMNEKLKTKNEQDDLPYEFRALECISIHVMLNLTTEMNVHKTVLQNILSRLEESIERVKLRYLLIQSKKIAQFHQKTKLIRDLLDNILEQNDELNALYLTEISKGKPRLQANHAEAEMLLESYYKTIDEIVQTVENLRSQIKTSEEIINIVLDSNRNELMLLGLKFSTGLLSMGCALYIAALYGMNLENFIEETDGGFELVVGGGSILLLILLMFSVKQLKKVQRITMTGMGRENSRISINDNKR

SEQ ID NO: 5269 - protein, 247 aa, Brassica napus
  misc_feature (16)..(16): Xaa can be any naturally occurring amino acid
  misc_feature (139)..(140): Xaa can be any naturally occurring amino acid
  misc_feature (235)..(235): Xaa can be any naturally occurring amino acid
RSDNCPYVLKAEHIGXLGVLGASEAAPILEALSRNNWNLTYILNTHHHDDHIGGNAELKAKYGAKVIGSAVDKDRIPGIDILLKDSDKWMFAGHEVRVIDTPGHTQAHVSFYFPGSATVFTGDLIHTLSCATRPGGTPXXLLSSLQKIVSLPDDTNIYCGRENTAGNIKFALSIEPKNETLHSYATRVAHLRSQGLPSIPTTVKVEKACNPFLRTSSKEIRRSLSIPDSANEAEXALRCIHRARDRF

SEQ ID NO: 5270 - protein, 515 aa, Aspergillus parasiticus
MEDGTQVSTLERVVKEVQAPALQTPTDEQFWSPEDPSKPNLQFLKQHFYREGRLTEDQALWIIQAGTQLLKAEPNLLEMDAPITVCGDVHGQYYDLMKLFEVGGDPSETRYLFLGDYVDRGYFSIECVLYLWSLKIWYPNTLWLLRGNHECRHLTDYFTFKLECKHKYSERIYEACIESFCSLPLAAVMNKQFLCIHGGLSPELHTLEDIKSIDRFREPPTHGLMCDLLWADPLEEFGQEKTGDYFVHNSVRGCSYFFSYPAACAFLEKNNLLSIIRAHEAQDAGYRMYRKTRTTGFPSVMTIFSAPNYLDVYNNKAAVLKYENNVMNIRQFNCTPHPYWLPNFMDVFTWSLPFVGEKITDMLIAILNTCSKEELEDDTPTTVSPTGPPSPPVPMDVESSEFKRRAIKNKILAIGRLSRVFQVLREESERVTELKTATGGRLPAGTLMLGAEGIKQAITNFEDARKVDLQNERLPPSSEEVYKRSEEERQAALERAQREADNDAGLATVARRISM

SEQ ID NO: 5271 - protein, 320 aa, Triticum aestivum
  misc_feature (54)..(54): Xaa can be any naturally occurring amino acid
  misc_feature (173)..(173): Xaa can be any naturally occurring amino acid
  misc_feature (187)..(187): Xaa can be any naturally occurring amino acid
  misc_feature (239)..(239): Xaa can be any naturally occurring amino acid
  misc_feature (294)..(294): Xaa can be any naturally occurring amino acid
PFAVPAEYHRFPLPPSSSAPAAASRGSAGGDVEEGIVITTPLKRKAPCERKRPXESTEWMITSPGFTEGVSSPHMTPISGKAARTYKSKAKGSKDGLQTPISNAGSPGTPLTPGSSRAEHSLGELTKKCISLLKQAEDGILDLNNVAEILVVKKRRIYDITNVLEGIGLLEKXLKNRIRWEGLDDSXANLDNEISILETELENLKLQEKALDNRISEMHEKVRELTEEENHQRWLYLTXEDDIKGLPCFQNETLIAIKAPHGTTLEVPDPDEAGDYVQRRYTIVIRSTMGSIDXYLVSKFEENLEELVGVTTPPRHANVA

SEQ ID NO: 5272 - protein, 547 aa, Rhodopseudomonas palustris
MSAKEVKFGVDARDRMLRGVDILANAVKVTLGPKGRNVVLDKSFGAPRITKDGVTVAKDIELDDKFENMGAQMVREVASKSADAAGDGTTTATVLAQAIVREGAKAVAAGMNPMDLKRGIDLAVEAVVADLVKNSKKVTSNDEIAQVGTISANGDAEIGKFLADAMKKVGNEGVITVEEAKSLETELDVVEGMQFDRGYISPYFVTNADKMRVEFDDAYILINEKKLSNLNELLPLLEAVVQTGKPLVIVAEDVEGEALATLVVNRLRGGLKVAAVKAPGFGDRRKAMLQDIAILTGGQAISEDLGIKMENVTLQMLGRAKKVMIDKENTTIVNGAGKKADIEARVAQIKAQIEETTSDYDREKLQERLAKLAGGVAVIRVGGATEVEVKERKDRVDDAMHATRAAVEEGIVPGGGVALLRASEQLKGLKTKNDDQKTGVEIVRRALSAPARQIAINAGEDGSVIVGKVLEKEQYAFGFDSQSGEYGDLVKKGIIDPTKVVRTAIQNAASVAALLITTEAMIAELPKKGGAGAGGMPPGGGMGGMDF

SEQ ID NO: 5273 - protein, 190 aa, Polypodium vulgare
DEHGEVLAEIRRSDLEPYLGLHYPATDIPQASRFLFMKNRVRMICDCRALPVRVIQDKELRQPLGLAGSTLRAPHGCHSQYMENMGSIASLVMAVVVNDNDEDVSNRSHHPKMRRLWGLVVCHHTTPRAVPFALRSACEFLVQVFGLQLNMELELAAQMREKRILRTQTLLCDMLLRDAPIGIVSESPNI

SEQ ID NO: 5274 - protein, 554 aa, Vibrio vulnificus
MCSVFGILDIKSDAAALRPIALEMSKKLRHRGPDWSGIYASDRAILAHERLAIVGLNSGAQPLYSPDKKLILAVNGEIYNHKEIRARYEGKYDFQTDSDCEVILALYQEMGADLLEELNGIFAFVLYDEEKDQYLIGRDHIGIIPLYQGYDEHGNYYVASEMKALVPVCKTISEFPPGSYYSSTDAGPQRYYIRDWNEYAAVQGNTSSKEELTAALEAAVKRQLMTDVPYGVLLSGGLDSSITSAVAKRYAAMRIEDDEQTEAWWPQLHSFAIGLDGAPDLKAAREVAAKIGTVHHEMTYTIQEGLDAIRDVIYHIETYDVTTIRASTPMYLMGRKIKAMGIKMVLSGEGADEIFGGYLYFHKAPNAQEFHEETVRKLLALNMFDCARANKSLAAWGVEGRVPFLDKEFIDVAMRLNPADKMCGNGKMEKHILRECFEHYLPDSIAWRQKEQFSDGVGYGWIDTLKAVAEEKVTDQQMEAAKFRFPYNTPTTKEGYVYREIFEELFPLTSAAECVPGGPSVACSSAKAIEWDESFKNCIDPSGRAVKAVHNEAY

SEQ ID NO: 5275 - protein, 122 aa, Arabidopsis thaliana
  misc_feature (68)..(68): Xaa can be any naturally occurring amino acid
  misc_feature (80)..(81): Xaa can be any naturally occurring amino acid
  misc_feature (84)..(84): Xaa can be any naturally occurring amino acid
  misc_feature (87)..(87): Xaa can be any naturally occurring amino acid
  misc_feature (94)..(94): Xaa can be any naturally occurring amino acid
  misc_feature (97)..(97): Xaa can be any naturally occurring amino acid
  misc_feature (102)..(102): Xaa can be any naturally occurring amino acid
  misc_feature (104)..(104): Xaa can be any naturally occurring amino acid
MASSMLSSTAVVTSPAQATMVAPFTGLKSSASFPVTRKANNDITSITSNGGRVSCMKVWPPIGKKKFXTLSYLPDLSDVXXAKXVDXLLRNKWXPCXEFEFXHXFFVGRETNSRIMIYAKFW

SEQ ID NO: 5276 - protein, 286 aa, Listeria monocytogenes
MILPGNETIPYIGLGVFQVTEQEFIAGAVEKAIEVGYRLFDTAAVYNNEAIVGQAIASSAVSREELFISSKVWNGDLGFDETLFAFERTLRNLKLDYLDLYLIHWPVAGKYRDSWRAMERLHDEKLIKSIGVANFKQHHLSDLLVAANEKPVLNQVETHPLLPQNDLRKYLAEQNIAHAAWSPLAKGILMQNPVITEIAKKHQASVDQVILQWHLNRNTIIFPKSITSSRIEENSRLSYFQLDAIDMEKIDRLETGKRVGPDPDDLEYFLSSIERERAYLSGENAE

SEQ ID NO: 5277 - protein, 198 aa, Glycine max
MAMLGGVRDVPSNENSVEVESLARFAVDEHNKKENALLEFARVVKAKEQVVAGTMHHLTLEIIEAGKKKLYEAKVWVKPWLNFKELQEFKPSTTITPSDLGCKKGEGASGWREVPGDDPEVQHVADHAVKSIQQRSNSLFPYELQEVVHANAEVTGEAAKYNMVLKLKRGEKEEKFKVEVHKNHEGVLHLNHMEQHHD

SEQ ID NO: 5278 - protein, 402 aa, Bordetella pertussis
MDSILSFISGGLTQATWWQIVLFTLVVTHITIVSVTVFLHRSQAHRGLDLHPAVMHFFRFWLWMTTGMVTKEWVAIHRKHHAKCEKEGDPHSPMLFGIWKVLFRGAELYREESANKETMAKFGHGTPDDWLERNIYSKHSLAGVLTMLAIDLALFGAVGLTVWAVQMAWIPFWAAGVVNGIGHYWGYRNYNSPDTSTNVFPWGIIIGGEELHNNHHAHGTSAKFSAKWYELDIGWGYISILKFFGLAKVKKVAPKLKLESGSKGIDLSTLQGVITHRYEVMARYGDLVKRAAREELSKLKSSRQQDAANCRWTTLRRVRRWLHRNEEVLQPEQRAEVDQAIAQNQSLSTLVQMRRELGRLWESSSASSEQLLHDLQAWCQRAQQSGIAGLEQFALHLRRYAA

SEQ ID NO: 5279 - protein, 190 aa, Pilularia globulifera
DEHGEVVAEIRKSDLEPYLGLHYPATDIPQASRFLFMKNRVRMICDCRAIPVKVIQDRELRQPLSLAGSTLRAPHGCHSQYMANMGSIASLVMAVIVNDNEEETSSRSQQPKMRKLWGLVVCHHTTPRAVPFPLRSACEFLMQVFGLQLNMELELSAQMREKHILRTQTLLCDMLLRDAPIGIVSESPNI

SEQ ID NO: 5280 - protein, 545 aa, Pseudomonas putida
MAAKDVKFGDSARKKMLVGVNVLADAVKATLGPKGRNVVLAKSFGAPTITKDGVSVAKEIELKDAFENMGAQLVKEVASKANDAAGDGTTTATVLAQSIVNEGLKAVAAGMNPMDLKRGIDKATAAVVAELKNLSKPCADSKAIAQVGTISANSDSSIGEIIAEAMEKVGKEGVITVEEGSGLENELSVVEGMQFDRGYLSPYFVNKPDTMVAELEGPLLLLVDKKISTSRAAASTERASAGRPLLIVAEDVEGEALATLVVNNMRGIVKVAAVKAPGFGDRRKAMLQDIAVLTGGQVISEEIGVSLETATLEHLGNAKRVILSKENTTIIDGAGADTEIEARVKQIRAQIEETSSDYDREKLQERLAKLAGGVAVIKVGAGTEVEMKEKKARVEDALHATRAAVEEGVVPGGGVALVRALNAIVDLKGDNEDQNVGIALLRRAVESPLRQITANAGDEPSVVANKVKQGSGNFGYNAATGEYGDMIEMGILDPAKVTRSALQAAASIGGLMITTEAMIADAPSDAPAGGGMPDMGGMGGMGGMM

SEQ ID NO: 5281 - protein, 283 aa, Listeria monocytogenes
MKTVKLNNGVEVPILGFGTYQITDAAEAEHAVKDAIKAGYRHIDTAQSYMNEEAVGRGIAASGVDRKELFITTKIWVENVSYKGVMSSFDRSLKRLGLDYVDLLLIHQPFNDVYGAWIAMEELQASGKIRAIGVSNFSPDRVIDLAAFNEVTPQVNQIEVNPFQQQTANLAILRKEGVAIEAWAPFAEGKNDIFNNPVLTKIGAKYGKSAAQVILRWLVEQDIIVLAKSVKPERMAQNLAIFDFELTEADKEEIAGLDQGESQFFSHADPEMVKWMASRKLNV

SEQ ID NO: 5282 - protein, 375 aa, Streptomyces avermitilis
MTVTTDATDRAAQILSRPVTLNGLTVPNRIVMAPMTRQFSPGGIPGEDVASYYARRAAAGVGLIVTEGTYVGHESAGQSDSIPRFHGEEQLAGWSKVADAVHAAGGTIVPQLWHIGMVRGAGEPPFADAPPVGPSGIGTEGAEVTGKAMTQQDLDDVIEAFAKAAADAERIGFDGVELHGAHGYLIDQFLWAGTNRRTDAYGGDPVARTKFAAEIVAAVRSAVSPSFPVLFRYSQWKQQAYDARLAETPEELEAILAPLAAAGVDAFHASTRRYWQPEFDGSDLNLAGWTKKITGKPAISVGSVGLNGEFLKAFQGEGSTVRGIDDLLDRLESGEFDLVAIGRALLQDPEWAAKVLAGRFSELAAYDASSLKTLH

SEQ ID NO: 5283 - protein, 505 aa, Arabidopsis thaliana
MEVLASSSLSPISFTKPNKINPNFSIQISKASKFSYARSRSNISRSNAANPGVVFVCNRFLCVIERNDQRKLSGKVMMKSSVNFRQNLSVALVRIVSVLLVSSISVVTTDSPPSWGLTEENLLFLEAWRTIDRAYIDKTFNGQSWFRYRETALRNEPMNTREETYMAIKKMVATLDDPFTRFLEPGKFKSLRSGTQGAVTGVGLSIGYPTASDGPPAGLVVISAAPGGPANRAGILPGDVIQGIDNTTTETLTIYDAAQMLQGPEGSAVELAIRSGPETRLLTLTRERVSVNPVKSRLCELPGSGSNSPKIGYIKLTTFNQNASSAVREAIETLRGNNVNAFVLDLRDNSGGSFPEGIEIAKFWLDKGVIVYICDSRGVRDIYDTDGSNAIATSEPLAVLVNKGTASASEILAGALKDNKRALVYGEPTYGKGKIQSVFELSDGSGLAVTVARYETPAHTDIDKVGVTPDHPLPKSFPKDEEAFCGCLKDPTAACYLNQGLLFSR

SEQ ID NO: 5284 - protein, 541 aa, Streptomyces avermitilis
MAKIIAFDEEARRGLERGMNQLADAVKVTLGPKGRNVVLEKKWGAPTITNDGVSIAKEIELEDPYEKIGAELVKEVAKKTDDVAGDGTTTATVLAQALVREGLRNVAAGANPMALKRGIEKAVEAVSGALLEQAKDVETKEQIASTASISAADTQIGELIAEAMDKVGKEGVITVEESQTFGLELELTEGMRFDKGYISAYFATDMERMEASLDDPYILIANSKISSVKDLLPLLEKVMQSGKPLLIIAEDVEGEALSTLVVNKIRGTFKSVAVKAPGFGDRRKAMLGDIAILTGGEVISEEVGLKLENASIDLLGRARKVVITKDETTIVDGAGSADQVAGRVNQIRAEIENSDSDYDREKLQERLAKLAGGVAVIKAGAATEVELKERKHRIEDAVRNAKAAVEEGIVAGGGVALIQASSVFEKLELTGDEATGANAVRLALEAPLKQIAVNGGLEGGVIVEKVRNLPVGHGLNAATGEYVDMIAEGIIDPAKVTRSALQNAASIAALFLTTEAVIADKPEKAAAGGAPGGMPGGDMDF

SEQ ID NO: 5285 - protein, 679 aa, Magnetospirillum magnetotacticum
MAANGETEMTRVHPDGLFAVKVKGSPAYRLRVNRHDGGTEDLDDPYRFPPVLGDLDVHLLAEGTHLRTFEKLGAQVRTVDGVGGVEFALWAPNASRVSVVGDFNGWDGRRHPMRLRHQAGVWEIFIPGLGQGCIYKYEIVASDGRLLPLKADPYGHFAEVPPKTASVVWELGRRDWADDDWMAAQKARNDRHAPVSIYEVHLGSWRRVPEDSNRPLSYLEMADQLGDYVADLGFTHVEFLPVHEHPFGGSWGYQPVGLFAPTSRYGTPDEFRTLVERLHLKGIGVIIDWVAGHFPNDPHGLHQFDGTHLYEHEDPRLGIHKDWNTLIYNYGRGEVVNYLYANALYWMEQYHVDGLRVDAVASMLYLDYSREPGEWIANRHGGNENLEAIEFLRRMNMLVYAEHPGAMTIAEESTAWPMVSRPVHLGGLGFGYKWNMGWMHDTLRYFAKDPIHRRYHHDSLTFAQLYAYHENFVLPLSHDEVVHGKGSIFGRMPGDPWQRFANLRAYYAFMWTQPGKKLLFMGSEFAQEREWNEDASLDWHLLADGRNEGVRRLIRDLNRLYRTEPALHQLDNEQAGFAWIDCLDRDNSVLTWLRKGFDPSDFLVVAGNYTPMVRESYRIGVPEPGWYRELLNTDSEWYGGANIHNGGGVQSEEVPWHGHGWSICLRLPPLATCVFKRER

SEQ ID NO: 5286 - protein, 495 aa, Leptospira interrogans
MDLIYRSIYKRRKIMSRKTLTTAGGHPVSQNQHSLTAGPRGPVLIQDTHLIEKLAHFNRERIPERVVHAKGAGAYGTLTITQDLTKYSRASIFSKKGKQTSLFLRFSTVAGEKGSADTERDPRGFAVKFYTDEGIWDLVGNNTPVFFARDPLKFPDFIHSQKRDPVTGYKNPIRMWDYWAGSPEAFHQITILFGDRGIPDGYRFMNGYGSHTFGLWNSKGERFWTKFHFKSMQGIRNLSMEKASALAGTDPDYATRDLFEAIERKEFPKWKFCVQIMPEKEATKYKFNPFDLTKVWSHKDYPLIEVGVLELNSNPKNYFEEVEQAAFSPSNMPPGIGASPDKMLQGRLFAYPDAHRYRLGIQYQQLPVNRPKNSVNVYHRDGRTRFQCDGNYDNYEPNGFEGPVQDSSYAEPPLSISGDMDRYNSHIGNDDYSQAGDLYRLMSVEERERLTSAIASTMHNLPKPLLEANLKHFHLCDPEYGEQLAAKVGLALSRV

SEQ ID NO: 5287 - protein, 494 aa, Oryza sativa
  misc_feature (181)..(181): Xaa can be any naturally occurring amino acid
  misc_feature (263)..(263): Xaa can be any naturally occurring amino acid
MDPYKHRPSSSFNGPLWSTNSGAPVWNNNNSLTVGSRGPILLEDYHLVEKLANFDRERIPERVVHARGASAKGFFEVTHDITHLTCADFLRAPGVQTPVIVRFSTVIHERGSPETLRDPRGFAIKFYTREGNWDLVGNNFPVFFIRDGMKFPDMVHSLKPNPKSHVQENWRILDFFSHHPXESLHMFTFLFDDIGIPADYRHMDGSGVNTYTLVNRAGKSHYVKFHWKPTCGVKSLLDDEAVTVGGTNHSHATQDLYDSIAAXGNFPEWKLFIQTIDPDHEDRFDFDPLDVTKTWPEDIVPLQPVGRMVLNRNIDNFFSENEQLAFCPGIIVPGIYYSDDKLLQTRIFSYSDTQRHRLGPNYLLLPPNAPKCAHHNNHYDGFMNFMHRDEEVDYFPSRYDPAKHAPRYPIPSATLTGRREKVVIAKENNFKQPGERYRSWDPARQDRFIKRWIDALSDPRLTHEIRSIWLSYWSQADRSLGQKLASRLSAKPSM

SEQ ID NO: 5288 - protein, 218 aa, Brucella melitensis
MRQLQAIIVPVTPFQQNCTILFDGETKKGVVIDPGGDLARIREAIESQGIDVEAIWITHGHIDHAAAALDLKEALGVDIIGPHRDDKFLLDNLVAAGLKYGITEGVRNVTPDQWLEEGDKVCVAGHVFDVFHCPGHAPGHVVFFNPEARFAIVGDVLFNGSVGRTDLPGGDHATLIRSITEKLLPLGDDIGFICGHGPGGRFGEERRSNPFLTDTGYA

SEQ ID NO: 5289 - protein, 563 aa, Xylella fastidiosa
MCSIFGIFNLQPSDNLQILRHQALECSQRQRHRGPDWSGVYVDVGAILVHERLAIVDPAGGAQPLLSEDGTLALAVNGEIYNHAVLKGTLQQPYAFQTHSDCEVINALYREETPTSFLNRLNGIFAFVLWDKTTGRGLIARDPMGVVPLYWGHDQDGRLRVASEMKALVEHCSDVAQFPPGHWYDTTTGTLVKYYERPWKNYSAVEGVQVSLQELREAFERAVHRQLMTDVPYGVLLSGGLDSSLVAAVAARYARHRIETNDQSEAWWPRLHSFAIGLKDSPDLSAANVAAEALNTVHHRFEYTFQEGLDVLPEVIRHIETYDVTTIRASTPMFLLARRIKAMGVKMVLSGEGSDEIFGGYLYFHKAPNAREFHEELVRKLNALYYYDCLRANKAMMAWGVEPRVPFLDREFLDVAMRMDAQHKMVDKTSNGPQRMEKGILRAAFDGYLPPSILWRQKEQFSDGVGYGWIDGLKAHAETQVSDHALATAETRFQVNPPQTKEAYYYRSIFERFFPSPAAAETVPGGKSIACSSPAAIAWDASFATMADPSGRAVSGVHQQALL

SEQ ID NO: 5290 - protein, 503 aa, Zea mays
MEGAGRDANPLSGYRIGKTLGIGSFGKVKIAEHILTGHKVAIKILNRKKIRSMDMEEKVKREIKILRLFMHPHIIRLYEVIDTPADIYVVMEYVKSGELFDYIVEKGRLHEEEARHFFQQIISGVEYCHRNMVAHRDLKPENLLLDSKYNIKIADFGLSNVMRDGHFLKTSCGSPNYAAPEVISGKLYAGPEVDVWSCGVILYALLCGTLPFDDENIPNLFKKIKGGIYTLPSHLSPSARDLIPRMLVVDPMKRITIREIREHVWFKIRLPRYLAVPPPDTAQQVKKVDEETLNDVIKMGFDKNQLIESLQNRLQNEATVAYYLLLDNRLRTTSGYLGSEFQESMDSSFSQVIAETPTSATELRQHGFSESPGSGLRQHFAAERKWALGLQSRAHPREIISEVLKALQELNVYWKKIGHYNMKCRWSPGCLESMMHNSDSFSAESAIIETDVFMEKSTPTVKFEIQLYKTRDEKYLLDLQRVSGSHLLFLDLCSAFLTQLRVL

SEQ ID NO: 5291 - protein, 156 aa, Unknown
  Fragaria x ananassa
MALSLFGNSRRSNVFDPFSLDTWDPFQGFGPLMNSSSTAGDTSAFAQTRIDWKETPEAHVFKADLPGLKKEEVKVELEEGNVLQISGERSKEQEEKNDKWHRVERSSGKFVRRFRLPDNAKVDQVKAAMENGVLTVTVPKAPEPKPQVKSIDISGA

SEQ ID NO: 5292 - protein, 351 aa, Legionella pneumophila
MVNSDLILNPYQLNEKITLKNRVIMAPMTRNMANDDFSPTRQMADYYARRADAGLIITEGTIISPDGQGYSNAPGIFTQTHIDGWKMVTEAVHERGGKIFLQIWHVGRVSHPIFLHGNLPISASETMMTGKVRRADELYYGKSRAATLEEINELIQNYALAARRAMIAGFDGIEIHGANGYLIDQFLHYHTNQRHDQYGQYPENMGRFALEVVKACINEIGGQSVGLRLSPGAYLNEIVGDERDAMVFRYVLEELNHYGIAYVHTGNFDDGIQFKELGFKTMTEFMRAHFKGTIIASGSYTLHQARKDIQNKKYDLIALGRPFIANPDLMNRIKWNADFVPYENRMLDTLF

SEQ ID NO: 5293 - protein, 508 aa, Zea mays
  misc_feature (490)..(490): Xaa can be any naturally occurring amino acid
MAFAVSGAVLGGAVRAPRLTGGGEGSLVFRHTGLFLTRGARVGCSGTHGAMRAAAAARKAVMVPEGENDGLASRADSAQFQSDELEVPDISEETTCGAGVADAQALNRVRVVPPPSDGQKIFQIDPMLQGYKYHLEYRYSLYRRIRSDIDEHEGGLEAFSRSYEKFGFNRSAEGITYREWAPGAFSAALVGDFNNWDPNADRMSKNEFGVWEIFLPNNADGTSPIPHGSRVKVRMDTPSGIKDSIPAWIKYSVQAPGEIPYDGIYYDPPEEVKYVFRHAQPKRPKSLRIYETHVGMSSPEPKINTYVNFRDEVLPRIKKLGYNAVQIMAIQEHSYYGSFGYHVTNFFAPSSRFGTPEDLKSLIDRAHELGLLVLMDVVHSHASSNTLDGLNGFDGTDTHYFHSGPRGHHWMWDSRLFNYGNWEVLRFLLSNARWWLEEYKFDGFRFDGVTSMMYTHHGLQVTFTGNFNEYFGFATYVDAEVYLMLGNDLXIHGLYPEAVTIGEEVSGM

SEQ ID NO: 5294 - protein, 496 aa, Lactobacillus acidophilus
MFYKKLDNFPKDFLWGASSAAYQIEGAANEDGKGPSIWDKYTHEKGNTYKDTNGDVAIDHYHHYKEDVELMAKMGLKAYRFSVAWSRIIPDGKGKVNPKGIEFYHNLIKDLRDHNIEPVLTMYHWDLPLNLQEKYQGWESRETIKAFRKYAQVLYREFGDEVKYWVTINEQNVFTSMGYRWGTHPPKKHDIKAMFLANHHVNIANALVVKDFHQMVPDGLIGPSFGYGPVYPKTCDPNDVLAALNAQDFNDNWWLDVYCRGKYPFFTKKQLTDLGIMPEVTAEDQKILEDPEAYPDYLGINYYHGGTVQQNRLEKQVDDQKDERKFNKVDPYLMQPKGDKAQNPEVPMFNNVENQYVDKTKWGWEIDPTGMRIALREIYEKYQLPIMITENGLGALDIVKDGKINDTYRINYLKDHVKAMKEAITDGVDLIGYCAWSFTDLLSWLNGYSKRYGFVYVDQNDNENGSLKRIPKASFSWYKQVIASDGNDENLLEHKE

SEQ ID NO: 5295 - protein, 554 aa, Shewanella oneidensis
MCSIFSILDIQSDAKELRQVALEMSKLMRHRGPDWSGIYASDKAILAHERLAIVDIEHGAQPLLTEDGSLILAVNGEIYNHKELKAQLGDKYSYQTNSDCEVILALYQEYGTEFLDKLNGIFAFVLYDKAKDAYLIGRDHMGIIPLYTGRDAAGNLYVASEMKALMPVCKTVEEFQPGQYLYSSDAAAVKYYTRDWQQYDAVKDNGASQEELREALEAAVKRQLMSDVPYGVLLSGGLDSSVISAITQTFAKRRIEDDGETGAWWPQLHSFAVGLKGAPDLIAAKKVADAIGTIHHEINFTFQEGLDAIKEVIYHLETYDVTTIRAATPMYLMARKIKAMGIKMVLSGEGADELFGGYLYFHKAPNAQAFHEELVRKLDKLHLFDCLRANKAMAAWGLEARVPFLDKEFMDVAMRINPEAKMSKDGRIEKHILRQAFEHKLPKEVAWRQKEQFSDGVGYSWIDGLKAHAAEQVDDLQLANAKFRFPYNTPETKEAYFYRCFFEEHYPLPSAAETVPGGKSVACSTPEALAWDESLRGIIDPSGRAVRSVHAASY

SEQ ID NO: 5296 - protein, 226 aa, Triticum aestivum
TTCYAEAGCPFRNSRELFTKGPAISHPLLGGANQRPSSSPFPFFPSVLPGGGGGFFKGFSGAGWRRRTSGTPRVAGGVREQDPFFPIANISRIMKKAVPANGKIAKDAKETLQECVSEFISFVTSEASDKCQKEKRKTINGDDLLWAMATLGFEEYVDPLKIYLQKYRDMEGDSKLTSKSGEGSVKKDIIGAHSGATSSNAQAMVQHGGYAQGMGYMQPQYHNGDT

SEQ ID NO: 5297 - protein, 359 aa, Arabidopsis thaliana
MTFLSYLKQWRGTAKEAFENVSIVAKFLCLLHVTDRYIISTTHVHGPSMLPTLNLTGDVILAEHLSHRFGKIGLGDVVLVRSPRDPKRMVTKRILGLEGDRLTFSADPLVGDASVSVLVPKGHVWIQGDNLYASTDSRHFGPVPYSLIEGKALLRKKSHGPDIVSETRTSISNVKIHIVGIEKAALNTRNFLKAPEKSGSETMSLIPSIFGGRRTNVFDPFSLDVFDPFEGFLTPSGLANAPAMDVAAFTNAKVDWRETPEAHVFKADLPGLRKEEVKVEVEDGNILQISGERSNENEEKNDKWHRVERSSGKFTRRFRLPENAKMEEIKASMENGVLSVTVPKVPEKKPEVKSIDISG

SEQ ID NO: 5298 - protein, 479 aa, Pyrococcus abyssi
MCLIAGGFNVSREDAIKIINLGKHRGPDSFGFWSERQMLKSDNFSDVSEIEGGEIALIQCRLAMTGSKSYTQPFYNEIILVHNGEIYNHESLRKYLIERGVAFETDVDSEVILRLLEYLVFDRKLKVEEAIKLSMKMLRGDYAVAFFFNGKFYLFRDPLGVRPLYYSSRGHFASEKKVLWGLGEDAEPVLPGEIVSISKHGITRVRGFNVFSIRTQGKDYFNGLQNLLIDSVKVRASKKVGVLFSGGVDSSLIALIASRYSDVILYTSGTEDSKDVEWARRVAEELGLKLRESLFSREDIENEIERIMFAIEEPNPMNLAIAIPLYFSTKRAREDGVKVLLSGQGADELFGGYAKYLQNPGLMLKDVEELGERNLARDDKVAMLNGVETRYPYLDLPFAILALNVPLELKIRDGKRKFILREIAKSLGLPEWVAEREKKAAQYGSNAQKILEKIAKSRGVKLKGLADILFSKVFHGIQN

SEQ ID NO: 5299 - protein, 133 aa, Brassica napus
YKFLQRTVMYHILAFGFLLYYCGGLSFLTWGMGIGVAMEHHVTCCINSLCHIWGSRTWKTNDTSRNVWWLSVFSFGESWHNNHHAFESSARQGLEWWQIDISWYIVRFLEIIGLATDVKLPSESQRRRMALVR

SEQ ID NO: 5300 - protein, 222 aa, Arabidopsis thaliana
MGQESFIYSFVARGTMILAEYTEFTGNFPSIAAQCLQKLPSSSNSKFTYNCDHHTFNFLVEDGYAYCVVAKDSLSKQISIAFLERVKADFKKRYGGGKASTAIAKSLNKEFGPVMKEHMNYIVDHAEEIEKLIKVKAQVSEVKSIMLENIDKAIDRGENLTVLTDKTENLRSQAQEYKKQGTQVRRKLWYQNMKIKLVVLGILLLLVLIIWISVCHGFNCTD

SEQ ID NO: 5301 - protein, 193 aa, Glycine max
  misc_feature (43)..(43): Xaa can be any naturally occurring amino acid
  misc_feature (71)..(71): Xaa can be any naturally occurring amino acid
  misc_feature (79)..(79): Xaa can be any naturally occurring amino acid
MVRGRVELKRIENKINRQVTFAKRRNGLLKKAYELSVLCDAEXVALIIFSNRGKLYEFCSSSSMLKTLERXQKCSYGAXEVSKPAKELETLREYLKLKARFESLQRTQRNLLGEDLAPLNIKELEHLERQLDSSLKQVRSTKTQFMLDQLSDLQTKMLVEANRSLTVKLEEINSRNHYMFKHNKVGTGGGKGV

SEQ ID NO: 5302 - protein, 705 aa, Sinorhizobium meliloti
MAKKPSAPNNTKPATIHDQKATRGNGGELHQIAEGDTPVLTTAQGGPVADDQNSLRAGERGPTLIEDFHFREKIFHFDHERIPERVVHARGYGVHGFFETYESLAAYTRADLFQRPGERTPAFVRFSTVAGSKGSFDLARDVRGFAVKIYTKEGNWDLVGNNIPVFFIQDAIKFPDVIHSVKPEPDREFPQAQSAHDNFWDFISLTPESMHMIMWVMSDRAIPRSFRFMEGFGVHTFRFVNAKDESTFVKFHWKPKLGLQSVVWNEAVKINGADPDFHRRDMWQAIQSGNFPEWDLHVQLFDQDFADKFDFDILDPTKIIPEEVLPTKPVGRLVLDRMPENFFAETEQVAFMTQNVPPGIDFSDDPLLQGRNFSYLDTQLKRLGSPNFTHLPINAPKCPFQHFQQDGHMAMRNPVGRVNYQPNSWGEGPRESPMKGFRHFPSEEQGPKLRIRAESFADHYSQARQFFISQTPPEQRHIADALTFELSKVETPVIRERMVAHLLNIDETLGKKVGHALGLETMPKPADAAVATRQDLDPSPALSIIQRGPKRFEGRKLGILATDGADGALLDALIAAVEKEKAAFELIAPKVGGFTASDGKRIAAHQMLDGGPSVLYDAVVLLPSAEAVTDLIDVATARDFVADAFAHCKYIGYAGAAVPLLERAGIAELLDEGTIELTDAASAAAFLTEIGKLRVWGREPSVKLK

SEQ ID NO: 5303 - protein, 621 aa, Magnetospirillum magnetotacticum
MCGIAGLSAARPEILDEMVRRLAHRGPDGHGTFVCERTGFGLAHARLAVIDLTEGGRQPMHSPCGRWTIAFNGEIYNHAELRLELEGRGHTFRSSSDTEVLLALLAEKGEAALERLVGMFALALLDRADGSVLLARDRVGIKPLVWAGLPGGGLAFASEIKALKAVPGVDLSLDREALSQFLACLYVPAPYSIHAGIRKLAPGHLLRWKPGAAPEIACWWRPAFTAERALSVDDATEELMPALRDAVRSCMVADVPVGCFLSGGIDSSVIAALMAEARREQGASAPASFTMTFDEAAYDERVAARAVSDHVGTLHTELPASARLVDGLERMIAAFGEPFGNPTALLIGDLSAKARQHVTVALVGDGGDEVFGGYPRYQGGLLAAKWRKIPAFLRNGLIEPIVALLPESTSGRHTWRRIREFVAGAGLSDAEMYASWVEYFDPAQRRALLGGGTPPRPVADIYRATGRVHPLDAMQETDLLSFLPGNLMAYGDAMSMMHALELRLPLLDHRLIERVQAISAATRFQAGKKTLLKAAARRLLPAEIVDRPKLGFNPPMGLWLKNELAPMVAERLIPARMADLGLEWKGVEALLAEHRAGRRDLSLPVWALLVLERWQGLEASA

SEQ ID NO: 5304 - protein, 252 aa, Sinapis arvensis
ENQLCFDLLESWLIQNPDAAGFKRDGQSIFRELALFQDYHSLSSFKNALAVFMSENRQNRVSFDSNNLVLTAGATSANETLMFCLANPGDAFLLPTPYYPGFDRDLKWRTGVEIVPIQCSSSNGFRITKLALEEAYEQAKKLNLNVKGVLITNPSNPLGTTTTQTELNILFEFISKNKNIHLVSDEIYSGTAFSSSEFISVMEILKNNQLENTDVFNRVHIVYSLSKDLGLPGFRVGAMYSNDKDVISAATK

SEQ ID NO: 5305 - protein, 199 aa, Triticum aestivum
LQASGANAGYWTTNSGAPVWNNNNALTAGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDIGIPLNYRHMDSF

SEQ ID NO: 5306 - protein, 474 aa, Lactobacillus casei
MSKQLPQDFVMGGATAAYQVEGATKEDGKGRVLWDDFLDKQGRFKPDPAADFYHRYDEDLALAEKYGHQVIRVSIAWSRIFPDGAGEVEPRGVAFYHKLFADCAAHHIEPFVTLHHFDTPERLHEAGDWLSQEMLDDFVAYAKFCFEEFSEVKYWITINEPTSMAVQQYTTGTFPPAESGRFDKTFQAEHNQMVAHARIVNLYKSMQLGGQIGIVHALQTVYPYSDSAVDHHAAELQDALENRLYLDGTLAGEYHQETLALVKEILDANHQPMFQSTPQEMKAIDEAAHQLDFVGVNNYFSKWLRAYHGKSETIHNGDGTKGSSVARLQGVGEEKLPDGIETTDWDWSIYPRGMYDILMRIHNDYPLVPVTYVTENGIGLKESLPENATPDTVIEDPKRIDYVKKYLSAMADAIHDGANVKGYFIWSLQDQFSWTNGYSKRYGLFFVDFPTQNRYIKQSAEWFKSVSETHIIPD

SEQ ID NO: 5307 - protein, 1130 aa, Gloeobacter violaceus
MIAKFKSQRKGSIARRLLLTLGSLLLVFLLVFGFNYGLVFNQVENLRQSYRLSRELNINVYRMQEGMTDQETGVRGFLLARQEEFLAPFYQGRVQYLRSLEEARRVVQLITVRIEDPQMRSQMLSALDAAGQAAESWYEFVRAGEIESLRRGDVAAALDLGRSRQGKERFDRFRQAAAEVRRRNDLLFAQLEARISERQNQSEILSIGLLAMAGLLAGAISLGLVRSLRRPFAALEAAAVALGEGNFQTRVPAEVIENDDELAVLARSFNQTAERLGRQNLELRERDILGSLRVLDAVIVEEIDLDCLCGRLLESLGELTGSQLGALYLLEGERLLLQSSLGLSAPAPAIRLGEGMVGLAASRCAPVVLQSPPTGEPLSLETPAGALQPRSLSAWPLLSKQQLVGVLFVAGLEPLAPMARNLLESVSSQLAVALLNSRSVRAVEEARARLEATFEQMSDGVSIADARGNPQLINPAGLRILGLPADQDLTDSDWQNRFEVFTLEGEPLEAQEVPVRRAVRFGTTVRADLQIRIRQGRSVLLSVSASPLKDGRGNIYGVVAVFRDVTVERERERRLVQQARELEALNTELAATNEELEAQQSELEAINAELEQQRLQIESQNQELVEADRQKNNFLASMSHELRTPLNAIIGFSQLLLRNKNLQEQPQVLLQLDRVYQNGKIQLRLVNDILDLAKIKAGKVELRYQPVALEPFVREVYAALESLALQKNLSVRIAVDPSIGSVETDPQQLRTILINLLSNAFKYTERGEVEVRARRPAADRFELEVRDTGVGIDPDQQQKVFDEFSRLEGAATRQASGTGLGLAICKRLVTLMGGEISLVSTPGVGSTFTVRLPCGPAVIPAGRSAGEPPKVLFIEHDLQVQQLVATRLAERSYRLLFAPDSIEGIQIAKAERPDAIVLDPTLPRTDLWGVLFELRTDPTTAGIPILLQSIAGERGLAIPLGLADFLTRPVGQESLLAVLKRRRVAPEGDAILIVDDSADNREYLAACLRDEGYRVQPAASGHEALAYLESHRPQLVILDLMMPQMDGFEVLRRLRRMPGGRQLPVLILSAMDLTEQQRQTLLAEQTEQILKKGDQNIDELLSLLDDTLRRQLETARAAGAERLTPDTRSL

SEQ ID NO: 5308 - protein, 83 aa, Citrus maxima
MSLIPSIFGGRRTNVFDPFSLDVWDPFDGFLSSALTNAPSSARETSQFANARIDWKADLVHVFKADLPGLRKEEVKVEVEECR

SEQ ID NO: 5309 - protein, 344 aa, Triticum aestivum
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPPKGKIYSVNEGNAKNWDTPTAKYVEKCKYPTDGSSPKSLRYIGSMVADVHRTLLYGGIFLYPADKKSPSGKLRVMYEVFPMSFLMEEAGGQSFTGKGRSLDLIPTDIHERSPIFLGSSDDVEEIKALYAEEAKKAGSA

SEQ ID NO: 5310 - protein, 514 aa, Glycine max
MDRSTGRGGGGSVDMFLRNYKLGKTLGIGSFGKVKIAEHVRTGHKVAIKILNRHKIKNMEMEEKVRREIKILRLFMHHHIIRLYEVVETPTDIYVVMEYVKSGELFDYIVEKGRLQEDEARHFFQQIISGVEYCHRNMVVHRDLKPENLLLDSKFNIKIADFGLSNIMRDGHFLKTSCGSPNYAAPEVISGKLYAGPEVDVWSCGVILYALLCGTLPFDDENIPNLFKKIKGGIYTLPSHLSPGARDLIPRMLVVDPMKRMTIPEIRQHPWFQVHLPRYLAVPPPDTLQQAKKIDEEILQEVVNMGFDRNQLVESLSNRIQNEGTVTYYLLLDNRFRVSSGYLGAEFQETMDSGFNRMHSGEVASPVVGHHSTGYMDYQGVGMRQQFPVERKWALGLQSRAQPREIMTEVLKALQELNVCLEEDWTLYHECRWVAGTAGHHEMINNSLHSNHYFGNDSGIIENEAVSKSNVVKFEVQLYKTREEKYLLDLQRVQGPQFLFLDLCAAFLSQLRVL

SEQ ID NO: 5311 - protein, 556 aa, Arabidopsis thaliana
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDGSKHYFFFDQT

SEQ ID NO: 5312 - protein, 397 aa, Puelia ciliata
TGYDRVMVYRFHDDEHGEVVAESRHADLEPYLGLHYPATDIPQASRFLFRQNRVRMIADCHAAPVRVIQDPALPQPLCLVGSTLRAPHGCHAQYMANMGSIASLVMAVIITSGGDDEHNMARGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEAQIKDIIEWLTLCHGDSTGLSTDSLADAGYHGAAALGDAVCGMAVAYITPSDYLFWFRSHTAREIKWGGAKHRPEDKDDGQRMHPRSSFKAFLEVVKSRSLPWEHAEMDAIHSLQLILRDSFRDAAEGTSNSKAIVNGQVQLGELELRGIDELSSVAREMVRLIET

SEQ ID NO: 5313 - protein, 393 aa, Sesleria insularis
EPARTEDPALSIAGAVQSQKLAVRAISRLQALPGGDVKLLCDTVVEHVRELTGYDRVMVYKFHDDEHGEVLAESRRADLEPYLGLHYPATDIPQASRFLFRQNRVRMIADCHAAPVRVIQDPAMPQPLCLVGSTLRSPHGCHAQYMANMGSIASLVMAVIISSGGEDNMSRGGAVPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGITPTGAQIKDIIEWLKVCHGDSTGLSTDSLADAGYPGATALGDAVCGMAVAYITPSDYLFWFRSHTAKEIKWGGAKHHPEDKDDGQRMHPRSSFKAFLEVVKSRSLPWENAEMDAIH

SEQ ID NO: 5314 - protein, 382 aa, Sorghum halepense
EPARTEDPALSIAGAVQSQKLAVRAISRLQALPGGDIKLLCDTVVEHVRELTGYDRVMVYRFHEDEHGEVVAESRRDNLEPYLGLHYPATDIPQASRFLFRQNRVRMIADCHATPVRVIQDPGMSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSL

SEQ ID NO: 5315 - protein, 393 aa, Sporobolus giganteus
EPARTEDPALSVAGAVQSQKLAVRAISRLQALPGGDVKLLCDTVVEHVRELTGYDRVMVYRFHEDEHGEVVAESRRDDLEPYLGLHYPATDIPQASRFLFRQNRVRMIADCHATPVRVIQDPGLSQPLCLVGSTLRAPHGCHAQYMANMGSIASLVMAMIIIVVVMTKQTSRSGISSAMKLWGLVVCHHTSPRFIPFPLRYACEFLMQAFGLQLNMELQLAHQLSEKHILRTQTLLCDLLLRDSPTGIVTQSPSIMDLVKCDGAALYYHGKYYPLGVTPTESQIKDIIEWLTVCHGDSTGLSTDSLADAGYHGAAALGDAVCGMAVAYITPSDYLFWFRSHTAKEIKWGGAKPHPEDKDDGQRMHPRSSFKAFLEVVKSRSLPWENAEMDAIH

SEQ ID NO: 5316 - protein, 682 aa, Salmonella enterica
MNTFFRLTALAGLLALAGQSFAVEDITRADQIPVLKEETQHATVSERVTSRFTRSHYRQFDLDEAFSAKIFDRYLNLLDYSHNVLLASDVEQFAKKKTVLGDELRTGKLDVFYDLYNLAQKRRFERYQYALKVLERPMDFTGNDTFNLDRSKAPWPKDEAELNALWDGKVKFDELSLKLTGKSDKEIRETLTRRYKFAIRRLAQTNSEDVFSLAMTAFAREIDPHTNYLSPRNTEQFNTEMSLSLEGIGAVLQMDDDYTVINSLVAGGPAAKSKSISVGDRIVGVGQAGKPMVDVIGWRLDDVVALIKGPKGSKVRLEILPAGKGTKTRIITLTRERIRLEDRAVKMSVKTIGKEKVGVLDIPGFYVGLTDDVKVQLQKLEKQNVNSIVINLRSNGGGALTEAVSLSGLFIPSGPIVQVRDNNGKVREDSDTDGVVYYKGPLVVLVDRFSASASEIFAAAMQDYGRALIVGEPTFGKGTVQQYRSLNRIYDQMLRPEWPALGSVQYTIQKFYRVNGGSTQRKGVTPDIIMPTGNEETETGEKFEDNALPWDSIDAAKYVKSDDLAPFGPELLKEHNARIAKDPEFQYIMKDIARFNAMKDKRNIVSLNYAQREKENNEEDALRLARINDRFKREGKPLLKKLDDLPKDYQEPDPYLDETVKIALDLAHLEKEKPAEQAATDK

SEQ ID NO: 5317 - protein, 394 aa, Streptochaeta angustifolia
EPASTEDPALSIAGAVQSQKLAVRAISRLQALPGGDVKLLCDTVVEHVRELSGYDRVMVYRFHDDEHGEVVAENRRADLEPYLGLHYPAMDIPQASRFLFRQNRVRMIADCHAAPVRVIQDPSLKQPLCLVGSTLRAPHECHAQYMANMGSIASLVMAVIISSGGDDENSVGRSGISSATKLWGLVVCHHTSPRCIPFPLRYACEFLMQAFGLQLNMELQLAHQLSEKHILRTQTLLCDMLLRDSPTGIVMQSPSIMDLVKCDGAALYYHRKYYPLGITPTEAQIKDIIDWLAMCHGDSTGLSTDSLADAGYPGAAALGDAVCGMAVAYITPNDYLFWFRSHTAKEIKWGGAKHHPEDKDDGQRMHPRSSFKAFLEVVKSRSLPWENAEMDAIH

SEQ ID NO: 5318 - protein, 397 aa, Streptogyna americana
TGYDRVMVYRFHDDEHGEVVAESRRADLEPYLGLHYPATDIPQASRFLFRQNRVRMIADCHAAPVKVIQDPALPQPLCLVGSTLRAPHGCHAQYMANMGSIASLVMAVIISSGGDDEHNMMRGGIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEAQIKDIIEWLTLCHGDSTGLSTDSLADAGYPSAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAIVNGQVQLGELELRGIDELSSVAREMVRLIET

SEQ ID NO: 5319 - protein, 396 aa, Thysanolaena maxima
  misc_feature (393)..(393): Xaa can be any naturally occurring amino acid
TGYDRVMVYRFHEDEHGEVVAESRRDGLEPYLGLHYPATDIPQASRFLFRQNRVRMIVDCHATAVRVIQDPGLSQPLCLVGSTLRAPHGCHAQYMANMGSIASLVMAVIISSGGDDEQTMRGGISSAMKLWGLVVCHHTSPRFIPFPLRYACEFLMQAFGLQLNMELQLAHQLSEKHILRTQTLLCDMLLRDSPTGIVTQSPSIMDLVKCDGAALYYHGRYYPLGVTPTEFQIKDIIEWLTACHGDSTGLSTDSLADAGYHGAAALGDAVCGMAVAYITPSDYLFWFRSHTAKEIKWGGAKHHPEDKDDGQRMNPRSSFKAFLEVVKSRSLPWENAEMDAIHSLQLILRDSFRDSAEGTSNSKAIVNGQVQLGELELRGINELSSVAREMVRXIET

SEQ ID NO: 5320 - protein, 341 aa, Spinacia oleracea
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSSNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIGSMVADVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 5321 - protein, 394 aa, Zizania aquatica
EPARTEDPALSIAGAVQSQKLAVRAISRLQALPGGDVKLLCETVVEHVRELTGYDRVMVYRFHEDEHGEVVAESRRNDLEPYLGLHYPSTDIPQASRFLFRQNRVRMIADCHSAPVRVIQDPALPQPLCLVGSTLRAPHGCHAQYMANMGSIASLVMAVIISSAGDDEHNMARGGIPSAMKLWGLVVCHHTSPRCIPFPLRYACEFLMQAFGLQLNMELQLAHQLSEKHILRTQTLLCDMLLRDSPTGIVTQSPSIMDLVKCDGAALFYHGKYCRLGVTPTEAQIKDIIEWLTVCHGDSTGLSTDSLADAGYPGAATLGDAVSGMAVAYITPSDYLFWFRSHTAKEIKWGGAKHHPEDKDDGQRMHPRSSFQAFLEVVKSKSLPWENAEMDAIH

SEQ ID NO: 5322 - protein, 461 aa, Serratia marcescens
MEYQFADGFWWGSATSAPQSEGAAARDGKSRNIFDYWYEIAPERFHERVGPTEASTFYDHFRTDIGLLKTLGHNTFRTSISWSRLIPDGDGEVNPQAVAFYNAMIDVQLAQGITPFINLYHFDMPLCMQQRGGWESRAVVEAYARYADTCFGLFGDRVTHWFTFNEPIVPVEAGYLNDLHYPCVVDFKRAVTVAYHSVLAHAMAVQRFRARRLPGSIGIILNLSPTYPRSDAPEDRQAAHDADLLLNRSFLDPVAKGRYPAALLHLLERHGLMPYCEPQDAQLIEGGVVDILGVNYYQPRRVQAKAGRRAEGPIASPEDLFSYYAMPGRKINPHRGWEIYEKGLYDILMDLKENYGNLPCYISENGMGVEGEEAFIRADGRVEDDYRIDFIREHLKSLHRALAERSQCKRYHLWTFIDCWSWLNAYKNRYALVRLDRADQRRTIKKSGYWFAEAARRNGFD

SEQ ID NO: 5323 - protein, 326 aa, Aspergillus fumigatus
MAEFVRAQIFGTTFEITSRYTDLQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIQTICSENKRIRAGEALAHEYLSPYHDPTDEPEAEEKFDWSFNDADLPVDTWKIMMYSEILDFHNIDQGNDAGQVLMEGGVAQAQQNYA

SEQ ID NO: 5324 - protein, 471 aa, Nocardia farcinica
MPLSHPSFPQDPGPSEVAVNPVFTREPVSVPRDRLPAGELDADIAYQVVHDELMLDGNARLNLATFVTTWMEPSARVLMAECFDKNMIDKDEYPRTADLEQRCVRMLADLWHAADPAHATGCSTTGSSEACMLAGLALKRRWQHRRRAAGLSTERPNLVMGANVQVCWEKFADYWDVEARLVPMAGDRFHLTAEAALPHCDENTIGVVAVLGSTFDGSYEPVAEICAALDELERQRGWDIPVHVDGASGAMVAPFCDPDLVWDFRLPRVASVNTSGHKYGLVYPGVGWVVWRDAAALPEDLIFRVNYLGGQMPTFALNFSRPGAQVVAQYYTFLRLGRSGYTRVQQYCRDVATRLADRIAALGAFRLLTDGRQLPVFAFTLAEGETGYSVFDVSAALREQGWLVPAYTFPADREDLAVLRIVVRNGFSHDLADMLLDALAAVLPRLRAQDRPQHGPDTATFAHGAQAPSGH

SEQ ID NO: 5325 - protein, 253 aa, Idiomarina loihiensis
MRVHAIEAFDDNYIWAIETNDKDKVIIVDPGEAQPVQQWLEQNSKSIETILVTHHHYDHTGGIAELIEQSPCPVIGPENPEIKTLTKTVTEGDELTVGGIQWQVLTTPGHTLDHISFYTPGFLFCGDTLFSGGCGRMFEGTPEQFTQSLLKLRKLPGETRVFCAHEYTQANVNFALKVEPENAVLQSYAEKVRMLREQEQITLPSTLQLELAINPFLRFDQKSVIAAANKHAESVKNSPEDVFYTIRQWKDNA

SEQ ID NO: 5326 - protein, 542 aa, Lactococcus lactis
MSKDIKFSSDARTAMMRGIDILADTVKTTLGPKGRNVVLEKSYGSPLITNDGVTIAKEIELEDHFENMGAKLVSEVASKTNDIAGDGTTTATVLTQAIVREGLKNVTAGANPVGIRRGIELAAETAVASIKEMAIPVHDKSAIAQVATVSSRSEKVGEYISDAMERVGSDGVITIEESKGMQTELDVVEGMQFDRGYLSQYMVSNTEKMVAELDNPYILITDKKISNIQEILPLLEQILKTNRPLLIVADDVDGEALPTLVLNKIKGVFNVVAVKAPGFGDRRKAQLEDLAILTGGTVITEELGLDLKDATLEALGQAAKATVDKDHTTIVEGAGSADAISDRVAIIKAQIEKTTSDFDREKLQERLAKLAGGVAVVKVGAATETELKAMKLLIEDALNATRAAVEEGIVSGGGTALVNAIAALDKLSEEGDIQTGINIVRRALEEPVRQIAANAGYEGSVIIDKLRSEEVGTGFNAATGQWVNMIEEGIVDPAKVTRSALQNAASVAGLILTTEAVVANKPEPAAPAMPPMDPSMGMGGMM

SEQ ID NO: 5327 - protein, 496 aa, Arabidopsis thaliana
MASTVSVQPGRIRILKKGSWQPSDQTVGPVVYWMFRDQRLKDNWALIHAVDLANRTNAPVAVVFNLFDQFLDAKARQLGFMLKGLRQLHHQIDSLQIPFFLLQGDAKETIPNFLTECGASHLVTDFSPLREIRRCKDEVVKRTSDSLAIHEVDAHNVVPMWAASSKLEYSARTIRGKINKLLPDYLIEFPKLEPPKKKWTGMMDKKLVDWDSLIDKVVREGAEVPEIEWCVPGEDAGIEVLMGNKDGFLTKRLKNYSTDRNNPIKPKALSGLSPYLHFGQVSAQRCALEARKVRSTSPQAVDIFLEELIVRRELSDNFCYYQPHYDSLKGAWEWARKSLMDHASDKREHIYSLEQLEKGLTADPLWNASQLEMLYQGKMHGFMRMYWAKKILEWTKGPEEALSISIYLNNKYEIDGRDPSGYVGCMWSICGVHDQGWKERPVFGKIRYMNYAGCKRKFNVDSYISYVKSLVSVTKKKRKAEEQLTRDSVDPKITIV

SEQ ID NO: 5328 - protein, 397 aa, Rickettsia conorii
MLSKLNKPALFALIFYPIFIISLVVKYSFDYGIGLTEVIFIIASYYINNITVGIGLHRLWSHNAYKINKYAEFVLIMLSAGTLQGPALSWASNHYKHHRYTDQDQDPHTPLKFDNKFLGFMWSHIGWMLVGSGSYKSIDRITWAKHGKNNLLKWQLKYYWQIAAFMNIVVPLFIGYLVGGTMQSAYAGFLFMGLGRFLQQQATFCVNSLCHFAGSKKYYKGTAGDIWWMALFLLGENWHNYHHAFPSDYRNGAKWYHLDVHKWIIFLMSKIGLASELERTTKVRIQAKMQETLNYLSEKQKQKLTLMQTKIDHLLENLCLKIKELEESSITIKEQFKKSFVEIQESLKNLAEQVSAATQITEKSSEKLLKIVNKKIIDAEQSIYKLYNQLNTLKVSH

SEQ ID NO: 5329 - protein, 615 aa, Cytophaga hutchinsonii
MCGITGFISIKWGSDELHSMTRRLQHRGPDAEGFYINESVHLGHRRLSILDLSVAANQPFFSKDKRYVMVFNGEVFNYKELAVKYAIPTDTTSDTEVILELFALQGPAAFQEFNGMFAIAIWDTYEKKLTLLRDRFGIKPVCYYDGPDGFGFASEIKSLLELPIPRLINSEALADYLFLEYIPKPNTIFQNIKKLTNGCYLEVTDGVRVAVKAFYDIREKYDPKPLKEKEGLEEFHHLLSDAVKSRMISDVPIGAFLSGGVDSSLVVSKFQENSTLPVETFTIGFDEKQYDESAYAKKVSELLKTNHHEYRLPAEDVFSVLKDAIEFYDEPFAVSSVLPSLLISKVSRQHTTVALTGDGADELFMGYNTYYWYNRIETLKRIGGKASLKLAGNIFKMFGGKPAIKSRLFEGWADKHPYINLWSQEQQMFTQQEIGKLLNYRYTHETTIPYWESLEKISLNNEQAVSFFDIQHYLADDLMYKMDIASMRHGLEVRCPFLDYNLVEFAVNLPLELKINNGTQKYILKKALEKYIPQSLIYRTKWGFSAPSEEWLKRSHTYLIDHYLDPARISAQGIFNAQEIQKLIASFRSGHYYHGKRLWSLVIFQLWYEQYMVAK

SEQ ID NO: 5330 - protein, 208 aa, Zea mays
MEVEACYNYGFLPADRGRHQPPPPPHATLPHAAEDAGELWEYFPCPFCYIEVEVPFICNHLQEEHCFDTRNAVCPICANNLGKDMAAHFRLQHTHLLKRRKPYRPSSCPAAATSPATYQVNSYYEEAEPQQHYSRPYKDPAPDPLLSQFICSVDAVPGDDNAQKDDQRLKLNNKGATASDDDASSKLGLEERLQRIDFLTEILMSTIL

SEQ ID NO: 5331 - protein, 226 aa, Vitis vinifera
VTIFHWDLPQTLEDKYNGWLDPQIIKDFALYAETCFQQFGDRVKHWITFNEPHTFTVQGYDIGLQAPGRCSIPLFLFCRAGNSATEPYIVAHHALLSHATVADIHHKKYKAKQQGSLGVAFDVIWFEPKTNSTEDIEATQRAQDFQLGWFIDPLMYGDYPKSLKDGVGSRLPNFTRDESALLKGSLDFVGINHYTTFYAEYDANNLTGMLLNDSLADNGTILHLAE

SEQ ID NO: 5332 - protein, 300 aa, Arabidopsis thaliana
MCDPTRDDGSSRSRVVSTMQKRAYFQRQWPLVDVVRASVVVIVHFLCLLAPFNFKWEALRFGLVLFALTTLSITFSFHRNLSHRSFKIPKWLEYPWAYSAVFALQGDPMDWVSIHRFHHQFTDSDRDPHSPKEGLLFSHILWIFDTQYIKYKCGGRDNVLDLKKQWFYKFLRRTIAVHILMFWTILYLYGGLPYLTCGGGVGIFIGYHVTWLVNSACHIWGSRSWNTKDTSRNVWWLSLFTMGESWHNNHHAFESSARQGLEWWQIDITWYLIRLFEVLGIATDVKLPSELQKQKMALVR

SEQ ID NO: 5333 - protein, 321 aa, Mucor mucedo
MSTDYLTLNRTGDKMPIRGFGCWKIDTKDCEETVYQAIKTGYRLFDGACDYGNEVEVGRGINKAINEGLVKREDLFIVTKLWNTFHSKKHVRALFDRQLKDTGLEYFDLYLIHFPVPLQYVDPATVYPPGWYVGDAKSLQFEQSPIHECWAELEKIVDAGLARNIGVANFNCQAILDLLTYARIKPAVLQIELHPYLPQERLVKWVKEQGIQITAYSSFGPTSYVDLTESGKTYTSLLEHASVKSVADKHNVSTGQVLLRWALDREFAVIPKSVNAGRMKANLEILDIKLDAEDNKTLDSLKTNQRFNDPMTYGFGLPLFD

SEQ ID NO: 5334 - protein, 364 aa, Agrobacterium tumefaciens
MTDKTLFEPYALGAISLSNRIVMAPLTRNRAGAGFVPGDLTAEYYTQRASAGLIISEATQISQQGQGYQDTPGIYTRAQIDGWRKVTAAVHEKGGRIVLQLWHVGRISHIDLQPNGGQPVAPSAIRAATKTFVNNAFVDVSEPRALEIEELAGIVNDFRKAAANAIDAGFDGVEIHGANGYLLEQFAKDGANVRTDAYGGSVENRARLMLEVTAAVAQEIGPARTGIRISPVSPANGISCSDAQAQYDYIVDQLDALGVAYIHVVEGATGGPRDVAPFDYGSLRRRFSKTYIANNGYDLELAATHIAEGKADLIAFGRPFIANPDLVKRLQSGAPLAEIDPATIYGGGAEGYTDYPRFNEASGS

SEQ ID NO: 5335 - protein, 419 aa, Zea mays
  misc_feature (230)..(230): Xaa can be any naturally occurring amino acid
  misc_feature (237)..(237): Xaa can be any naturally occurring amino acid
  misc_feature (253)..(253): Xaa can be any naturally occurring amino acid
MDPYKHRPTSGANSGYWTTNSGAPVWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTXVGVKCLXLDDEAVTVGGTCHTHXATKDLTDSIAAGNYPEWKLFIQTIDADHEDKFDFDPLDVTKTWPEDIIPLQPVGRMVLNKNIDNFFAENEQLAFCPAITVPGIHYSDDKLLQTRIFSYADTQRHRLGPNYLMLPVNAPKCAHHNNHHDGLMNFMHRDEEVNYFPSRFDPTRHAEQYPIPPRVLSGC

SEQ ID NO: 5336 - protein, 1315 aa, Botryotinia fuckeliana
MEDSTIAHTTAILQTLALSSIDLPLTNVYGNKGIRLPGADTAEKLALERELAALVSRVQRLEARAITVNNQTLPDTPNELGAPSAFADVLTGAPSRASKSTTSRQQLVNSLLAAREAPTGGERPPKFTKLSDEELEALREHVDHQSKQLDSQKSELAGVHAQLFEQKQRQEQALNVLEVERVAALERELKKHQQANEAFQKALREIGEIVTAVARGDLSKKVQIHSVEMDPEITTFKRVINTMMDQLQIFSSEVSRVAREVGTEGILGGQAKISGVDGTWKELTDNVNVMAQNLTDQVREIASVTTAVAHGDLTQKIERPAQGEILQLQQTINTMVDQLRTFAAEVTRVARDVGTEGILGGQAEIEGVQGMWNTLIVNVNAMANNLTTQVRDIAIVTTAVAKGDLTQKVQAECKGEIKQLKETINSMVDQLQQFAREVTKIAREVGTEGRLGGQATVHDVEGTWRDLTENVNGMAMNLTTQVREIAKVTTAVARGDLTKKIEVEVQGEIASLKDTINTMVDRLSTFAFEVSKVAREVGTDGTLGGQAQVDNVEGKWKDLTENVNTMARNLTTQVRGISTVTQAIANGDMSQKIEVAAAGEILILKETINNMVDRLSIFSNEVQRVAKDVGVDGKMGGQADVAGIGGRWKEITTDVNTMANNLTTQVRAFGDITNAATDGDFTKLITVEASGEMDELKRKINQMVYNLRDSIQRNTLAREAAEFANRTKSEFLANMSHEIRTPMNGIIGMTQLTLDTDLTQYQREMLNIVHNLANSLLTIIDDILDLSKIEANRMIMEEIPYTLRGTVFNALKTLAVKANEKFLDLTYRVDSSVPDHVVGDSFRLRQVILNLVGNAIKFTEHGEVSLTIQKAEQDHCAPNEYAVEFCVSDTGIGIQADKLNLIFDTFQQADGSMTRKFGGTGLGLSISKRLVNLMRGDVWVKSQYGKGSSFYFTCTVRLATSDISFIQKQLKPYQGHNVLFIDKGQTGHGKEIITMLTQLGLVPVVVDSEQHTILLGNGRTKEKIASTYDVIVVDSIESARKLRSIDEFKYIPIVLLAPVIHVSLKSALDLGITSYMTTPCLTIDLGNGMIPALENRAAPSLADNTKSFDILLAEDNIVNQRLAVKILEKYHHVVTVVGNGQEALDAIKEKRYDVILMDVQMPIMGGFEATAKIREYERSLGTQRTPIIALTAHAMLGDREKCIQAQMDEYLSKPLKQNHLIQTILKCATLGGALLEKGREVRQSANEESPNSQNGPRGAQHPASSPTPAHMRPAIEPRAYTTTGPINHGSAESPSLVTADAEDPLARLLMRAHSS

SEQ ID NO: 5337 - protein, 844 aa, Zea mays
MASFAVSGARLGVVRPGGSARSGGERRSAVDLPSVLFRRKDAFSRTVLSCAGAPGKVLVPGGGSDDLLSSAEPVVDTQPEELQIPEAELTVEKTSSSPTQTTSAVAEASSGVEAEERPELSEVIGVGGTGGTKIDGAGIKAKAPLVEEKPRVIPPPGDGQRIYEIDPMLEGFRGHLDYRYSEYKRLRAAIDQHEGGLDAFSRGYEKLGFTRSAEGITYREWAPGAYSAALVGDFNNWNPNADAMARNEYGVWEIFLPNNADGSPAIPHGSRVKIRMDTPSGVKDSIPAWIKFSVQAPGEIPYNGIYYDPPEEEKYVFKHPQPKRPKSLRIYESHVGMSSPEPKINTYANFRDEVLPRIKKLGYNAVQIMAIQEHSYYASFGYHVTNFFAPSSRFGTPEDLKSLIDKAHELGLLVLMDIVHSHSSNNTLDGLNGFDGTDTHYFHGGPRGHHWMWDSRLFNYGSWEVLRFLLSNARWWLEEYKFDGFRFDGVTSMMYTHHGLQVTFTGNYGEYFGFATDVDAVVYLMLVNDLIRGLYPEAVSIGEDVSGMPTFCIPVQDGGVGFDYRLHMAVPDKWIELLKQSDEYWEMGDIVHTLTNRRWLEKCVTYCESHDQALVGDKTIAFWLMDKDMYDFMALDRPSTPRIDRGIALHKMIRLVTMGLGGEGYLNFMGNEFGHPEWIDFPRGPQSLPNGSVIPGNNNSFDKCRRRFDLGDADYLRYRGMQEFDQAMQHLEGKYEFMTSDHSYVSRKHEEDKVIIFERGDLVFVFNFHWSNSYFDYRVGCFKPGKYKIVLDSDDGLFGGFSRLDHDAEYFTADWPHDNRPCSFSVYAPSRTAVVYAPAGAEDE

SEQ ID NO: 5338 - protein, 487 aa, Arabidopsis thaliana
MGSKLKLYPLLNHSSVFHPDSRYQSAPTMEEEQQQLRVLFAKYEMGRLLGKGTFGKVYYGKEITTGESVAIKIINKDQVKREGMMEQIKREISIMRLVRHPNIVELKEVMATKTKIFFIMEYVKGGELFSKIVKGKLKEDSARKYFQQLISAVDFCHSRGVSHRDLKPENLLVDENGDLKVSDFGLSALPEQILQDGLLHTQCGTPAYVAPEVLRKKGYDGAKGDIWSCGIILYVLLAGFLPFQDENLMKMYRKIFKSEFEYPPWFSPESKRLISKLLVVDPNKRISIPAIMRTPWFRKNINSPIEFKIDELEIQNVEDETPTTTATTATTTTPVSPKFFNAFEFISSMSSGFDLSSLFESKRKLRSMFTSRWSASEIMGKLEGIGKEMNMKVKRTKDFKVKLFGKTEGRKGQIAVTAEVFEVAPEVAVVELCKSAGDTLEYNRLYEEHVRPALEEIVWSWHGDNHNNNIVKSNGNYVSDENSGSDC

SEQ ID NO: 5339 - protein, 531 aa, Zea mays
MDPYKHRPSSAFNAPYWTTNSGAPVWNNDSSLTVGARGPILLEDYHLVEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRPTCGVRSLMDDEAVAVGGANHSHATKDLTDAIAAGNFPEWTLYIQTMDPEMEDRLDDLDPLDVTKTWPEDAFPLQPVGRLVLNRNIDNFFAENEQLAFCPGLIVPGIYYSDDKLLQTRIFSYSDTQRHRLGPNYLLLPANAPKCAHHNNHYDGSMNFMHRHEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSITLVEDRTRPKQHRHCIHGYCAEAELLVSVECLAGFPSE

SEQ ID NO: 5340 - protein, 497 aa, Leifsonia xyli
MSENHTTTQTGTPVASDAHSLTAGQDGATALHDRYLVEKLAQFNRERIPERIVHAKGGGAFGTFAVTGDVTAYTKAAVFQPGAKTETVQRFSSVAGEQGSPDTWRDVRGFSVKFYTSEGNYDIVGNNTPVFFIRDGMKFPDFIHSQKRLPGSGLRDADMQWDFWTLSPESAHQVTYLMGDRGLPRSWRTMPGYGSHTYQWINAAGERFWVKYHFHALHGNEEMHGAEAEKIAGEDADYYRRDLYEAIERGDFPAWKLSVQVMPYEDAKTYRLNPFDLTKVWPHSDYPLIEVGVHTLNRNPENFFAQIEQAAFSPANTVPGIDISPDKMLTARVFSYPDAQRYRVGTNYNELPVNAPVAPVHNYSQDGAARHGFKAAEAPVYAPNSFGGPVADPALAGEGSWESDGALVRAAATLHAEDDDFGQAGSLYRDVFDAKAKERFLDTIAGAVGGVQRDDIRERAIQYWTSVDAGLGGLLRTRLASGVTDADEAAEFVGVAG

SEQ ID NO: 5341 - protein, 349 aa, Vicia faba
MDMPPPIMHDSDRYDFVRDIGSGNFGVARLMTDKLTKDLVAVKYIERGDKIDENVKREIINHRSLRHPNIVRFKEVILTPTHLAIVMEYASGGEMSDRISKAGRFTEDEARFFFQQLISGVSYCHSMQVCHRDLKLENTLLDGDPALHLKICDFGYSKSSVLHSQPKSTVGTPAYIAPEVLLKQEYDGKIADVWSCGVTLYVMLVGSYPFEDPDNPKDFRKTIQRVLSVQYSVPDFVQISPECRDIISRIFVFDPAERITIPEIMKNEWFRKNLPADLVNENIMDNQFEEPDQPMQSMDTIMQIISEATVPAAGSYYFDEFIEVDEDMDEIDSDYELDVDSSGEIVYAI

SEQ ID NO: 5342 - protein, 471 aa, Escherichia coli
MKAFPETFLWGGATAANQVEGAWQEDGKGISTSDLQPHGVMGKMEPRILGKENIKDVAIDFYHRYPEDIALFAEMGFTCLRISIAWARIFPQGDEVEPNEAGLAFYDRLFDEMAQAGIKPLVTLSHYEMPYGLVKNYGGWANRAVIGHFEHYARTVFTRYQHKVALWLTFNEINMSLHAPFTGVGLAEESGEAEVYQAIHHQLVASARAVKACHSLLPEAKIGNMLLGGLVYPLTCQPQDMLQAMEENRRWMFFGDVQARGQYPGYMQRFFRDHNITIEMTESDAEDLKHTVDFISFSYYMTGCVSHDESINKNAQGNILNMIPNPHLKSSEWGWQIDPVGLRVLLNTLWDRYQKPLFIVENGLGAKDSVEADGSIQDDYRIAYLNDHLVQVNEAIADGVDIMGYTSWGPIDLVSASHSQMSKRYGFIYVDRDDNGEGSLTRTRKKSFRMVCAEVIKTRGLSLKKITIKAP

SEQ ID NO: 5343 - protein, 240 aa, Zea mays
FIRHHRTATEEGGMAAAGGGPRRTTRVGPYELGKTVGEGSFAKVKIAKDTRNAATCAIKVLDRNHVLRHKMVEQIKREIATMKLIRHPNVVQLHEVMASKSKIYMVLEFVEGGELFDKIVNSGKLGEDEARRYFHQLINAVDYCHSRGVYHRDLKPENLLLDSYGALKVSDFGLSAFSPQTKEDGLLHTACGTPNYVAPEVLADKGYDGMAADVWSCGIILFVLMAGYLPFDDPNLMDSV

SEQ ID NO: 5344 - protein, 536 aa, Methanosarcina mazei
MASKQIMFDESARKALLSGVDKVANTVKITLGPKGRYVVLDKSTKPVVTNDGVTIAKEIELHDKFENMGAKLVKEVASKTQDNTGDGTTTATLLAQSMIREGLKNISAGANPIEVKKGIEIATEKVVGYLKGKSVEVKGKDKIIQVATISANNDEEIGNLIADAMERVGYNGVITVEDSKTMETSLDVVEGMQFDRGFVSPYMALDTEKMVCEFEDPYILITDKKINSMKQIVPVLEKVASEGRSLLIIAEDVDGDAQAALILNIIRGALRVCAVKAPGFGNERKEMLEDIAVLTGGQVISEEKGMKLEEFSDYMLGNARKVTVDNHKTIIVEGRGDKADIDERVRVIEAQINIAEADYRKTELKKRMAKLGGGVAVIKVGAATETELKEKKMRIDDALNATKAAVEEGVVTGGGISLFRAAATLDSLDLDGDRQIGVKIVQRAIEDPVRQIAANAGREGAEVVAAIKAESSEHFGYNAKTDVFEDLFEAGVIDPTKVVRSGLQNAASIAGMVLTTEALVTDFDEEKDERTAAIII

SEQ ID NO: 5345 - protein, 550 aa, Buchnera aphidicola
MAAKDVKFGNEARVKMLRGVNVLADAVKVTLGPKGRNVVLDKSFGAPSITKDGVSVAREIELEDKFENMGAQMVKEVASKANDAAGDGTTTATLLAQAIVNEGLKAVAAGMNPMDLKRGIDKAVISAVEELRIMSVPCADSKAITQVGTISANADEKVGSLIADAMDKVGKDGVITVEEGTGLQDELEVVKGMQFDRGYLSPYFINKPETGIVELENPYILMADKKISNVRELLPILEAVAKSGKPLLIISEDLEGEALATLVVNSMRGIVKVAAVKAPGFGDRRKAMLQDISILTSGSVISEELAMELEKSTLEDLGQAKRVVINKDTTTIIGGIGEKYNIQSRISQIRQQIQEATSDYDKEKLNERLAKLSGGVAVLKVGAATEVEMKEKKARVEDALHATRAAVEEGVVPGGGVALVRVAAKISNIVGQNEDQNVGIRVALRAMEAPLRQIVSNSGEEPSVVTNNVKDGKGNYGYNAATDEYGDMISFGILDPTKVTRSALQYASSVAGLMITTECMVTDLPKDEKSDLGNSSAPSAGGMGGMGGMM

SEQ ID NO: 5346 - protein, 323 aa, Dechloromonas aromatica
MLALAALIPHATMAADPTPDASQVVAAVEGVFGVTPGERRNHIKGTCAAGEFVGTKEAAKLSRSPLFSGKPVPVVARFSLSGGNPKAPDVAKSARGMALQFQLPKGQLHHITMLNTPMFGAANPQTFLDLMQALQPDPATGKPDPEKMKAFKASHPDNQAQAQYLASNNPPASYASSSYWGIHTFKFVDKKGKATLVRWQFVPQDGEKRLSDDELKTAGANFLESALIERAKQGAVRWDMMVSIGQPGDSETDPTVLWPAERPRIKAGTLTIRSAEAQKGAPCEPINFDPLVMAPGIQPTDDPVLRFRSPAYAVSFGKRLSER

SEQ ID NO: 5347 - protein, 465 aa, Haloarcula marismortui
MRLHWHRRDLRATDNAGLAAATPSDPVVPVFIFDTAVLDHAGPPRVAFMLDALDSLREWYRDKGSDLVVAEGDPTSVLPELAAQHGAEKVTWGKDYSGLARERDAAVRQALDDADVAREAVQNAVLHEPGEITTNDGDPYSVFTYFGRKWHDREKAAPYDPPSADTLADVDGDALPTLADLGFEEPEADVPAAGTEEARALLDDFLDENVYEYEERRDFPADECTSRLSAHLKFGTIGIREVYDRTQAAKEGTGGDRRDSVREFQSQLAWREFYTQVLFAHPHVVSSNYKSYENPIEWENDEELLQAWKDGDTGYPIVDAGMRQLRDEAYMHNRVRMIVASFLTKDLLIDWRHGYEWFREKLVDHDTANDNGGWQWAASTGTDAQPYFRIFNPMTQGEDYDPNAEYIKEYVPELRDAAPEIIHDWNDCSLTQRRSAAPEYPDPVVDHSERREEALAMFERARGDD

SEQ ID NO: 5348 - protein, 611 aa, Pyrococcus abyssi
MCGINGFSWGDEELVKRMNDAIRHRGPDDEGVYVDDNVSLGHVRLAIIDLSPKGHQPMKYEKDGKEVWIVYNGEIYNFMEIRKELEEKGYTFTSNTDTEVILAAYLEWGFDCVERFNGMWAFVIYDKSKNILFLSRDRFGIKPLYYYYDGKNIIFSSEIKGILQHNIPRKPNDAVIFDFLYYNLLDHTEDTFFEGIKRLMPGYNAVFDLNTRKFEAWKYYDLRERIEKRKEISDPQGFKDLFLRAVKMRLVADVPVGSCLSGGLDSSSIVCAMRHLLPDGEIKVFSLVFPGKEIDESKYQRIVVDECRVSWYRTTFNVEDVLADIIDLIRTQEEPFSTLSIYGQYRVMKLARENGMKVLLDGQGSDEILAGYHYFFGYYFVELLRKFKWGKLLREILAYKRIHGSLVPLKNMVLYILPVWVTKRLWRRRFPYLREEFIEKFKKRPSKELIWKIKTLNEALLLAETYYSLPHLLRFEDKNAMRWSIESRVPFCDHELVEYVLSLPPESKVSAGITKVLLRKGLKGILPDEIRNRASKVGFATPDKDILKTNEGQKFALAVIDSESFKKRPYWDYRKVLRMFEEHVSGKKNWSQELWKVIIMELWLREWMDNG

SEQ ID NO: 5349 - protein, 725 aa, Methylobacillus flagellatus
MLTKSKQDPHLNHILNARHHDPFSYLGLHQDGTQYILRLFQPFAARAWLQTASGWVPLQRSHEAGLFEWKGNTPPPVPCRIRLEENGHSWETYDAYTFWTTLSPEELYLFGEGRLKQAYRTFGAHLCEQQGVAGVRFVVWAPNAERVSVIGNFNHWDGRMHQMRVHGSSGVWEIFIPGLTSSDLYKFEIRNRQTGQILVKTDPYGFSFEQRPGTAARVTAHGHYAWQDAEWLEDRARADWLHAPFNCYEVHLGSWRRDAHGEFLGYRELAHQLVPYMQEMGYTHIELLPVSEHPLNESWGYQTTGYFAPTNRFGSPDDLRYFVDQCHQAGIGVILDWVPGHFPKDDWALARFDGSALFEHEDPRLGEHQDWGTYIFNYGRNEVRNFLLASAHYWLEEFHMDGLRVDAVASMLYLDYSRKEGEWLPNRHGGRENLEAIDFLKQLNVMVHEDFPGALTIAEESTSWPMVSRPVYLGGLGFSMKWNMGWMNDTLSYMQHDPIHRRFHHDKLTFGQIYAYSENFVLPFSHDEVVHGKRSLLDKMPGDTWQKFANLRLLATYQMTASGKKLNFMGNELAQGREWNVNSSLDWHLLDLHWHQGIQRLHRDLSHLYRQVPALHELDFDAHGFEWIDCSDSDQSIINYLRRARDGSFVLVLLNFTPVLRSGYRVGTPLAGHYREIFNSDAGYYGGSNQGNGNGLQTEAYPWMGHSHSLVVTIPPLGGVIIQPG

SEQ ID NO: 5350 - protein, 155 aa, Brassica napus
  misc_feature (140)..(140): Xaa can be any naturally occurring amino acid
NTITQRVGEPNNVGDLEKQPFYQFLKNTYIWHPVALAAALYAMGGFPFIVWGMGVRIVWVYHITWLVNSACHVWGNQAWNTGDLSKNNWWVAALAFGEGWHNNHHAFEFSARHGLEWWQFDMTWYVVRFLQAIGLATEVXLPSEAQKQRMGLTSD

SEQ ID NO: 5351 - protein, 98 aa, Arachis hypogaea
MAAVGAPREVAGNENSLEIDSLARFAVDEHNKKQNGLLEFKRVISAKQQVVAGTLHHITLEAASGDSKNVYEAKVWEKPWMNFKEVQEFKLAGDGSNA

SEQ ID NO: 5352 - protein, 246 aa, Unknown
  Malus x domestica
QMKSESYISLLIASFFVLLLPAFSSAAEESSTPIGCGHTSHRNMATLGGVHESHGAQNSAEVEDLARFAVQEHNNKENALLEFVSVVKAKEQVVAGTLHHLTIEAIEAGKKKLYQAKVWVKPWMGFKEVQEFKHADEEETPSVTSSDLGVKQGGHPPGWQSVPPHDPQVQDAANHAVKSLQQRSNSLLPYELQEVVHAQAEVAEEHAKFNMLLKVKRGSKEEKFKAEVHKNMEGTFSLNQMEADHS

SEQ ID NO: 5353 - protein, 268 aa, Candida albicans
MYLRSIFKSTIRKMHIESIPMRWGHGDNYAYLVVDTPTKQAWLIDSAQADEVLEYFKKHKTDFNLKAIVNTHHHYDHSDGNPFFHKKYPDLPIIAGKDSPLVTYTPSDKETLELGEDLTITALHTPCHTQDSICYFVQDKKTNEKAVFTGDTLFISGCGRFFEGTGKEMNYSLNQVLAKLPKETKVYPGHEYTKSNVKFSQTVLSNEAIKELAEYCKSHEHTTGKFTIGDELQFNPFMKLTDPQVINSTGLTSPDEIMDKLRTMKNNM

SEQ ID NO: 5354 - protein, 537 aa, Exophiala dermatitidis
MDGPLHKAVVNKKPVPEIDFTLHIMEDGTQVSTQERVCKDVQAPAMQRPTDDQFWSPIDRSKPNLPFLKQHFYREGRLTEEQALWIIHEGTKILRSEPNLLEMDAPITVCGDVHGQYFDLMKLFEVGGDPAETRYLFLGDYVDRGYFSIECVLYLWSLKIWYPNTLWLLRGNHECRHLTDYFTFKLECKHKYSERIYDACMESFCALPLAAVMNKQFLCIHGGLSPELHTLEDIKSIDRFREPPTHGLMCDILWADPLEEFGQEKTGEYFVHNHVRGCSYFFSYPAACNFLEKNNLLSIIRAHEAQDAGYRMYRKTRTTGFPSVMTIFSAPNYLDVYNNKAAVLKYENNVMNIRQFNCTPHPYWLPNFMDVFTWSLPFVGEKITDMLIAILNTCSKEELEEDTRTSSAEPETPPFAPDAETTEAKRRAIKNKILAIGRLSRVFQVLREESQRVTELKTQAGGRLPAGTLMLGAEGIKQAIHNFEDARKVDLQNERLPPSPEEIEKRSAEDRKAALERAATEAENDTTLQGVARRISL

SEQ ID NO: 5355 - protein, 428 aa, Desulfovibrio vulgaris
MRVTLWVVSLGLCAAVAFSGGAVFATTEESKYDALKRFSQVLDIVERYYVRDVPRKDLMNGAVKGMLQGLDPHSTFLSPEEFKEMQETTSGEFFGIGIEISSENGQLTVVSPIEDTPAFKAGLKAGDLILAVDGQPTQEMSTQEAVSRIRGPKGSEVELLILHREAKAPSTVKIVRDAIPLVSVKSKQLEQGYVWVRLTRFSERTTSDLLEALREANKRGPVKGVVLDLRNNPGGLLDQAVSVSDVFLRDGGIVSIRGRGDDTGREYNAKAQSTDVTAPMVVLINAGSASASEIVAGALRDQKRALLVGERSFGKGSVQNVIPLSDGAGLKLTVALYYTPNGRSIQAEGIDPDIEIPFEAPREDDAKPMQRFNMLREKDLSRHLENGAGGKQGKNDQSDEVRDLLERDNQLRMALQFVKRLPALKEIR

SEQ ID NO: 5356 - protein, 551 aa, Haemophilus influenzae
MAAKDVKFGNDARVKMLKGVNVLADAVKVTLGPKGRNVILDKSFGAPTITKDGVSVAREIELEDKFENMGAQMVKEVASKANDAAGDGTTTATVLAQAIVNEGLKAVAAGMNPMDLKRGIDKAVSAVVSELKNLSKPCETAKEIEQVGTISANSDSIVGQLISQAMEKVGKEGVITVEDGTGLEDELDVVEGMQFDRGYLSPYFINKPETATVELDNPYLLLVDKKISNIRELLPVLEGVAKAGKPLLIIAEDVEGEALATLVVNTMRGIVKVAAVKAPGFGDRRKAMLQDIAILTAGTVISEEIGMELEKATLEDLGQAKRVVINKDNTTIIDGIGDEAQIKGRVAQIRQQIEESTSDYDKEKLQERVAKLAGGVAVIKVGAATEVEMKEKKDRVDDALHATRAAVEEGIVAGGGVALVRAAAKVAASLKGDNEEQNVGIKLALRAMEAPLRQIVTNAGEEASVVASAVKNGEGNFGYNAGTEQYGDMIEMGILDPTKVTRSALQFAASVAGLMITTECMVTDLPKDDKADLGAAGMGGMGGMGGMGGMM

SEQ ID NO: 5357 - protein, 600 aa, Dunaliella salina
  misc_feature (276)..(276): Xaa can be any naturally occurring amino acid
MLRCAQPKYAPLKRQAFNQKLNRLVAAARTPSKSSSTSRMASTSSGQQGRSILWFRKGLRLHDNPALRDACTGSAAVFPIFIIDPYFLQKSNNKVGVNRYQFLLESLSDLNSSLTSLGSQLLVLRGTPEEVIPRVLRDWSIKKLCYEIDTEPYAKARDARVDDMAREAGVEVKKHWSHTLYDTDMLVRENKGKAPLTMQAFEKLVDRVGHPLTALPAPTARLPPVDVSLPGIKDAEVGVPTWQEMGFKEAPTAIFKGGETEALKRLEHYMKDTKWXASFEKPSTDPSAFTEPSTTALSPYLKFGCLSARFFHQRLLDVYRLHPKHSQPPMSLRGQLLWREFFYTLGSHTPNFDRIAGNPICRQITWDTNPALLKAWRDGATGYPWIDAAMTQLREWGWMHHLARHSVACFLTRGDLYLSWESGKEVFEELLLDADYFINAANWMWLSASAFFAQYFRVYSPVVFGKKYDKEGAYIRKFLPVLKDMPAKYIYEPWTAPKEVQQRANCIIGRDYPAPIVDHAVASKECIARMGAAYKATNTGGSAGKASPAKAASSGDAGTSASAGAPSSSKKTTGKRAASADQGGKRQKTLEESMTKKRCQ

SEQ ID NO: 5358 - protein, 1049 aa, Unknown
  Polaromonas sp. JS666
MSTSTPSSGSPVKILIVEDSPTQAQQLQHILEQEGYEVGIARNGRLALKMLPQFRPALIISDVIMPEMDGYELSRRIKTQPDLRNIPVILVTTMSDPQDVIRGLECGADNFVLKPYDERYMLARVRYVLVNREMHREQDMGLGVEIYFNDQRHFITADRLQILNLLLSTYDAAIQRNKDLTQTQESLGQRSAEVAAVNRFLDSVIETIPDMIFVKDAADLRFVRFNRAGEELLGYSRDELVGKNDYDLFPEAEADAFTSKDQEVLTRGMVLDIPEEPIHTRNKGDRILHTKKIPIFDSKGRPLYLLGISRDVTEKKKLEDALRKRNEELSKSQEDLQWSNSELNKLRLALEARVNQRTQQLTAVVEALRESEARTRLTIDTALDAVVAMDAHGLVREWNAQAETIFGWKRDEAIGKPLAGLVIPRQHREGHARGLERFLATNEGPILSQRLELTALHREGREFPVELSITPMLLQGEWTFSAFLRDITDRKQMEERTLNLNRELEQRVAQRTTELVAAREAADTANRAKSTFLATMSHEIRTPMNGMFGMLELLGLTELDTDQRATLAIVRESSQSLLCIIDDILDFSKIEAGKLTVRPEVASIKDVIEHVRNMYAGNASGRGLLLKHGTDPQISPALMFDPLRLGQILNNLVSNALKFTSRGSIEIKAELIARTNGEDQVRFVVTDTGMGVSAEDQQRLFQPFTQGGGDTARWAGGTGLGLTICRRLAGMMNGTVEMVSELGKGTTMILTLSLPIADPKELAKIRRAQMQDSARTTHTARRDAPTVARAETEGTLVLLVDDHPVNRMLLMRQVHVLGYAAESAKNGVEALAKWQSRRFGIVITDCNMPEMNGYDLARSIRGLESGNEGKHVPIIACTANALSGEAESCFAAGMDDYLVKPVELSQLREKLDQWLPIPDATVMPEATSGTSSKHMAATAAAVPVDRSVIAEFSGGDASTERHIFTEFRSANDEDAAMLKRAVAASDGVQITRTTHRMLGASRMIGARDFARVCESIEHASRTSDWAAVEAHMSAFQHELQRLNAYLDAL

SEQ ID NO: 5359 - protein, 547 aa, Magnetospirillum gryphiswaldense
MAAKEVKFSTEARAKMLRGVDILADAVKVTLGPKGRNVVIEKSFGAPRITKDGVSVAKEIELSDKFENMGAQMVREVASKTADLVGDGTTTATVLAQAIVREGNKAVAAGMNPMDLKRGIDLAVEAVVADVKSRAKKVSTNEEIAQVGTISANGERDIGAKIAEAMSKVGNEGVITVEEAKGFETELDVVEGMQFDRGYSSPYFVTNAEKMTCELDSPYILLFEKKLSGLQPLLPVLEAVVQSGRPLLIIAEDVEGEALATLVVNKLRGGLKVSAVKAPGFGDRRKAMLEDIAILTGGQVISEDLGIKLESVTLEMLGTAKRVTITKEDTTIVDGAGARGDIEARCKQIRAQIEETTSDYDREKLQERLAKLAGGVAVIKVGGATEVEVKERKDRVDDALHATRAAVEEGIVPGGGTALLYSVRALDGIAVANNDQKVGIDIVRRALQSPVRQIAENAGHDGAVVAGKLLEATDTNFGFDAQTGTYVDMIKAGIIDPVKVVRTALQDAASVAGLLITTEAMIAEKPKKDSGPSMPGGGMGGMGDMDF

SEQ ID NO: 5360 - protein, 439 aa, Thiomicrospira crunogena
MFFGAILGAMAVVGTTVWAEGDNADAGTETTKEVSVPLEELRAFVEVFDRISTDYVEPIEDKKLLEGAIDGMLSSLDPHSAYLPPKNYKRMEEHTTGQFGGLGMEVGMEDGFVKVVSPIDDTPAQKAGVKAGDLIIKLDEHPVKGKSLAEAVKIMRGKPGSKITLTIVRDGVDKPIVMVLTRAIIKVKSVKEQLLKDGMGYVRISQFQLRTGEDLIKSIKALEKKNKKPLNGLVLDLRNNPGGVLRAAVQVSDAFLNDGLIVYTKGRVKNSEMRFEAEEGDVLNGKPIVVLINEGSASASEIVSGALQDQKRALIAGRTSFGKGSVQTLIPLNNGGAIKVTTARYFTPSGRSIQAEGIVPDIKIDQVKIEKLKAADFTRIKEKDLSGHLDNEDDKIQAEKVVQKADKALEELLANDYELHEALSLLKGMYFTQQMRGHE

SEQ ID NO: 5361 - protein, 555 aa, Sulfolobus solfataricus
MDLSKLLEPIRIGDIVLKNRIAMSPMISNLGTPEGYPSDAHIAYLAERAKGGVGLIITEYTYVNHVDARGSVNELGMDSDELTPKFMRLTELIHALGSKIFVQLVHVGRKTRKDIIWGNKPIAPSPIPIMDEVREMTKEDIERVKNDFIDASIRAKRAGFDGIELHGAHGYLLAQFLSPATNKRNDEYKDGVRFIEEILKGIKEKAKITVGIRISVTEFDNEGLTPEIVAEIGKKLEKAGIDYIHLSAGRDGPLGSSMPYYYKRLAFLEEAKVVRDAVNIPIFLVGSVITPVDAIKAREIADVVVLGRQLLADPYWLEKAKRDLPIRPCIRCNQTCRGVVYKEVRCDVNPELGWELLPPLEKGKGEVIVVGGGVMGLEAARVLALRGFTVTLYEQNNKLGGQFLLYKDPWKVKEFQELINYYERELKRLNVEVKLNSKIECSDCIMAIPDYEIPKMPDVKGEKLLIDSNLYVYHDYAFELAKYNEIYITERSFKGLDRTREYLLRKELSEVGVKFLEEKNSMKFDVEIHNIADDQPSIGKAIQRGYWLGRTFKSY

SEQ ID NO: 5362 - protein, 154 aa, Oryza sativa
MSMIRRSNVFDPFSLDLWDPFDGFPFGSGSGSLFPRANSDAAAFAGARIDWKETPEAHVFKADVPGLKKEEVKVEVEDGNVLQISGERIKEQEEKTDKWHRVERSSGKFLRRFRLPEDTKPEQIKASMENGVLTVTVPKEEPKKPDVKSIQITG

SEQ ID NO: 5363 - protein, 556 aa, Cicer arietinum
MGCQGSKEKNKPTPDFTARHHGSSATAASASGVATNNHQYHSVQPSSTHVQTPPPKPDSNPKPTVTTQNVKTVHKTDTTILGKPFDDIKKHYTLGQELGRGQFGITYFCTENSTGNTYACKSILKRKLVSKSDREDIKREIQILQHLSGQPNIVEFKGAYEDRFSVHLVMELCAGGELFDRIIAQGHYSERAAASICRAVVNVVHICHFMGVLHRDLKPENFLLSSKDEGATLKATDFGLSVFIEEGKVYRDMVGSAYYVAPEVLRRSYGKEIDIWSAGIILYILLSGVPPFWAETEKGIFNAILEGELDFASEPWPSISDSAKDLVRKMLNHDPKKRITSAQVLEHPWMREGGEASDKPIDSAVLSRMKQFRAMNKLKKLALKIIAENLSEEEIKGLKAMFANMDTDNSGTITYEELKTGLARIGSRLSETEVKQLMELADVDGNGSIDYLEFISATMHRHRLERDEHLYKAFQYFDKDNSGHITREELETAMTQHGMGDEATIKDIISEVDTDHDGRINYEEFCAMMRSGMPPPGTTIINLQSEFDFICSCNSL

SEQ ID NO: 5364 - protein, 237 aa, Glycine max
EAQEGSSQKKMGRGKIEIKRIENTIFMQVTFCKRRNGLLKKAYELSVLCDAEVALVVFSTRGRLYEYANNSVRATIERYKKANAAASNAESVSEANTQFYQQESSKLRRQIRDIQNLNRHILGEALGSLSLKELKNLEGRLEKGLSRVRSRKHETLFADVEFMQKREIELQNHNNYLRAKIAEHERAQQQQSNMMSGTLCESLPSQSYDRNFFPVNLIASDDQQQYSSQDHTALQLV

SEQ ID NO: 5365 - protein, 97 aa, Glycine max
MAALGGIRDVAGTQTSLEVDGLARFAVEEPHKNQIPLLEFEKVVSPKHQVVFGTLSPPPLEAKNGGQKKVYEPKVWEKAWFNFKEGQKFKLVGEAPP

SEQ ID NO: 5366 - protein, 469 aa, Bacillus anthracis
MVVAFLIGAGGMFAGMSLFGVNPAEVTQTISSGNASTAQGNLAKINEAYALIDSRYVEDVKDEKLVEGAIQGMLSTLKDPYSTYMDKETAKQFSESLDPELEGIGAEVNKTDGKLIIVSPIKGSPAEKIGIKPNDQILSVDGNSVKDLSREEAVLKIRGKKGTTVAIEIKRAGVADPIVFKIKREKIPIFTVFSSVKQESGKDIGYMQITSFAENTAKEFKDQLKELEKKNIKGLVIDVRGNPGGYLNSVEEILGEIMTDKKPMLQVEQRNGEKKKFSTELKERKPYPISVLIDNGSASASEILAGALKEGEGYDLIGEKTFGKGTVQQAVPFKDGSNIKLTMFKWLTPDGNWIHKKGIKPTVEVKQPDYYHATPIQIEKTLSYNANDVQVKHAQEMLKSLGYVPGREDGYFSKETESALKAFQNANKMEATGQLDKKTAEAIQTKIIEKIRSGENDLQLQSALKLMAK

SEQ ID NO: 5367 - protein, 480 aa, Desulfovibrio vulgaris
MTKHKLTTNAGAPVPDNQNAMTAGPRGPMLLQDVWFLEKLAHFDREVIPERRMHAKGSGAYGTFTVTHDITSYTKAALFSKIGKKTDLFVRFSTVAGERGAATAERDIRGFAIKFYTEQGNWDLVGNNTPVFFLRDPLKFPDLNHAVKRDPRTNMRSAKNNWDFWTSLPEALHQVTVVMSDRGIPASYRHMHGFGSHTFSFISPDNQRYWVKFHLRTQQGIKNLTDAEAEAIVARDRESHQRDLYDSIERGDFPRWTNYVQVMPEKDAEKLPYHPFDLTKVWFHKDCPLIEVGVLELNRNPENYFAEVEQAAFNPANVVPGISFSPDKMLQGRLFSYGDAHRYRLGVNHHLIPVNAARCPVHSYHRDGAMRVDGNHGSTLAYEPNSYGEWQEQPDFAEPPLAIRGDAAHWNFREDDADYYDQPGRLFRLMTPQQQDELFQNTARAMGDAPEEIKRRHVGNCAKADPAYGAGVARALGLKM

SEQ ID NO: 5368 - protein, 157 aa, Brassica rapa
MSLIPSFFGGRRTNVFDPFSLDLYDPFEGFLTPSGMTNATSKDVAAFTNAKVDWRETPEAHVFKADLPGLKKEEVKVEVEDGNILQISGERSSENEEKSDRWHRVERSSGKFMRRFKLPENAKVDEVKASMENGVLSVTVPKMAERKPEVKSIDISG

SEQ ID NO: 5369 - protein, 477 aa, Unknown
  Synechococcus sp. WH 8102
MTTPRVLFWHRRDLRLTDNLGLAAAAAISPAVTGVYVLDPQVISPSEHLLPMAPARLWFLIESLIELQQRWRDAGSRLLVVEGDPVQLLPQLAERIAAEAVVWNRDVEPYARERDRQVAQRLQADGRKVVVDWDQLLIAPELLKTGGGDPYRVYGPFLRNWRGQVQAKQPVTVPAPAGLVDLDPAAVPSGEPLMARRDSHGFKGTELCPCRPGEAAAMQQLTSFCDGALFGYEPDRNFPGVVGTSYLSAALSVGTLSPRQAWSAAQEAREQARSEEQLHAIAVWEQELCWREFYQQALFHFPELSDGPYREQWRRFPWENNEDWFDFWREGQTGMPIIDAAMRQLNQTGWMHNRCRMIVASYLVKDLICDWRWGERAFMELEVDGDLAANNGGWQWSASSGMDPKPLRIFNPATQASKFDAAGDYIRQWVPELRHVNTKDLLSGEIGALERRDYPEPLVNHKTQQAKFKALYATIRS

SEQ ID NO: 5370 - protein, 572 aa, Debaryomyces hansenii
MGNNSSKPKDLRGSPLSRTDTGNSAKSSRSIRSRISMLRDDNSTSGSPKTGSKATSRKNSSTSLNNMNSSSHSMNIPINGNNSAHSNNNSSANLSNSFSNLSLHKNPSNQHSNNNFNLPPSMIQVEPKEPILIRRNTGPDGEDTPLSPKNHSFNSNSPHLASSFDNSNPSSNPSNNISRTSTNHSHHSGSINNYPLSPQPTSSSANGSTKDLQEDTSKNFDSQLLNENRNKDVLINNLLHSSTTESNESDDSGSIDIENLIQRLLDAGYSGKKTKSVCLKNHEIQLICAKARNILLLQPSLLELSPPVKVVGDVHGQYGDLIRIFTKCGFPPQTNYLFLGDYVDRGKQSLETILLLLCYKIKYPENFFLLRGNHECANVTRVYGFYDECKRRCNIKTWKLFIDTFNTLPIAAIVAGKIFCVHGGLSPVLNSMEEIRNIARPTDVPDFGLLNDLLWSDPADTMNEWEDNERGVSYVFSRVAINKFLQKFGFDLVCRAHMVVEDGYEFFNDRTLVTVFSAPNYCGEFDNWGAVMSVSDELLCLFELLDPLDSIALKQVMKKGKEERKNAQLQQL

SEQ ID NO: 5371 - protein, 981 aa, Myxococcus xanthus
MASSQPPSDSPADNASLLLVAGERECQRVEEALQHAGVTVVTERATTAAAAEAALSRTWGLVLCGSEVPDMGFAEVQALWSKHGKELPFVVLSRDWCEATLEASVRAGALDYITEDRFSRLAPVVQRELRMTADRRRHTATAVQLERTNYLMENIIDAIPFVLFVKDADTRRLVVANKTFADAFRVTKEWLLGKLDHDYFPKEQAESFIAIDTEILETKQMKSFEEVARADGVDRIFATRKLPLLDEHGVARYVMGVTEDITERKHHEEMLRASKAELEAANKQLAASLEEIKRTRAVSARSLASYQQRALQMEIIRQQNEDLDRLAQELAVAKRNEEERAREAEAAARLKSEFLANFSHEIRTPLNGIIGYCDLLMREEGQRLTAHGRRDLNVVKTNAKTLLALINDILDLSKIESGRVEVVTEQVDVQELAEECLATVKEYLKGKDVALTTNIDPSARMLRSDALKLRQIMLNLLSNAAKFTDAGEVALSLVPAGSEVIMTVEDTGVGIPSDELPFIFEKFRQVDGSTTRKVGGTGLGLAIVRELSRVLGGNVTVTSTLGRGTTFTVRLPTTLETPDNGGGPHLERGVPVSEVAQHVGTMAQPGSTVLVVDDDPLIQQLVAGQLEPAGFKVVVAEDGIAALKRARELRPQAILLDIHLPKLDGWSVLSQLKSEPSLAGIPVILISVEEQRARGFSLGACEYLVKPVEPDRLVEVVQRSLHQSSGTSTSVGEVLVVDDDSATRELVSRNLRRAGFSTSEARSGEDALLKARVSPPALVVLDLMMPNLDGFEVLRRLRAEKLQVPVVVLTGKTLSAEEEALLRDGFAGFVKKGGHALEDVIAQAKGLLLSQRAASAGKLARILYVEDSAQNRDIVRRYLNGHFEVIEAEDGEHGLERAIRDAPDLILMDLSLPRLDGWEVTRRLRALPAAANVPVIAVTAHAGREYQDKAHAAGCTAYLTKPLDRDQLLEMIRKHLGRTHV

SEQ ID NO: 5372 - protein, 572 aa, Gibberella zeae
MASPPHIGSLSRLPANLRGSIESVKRGGHNVSWPLLNLDLLRNVLLFLFFWRWSRRAFWQLRGRGIIGSVVELYTNIRRILYGYFLRAPGVRGKVQQQVNESLVKLSDKLVPKDQIRYLTLPKEGFSHDVVRSELENLANMDHTRWEDGYVSGAVYHGEDELLALQTEAYGKFTVANPIHPDVFPGVRKMEAEVVSMVLSMFHAPPGAAGTSTSGGTDSILMACLAARQKAYAERGVTEPEMILPETGHTAFRKAAEYFKIKLHLVACPAPEYQVDVNAVRRLINPNTVILVGSAPNFPHGIIDDISALSKLALRKNIWLHVDCCLGSFLVPFLERAGFETLLFDFRLKGVSSISCDTHKYGFAPKGNSTVLYRTAEHRKFQYFVSPDWSGGVYASPGMAGSRPGALIAGCWASLMTMGESGYIDSCTKIVGTAKKIAEAIQTTPALGGELEIMGKPLVSVVAFTARNLNVYDIADGMGTKGWHLNALQSPPAIHVAVTLPITKVWEKLITDLEAVVEEEREKERVRLVEGKGTHGKAMGDASALYGVAGSLPNKSVVVDLASGFLDLLYKA

SEQ ID NO: 5373 - protein, 1023 aa, Schizosaccharomyces pombe
MNAQPFHNNTSDVQSFQDIISNSYQKPLSLVDSTDRALPDSSLSSLSRSTFQFHKHHLSGNENPQPSSESPYFTNNERLNSSSFPQIHDNQLSPSFNTSYQAIPSSSSNRSRGGPYTPSIRDDSLLALLSFSSNHRLHSMPSQLQPFNNASSYTTPMAPFTASFSNKVSHSAYPTRRLPSQAKKTSAIERVPVNLNFLQSDNLVVQSSPQTNFENFEFPKKIPSKEDLETREVLLLPPQTSKLSNKNLDTKSFTDVNKISQQGFVEISSNSSKVTPNTSLHQSFGIASSSSNNYMQTSSELTSSTEKMNGSHPLQLSNKSLLSIHLMQSKNQGHVSMTGSDKLSSHVQSETENAPVSKPSKPNTLTEDEKPLQSTKLPGNSLTVGELYQEPKSIQLPELSVSRTTYSAQSSSVKNCNERIPSAKALKKQKHLVPENKSKLQYVWQKKESLPYANLTSASNTHFFLSENQNDTSERLTRTLRKSTKNYTFGSYILGRTIGTGEFGKVKLGWPLPKANSTIHRSTPQVVIKIVLSTKQNCQTSRLMREVAILKGLGNNHPHIVKYLDFVKTKHHFGIVLDYVNGGELFDYILARRRLEDSVACRLFAQLISGVAYLHSRGVVHRDLKLENILLDTNRNIVIADFGFATTFGHFNTLSEHSLPTEKPDLFSTSCGSPCYAAPELVNCKSGMYAGTQADIWSCGVILYAMLAGYLPFDDDPHNPNGENVPRLYRYICSTPLIFPEFFKSKARDILKKILVPDPAKRVRMSAIMNHAYLRSHVSLFETYNDDEATSLRPSPIRLLSQKSLASVSSVSSISTYSSSIELTPQITKTSLNREKPALHGSINLKHSTRPVVPIADGIYASTTLHPIDNAKNRLVSLLRRPKHKVKHAKVETRESPMKNKPTKKQHKRAFSMFERPTSQKAPLSPVESKINLMVAPKRVLNCASDSLRALLAGKTDKSFWGSRIPFLFNKLKSKQKAVSSSFNTENSFLILQAVSPLTFGGCFKEENAYGQKKQHMRHATVF

SEQ ID NO: 5374 - protein, 1248 aa, Unknown
  uncultured bacterium
MPLRSPGKGADLPKDHPAISPDKEIMRSTWTFMLALGALVVTTGATLAWGWSGLGLALAGWAAAGIGYLARQRQEPAADQPGTTRPPEAGAEAEAADLIARVSPQDNGEAQRWLALSQEIVEAAHGANSLAQALQRVGQALHLQMGSRAWVCLRVDGWNGESALLRPWVNADGDAGDIIDVTAIATTHREERPLGQALSTLRPRAAQGEAELAPQSTCPWRPVHTRKVLAVPVSVEGWPLALLEFDDPQQDCAELSHVLDIAALQLGFVAQRDANLAHMATSAEHLGRLALVASRISSGVAITDRHGTIEWINSAFVALTGWPEDKVLGRKLGELLAQEVSAPTTVRELEDHLARGVPFRLSYEAARQGGQLITRYWGEIDAIQMLDETGGRSQYVCLFNDITKRKAQEHVRDQEREFLEALLGNLPVSLFVLDPVNLNVVAINRYTEIEFKLQRDQVVGKSITQALGESVLKLTEGPMQEALETGQTIEHDFEWQNASQQRIVNARHFALRHSNGRPRLLISLVRDITSARQSQADLEESERRFRELVESMDDGVYVASEHRANYLYLSHRTQDLWGVSAEDIQAHPARLKSLVLPEDQHLLAEQEALEDQDQPTDTLLRLQHPDKGLRFLRHRTRARRLPDGQSRIYGLVSDVTDEHGQALELQRARDLAEAASQAKSQFMANMSHEIRTPMNGILGMTELLLGTPLNDKQRRFAQAVYRSGESLLEIINDILDFAKIEAGRLELATCDFVLRTLVEDTLELMAPRAHEKGLELSFREQPGLPSVIHGDPLRLRQILTNLVANAIKFTEHGEIVVDIRRAIGGAVELPKPGSLETMELEFMVRDTGIGIPAEVVPRLFSAFVQANGGMARRYGGTGLGLAISKQLVELMGGQIEVNSAPGVGSEFLFRVPVCIGTTQADMAMLEEPDMPSFNVLVVDDNDTNRTVIENMLTAWGMHVVQAIDGREALNVLMAHPSQDAPFDLALVDMNMPNLDGMGLAEAVRTSGRYPLLKMILLSSVSSPDDVRRAQDVGFQRFVAKPLRKAELRQAILGISAERGDNAQEARRINKAVLVIEDNTVNQEVCSQMLKRLGCEVRVASSALEGLRRLGEQRFDLILMDIQMPGMDGVEALGWFRRGSNNRFSFITPSDTPVIAVTANALEGDEERFLGLGFDDYLSKPFRQSQLHKMLVEHTHIDPGDLPDAPITVPTPLHDDHAPSPAIATAAPPRGSPARCHRRIPQRRLVGRP

SEQ ID NO: 5375 - protein, 724 aa, Unknown
  Polaromonas sp. JS666
MPRPKRKAAGPTRPADGARDKQTQLDAFTAGSANVLTTNQGLQIPDNHNSLKGGVRGPTLLEDFILREKITHFDHERIPERVVHARGSGAHGYFKPYKSMVQYTSAAFLQDPAIETPVFVRFSTVAGSRGSADTVRDVRGFAVKFYTAEGNYDLVGNNIPVFFIQDAIKFPDLIHAVKPEPHHEMPQAASAHDTFWDFASLMPESTHMLMWTMSDRALPRSFRMMEGFGVHAFRFINARGDSHFVKFHWKPKLGVHGLAWDEAQKIAGKDPDFHRRDLWEAIESGHFPEWELGVQIVDDGQESELGFDILDATKLIPEEQVPVQIIGKLVLNRNPDNFFAETEQVAFHPGHLVPGIDFSNDPLLQGRLFSYTDTQLSRLGGANFHELPINRAVCPMHNFQRDGMHRQAISKGRVAYEPNTLGNGAEYRVDGAAQGFQSYPEQLEPPKIRRRSPSFDDHFSQATLFWNSQSVAEKDHIVAAFRFELSKVDVPEIRQRIVDNLAHVDLKLAGRVAVTLGIAAPDPKAAAGRLGFRDYRITSKVDEDPTLRMVGRPGGGVKTRKVAILVANGVESAPLRRIQQDLTEAGALCKLVAQHLGTVSTASGRQLAVDHTFANMPSVMFDAVLIPGGASSAAALSGLGEAVHFVLEAYKHGKTICAVNDGVQLLGTLGFSQGKNPELVTVPTVGVLIADGRKVLDGQVSQDFMAAIALHRHWDRLNIDAIPA

SEQ ID NO: 5376 - protein, 548 aa, Brassica napus
MKLLHGLALVFLLAAASCKADEEITCEENNPFTCSNTDILSSKNFGKDFIFGVASSAYQIEGGRGRGVNVWDGFSHRYPEKAGSDLKNGDTTCESYTRWQKDVDVMGELNATGYRFSFAWSRIIPKGKVSRGVNQGGLDYYHKLIDALLEKNITPFVTLFHWDLPQTLQDEYEGFLDRQIIQDFKDYADLCFKEFGGKVKHWITINQLYTVPTRGYAIGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAELVAGSYDFLGLNYYVTQYAQPKPNPYPSETHTAMMDAGVKLTYDNSRGEFLGPLFVEDKVNGNSYYYPKGIYYVMDYFKTKYGDPLIYVTENGFSTPSSENREQAIADYKRIDYLCSHLCFLRKVIKEKGVNVRGYFAWALGDNYEFCKGFTVRFGLSYVNWEDLDDRNLKESGKWYQRFINGTVKNAVKQDFLRSSLSSQSQKKRFADA

SEQ ID NO: 5377 - protein, 376 aa, Unknown
  uncultured archaeon GZfos24D9
MEERGISKQELKSFLKEQRQKDLTYRKVLSSMCSYPHEMATYAHNLFLDSNLGDSGLFPGTKAMEDELIRMIGALLGNENAHGYISTGGTESNIQAIRAIRNRKRKERLQEMNIIVPKTAHFSFDKIEDLLSLEVKKAGLDDKLRVDVNLVEELIDDNTISIVGIAGTTEFGQIDPIKELADIAHDSDIFLHVDAAFGGFVIPFLDAEYQFDFSLDAVSSVSIDPHKMGMSTIPAGCILFRDESYLADLAVDTPYLTTNEQCSLIGTRSGAPVAATFAVLKYLGRSGLKAIVDDCMQLTRMLVRGAKAMDIYPVIEPVTNVVTLRFPDVDRVAKALEARGWRVSTTRAPKALRLVIMPHVTEDTIELFLNDLACVT

SEQ ID NO: 5378 - protein, 453 aa, Prochlorococcus marinus
MPISRSLRSLGRQRSSWLVLLGAGGAATAIALASPSLGLPRSSSSAISDSPKEVIDQVWQIVYRDYLDSTGKYNPEVWKGLRKDLLAKNYSATSESYEAIRGMLASLDDPYTRFLDPKEFKEMQIDTSGELTGVGIQLSLDKDTKELVVVSPIEGTPASKAGVQPKDVIVFINGQSTKGMSTADAVKLIRGKEGSEVTLGLRRRGEVIQVPLIRARIEIQAVDIQLNTTVSGTKIGYIRLKQFNAHAAKGMRSAIKNLEKEGAQGYVLDLRSNPGGLLEASIDIARQWLDEGTIVRTKTRDGIQDVRRANGSALTQRPVVVLVNEGSASASEILSGALQDNHRGVLVGQKTFGKGLVQSVRGLSDGSGLTVTIAKYLTPSGTDIHKNGIKPDIKAVMSEKEINNLKLEDLGSGKDSQYKVAETTLIKALSKILDGPMYKPVGVKLPQAIPSTL

SEQ ID NO: 5379 - protein, 578 aa, Avena sativa
MALLCSALSNSTHPSFRSHIAGANSENLWHLSAHPAQKSKRRCNLTLSSRAAARISSALESGKLKPWQIPKRDWFPPEFTFGAASAAYQIEGAWNEGGKGPSSWDNFCHNYPERIMDGSNWDVAANSYYMYKEDVRMLKEIGMDSYRFSISWPRILPEGTLEGGINHEGIQYYNDLLDCLIENGIKPYITLFHWDTPQALADKYNDFLDRRIVKDYTDYATVCFEHFGDKVKNWITFNEPHSFCGLAYGTGLHAPGLCSPGMDCAIPQGDALRQPYIVGHNLLLAHAETVDVYKKFYKGDDGQIGMVMDVMAYEPYGNNFVDQQAQERSIDFHIGWFLEPMVRGDYPFSMRSLVGDRLPFFTKSEQEKLVSSYDFVGINYYTARFSEHIDISPEIIPKLNTDDAYSTPEFNDSNGIPIGPDLGMYWILSYPKGLKDILLLMKEKYGNPPIYITENGTADMDGWGNPPMTDPLDDPLRIEYLQQHMTAIKEAIDLGADVRGHFTWSLIDNFEWSMGYLSRFGIVYIDRNDGFKRIMKKSAKWLKEFNGATKEVNNKILGASSCCSGELMWFLVQNPYGK

SEQ ID NO: 5380 - protein, 278 aa, Unknown
  Corynebacterium sp. ATCC 31090
MTVPSIVLNDGNSIPQLGYGVFKVPPADTQRAVEEALEVGYRHIDTAAIYGNEEGVGAAIAASGIARDDLFITTKLWNDRHDGDEPAAAIAESLAKLALDQVDLYLVHWPTPAADNYVHAWEKMIELRAAGLTRSIGVSNHLVPHLERIVAATGVVPAVNQIELHPAYQQREITDWAAAHDVKIESWGPLGQGKYDLFGAEPVTAAAAAHGKTPAQAVLRWHLQKGFVVFPKSVRRERLEENLDVFDFDLTDTEIAAIDAMDPGDGSGRVSAHPDEVD

SEQ ID NO: 5381 - protein, 459 aa, Streptomyces coelicolor
MSEYPGFPPGFVFGAATASYQIEGAATEDGRGPSIWDTYSRTPGLVVNGDTGDVACDHYHRYPEDVALLRDLGVDSYRFSIAWPRIVPDGSGAVNPKGLDFYSRLVDELLAAGIEPAATLYHWDLPQALEDRGGWRVRETAERFAEYTAVVAEHLSDRVPRWITLNEPWCSSFLGYSIGRHAPGAKEGRGALAAAHHLLVGHGLAVKALRAAGVREVGITLNLDRNLPATDSPADLAAVVRADTQHNLVWTEPILAGRYPATEEETWGELITGEDFRRDGDLELISQPLDFLGVNYYRPIVVADAPHRESDPARRVATDNRYEEVRHPGVRHTAMNWPVVPDSFTDLLVALKRQYGDALPPVHITENGSAEDDAAAADGTVHDTDRVAYLRDHLTALRAAIDAGVDVRGYYVWSLLDNFEWAYGYDKRFGIVRVDYDTQRRTPKDSYRWYREMIAANRG

SEQ ID NO: 5382 - protein, 299 aa, Unknown
  Synechococcus sp. WH 8102
MPSTPSPHNPGDLPRQFASRDALEALLVEEFPSAEGPLSPIPGGRQAAEAKLAGVQPARYAKSRNHLNGAVTGLSPYIRHGVLTLAEVKQAVFERIRKRDDGGKLINELGWRDFWQRMWLDLGDGIHDDQEAFKTGHDASSYARELPQDVRDGRTGLACMDGFRDKLVTTGWLHNHARMWMAAWLVHWRRVHWTAGANWFLEHLLDGDPASNHLSWQWVASSFSHKPYFFNRGNLERYSDGRYCEECPSAADCPFEGSYDQLESQLFAPMPAIRDTGTGRNRQRRNGGGASAALARPKR

SEQ ID NO: 5383 - protein, 146 aa, Legionella pneumophila
MKYLHTMVRVSNLEQSLDFYCNKLGLIEVKRTENAKGRFTLVFLAAPADIEQVQTSYGPMLELTYNWDPEDYTEGRNFGHLAYHVDDIYKICQHLQECGVVINRPPRDGHMAFIRSPDNISIELLQKGEPLPKQEPWLSAPNIGHW

SEQ ID NO: 5384 - protein, 545 aa, Caulobacter crescentus
MAAKDVYFSSDARDKMLRGVNILANAVKVTLGPKGRNVVIEKSFAAPRTTKDGVSVAKEIELADKFENLGAQMIREVASKTNDKAGDGTTTATVLAQAIVQEGLKSVAAGMNPMDLKRGIDKAVAIAIEDIKTSSKKVTTNAEIAQVGTISANGDKEVGEMIAKAMDKVGNEGVITVEEAKTAETELDVVEGMQFDRGYLSPYFITNADKMEVQLEEPLILLSRKKLSSLQPLPVLEAVVQSGRPLLIIAEDVEGEALATLVVNKLRGGLRVAAVKAPGFGDRRKAMLEDIAILTGAQVVSEDIGIKLENVSLEMLGRAKKVSITKDDTTIVDGVGEKADIEARIAQIKRQIEDTTSDYDKEKLQERLAKLAGGVAVIRVGGSTEVEVKEKKDRVDDALNATRAAADEGIVPGGGTALLKASKASAVVGDNDDQTAGIAIVRRALQAPIRQIAENAGVEGSIVVGKILENDNSAFGFNAQTEQYVDLVVDGVIDPAKVVRTALQNAASVAGLLITTEAAIVVSPQEGRRRPAGGGMPGGMGDMDF

SEQ ID NO: 5385 - protein, 279 aa, Helicobacter hepaticus
MISIIIDSLRESALHIDSLLKDTSTSYLQSINASGDMQLEIDVRVDKFLSEKLLNLPCVKAICSEEQEEIMYSENKNAPYIIAYDPLDGSSLIDSNLSIGTIFGIYNEELSAKHLIASGYIIYGPRLEMVVAQEQALHYRYNGNMWRNLGALALNTKGKINAPGGTQKHWENKHKAMIESLFAQGYRLRYSGGMVPDLHQILIKGGGLFSYPATSDAPNGKLRKLFEVFPFAFVYEKAGGFATNGTYRILELEVAHLHDSTPCFFGSQSEMNLVKEVYE

SEQ ID NO: 5386 - protein, 548 aa, Corynebacterium glutamicum
MAKIIAFDEEARRGLEKGLNTLADAVKVTLGPKGRNVVLEKAWGAPTITNDGVTIAREIELEDPYEKIGAELVKEVAKKTDDVAGDGTTTATVLAQALVREGLRNVAAGSNPMGIKRGIEKAVAQVTEKLLEAAKEVETEEQIAATAGISAADPAIGAQIAKAMYAVGGGKLNKDSVITVEESNTFGVELEVTEGMRFDKGYISGYFATDMERLEAVLEDPYILLVSGKISNIKDLLPLLEKVMQSGKPLLIISEDVEGEALSTLVVNKIRGTFKSVAVKAPGFGDRRKAQLQDIAVLTGGQVISEEVGLSLETADLPLLGQARKVVVTKDDTTIVDGAGSEAQIEGRVNQIRVEIENSDSDYDREKLNERLAKLAGGVAVLKVGAATEVELKERKHRIEDAVRNAKAAVEEGIVAGGGVALLQAAHVLDNDLELSGDEATGVRIVREALTAPLKQIAANAGLEPGVVADKVSQLPQGEGLNAANGEYVDLMAAGINDPVKVTRSALQNAASIAALFLTTEAVVADKPQPAGAAGMPGADEMGGMGGF

SEQ ID NO: 5387 - protein, 336 aa, Glycine max
MEERYEPLKELGAGNFGVARLAKDKKTGELVAVKYIERGKKIDENVQREIINHRSLRHPNIIRFKEVLLTPTHLAIVLEYASGGELFERICTAGRFSEDEARYFFQQLISGVSYCHSMEICHRDLKLENTLLDGNPSPRLKICDFGYSKSALLHSQPKSTVGTPAYIAPEVLSRKEYDGKISDVWSCGVTLYVMLVGAYPFEDPEDPRNFRKTIGRIIGIQYSIPDYVRVSSDCRNLLSRIFVADPAKRITIPEIKQYPWFLKNMPKEIIEAERKGFEETTKDQPNQKVEEIMRIIQAARIPGQGSKAGEGGQAGTGSLDIEDDEEIDVSGDYEQV

SEQ ID NO: 5388 - protein, 353 aa, Aeropyrum pernix
MDGSMGEGGGQILRTAVALAAVLGRPLRIVNIRAKRRPPGLRPQHLTAVRAVAAISGGRLRGAEVGSTSLEFTPGRVRGGRYRFDVGTAGSVALIIQALAPLLAYSDSPVEVELTGGTDVPMAPTIDYMREVFASILAMLGYEIEIRVLRRGHYPRGGGRVVVRVPDPPGGFRARSFVERGPLKGVYVRSHAVKLPGSIAERQARSAASLVRERLGVDPIVEIEAYKPHRDPHLGPGTGVLVWAVFGETVMGGDSIGKKGKPAEVVGREAAESLLEDMATGAALDRHMSDMAPVYLALAGGVSTVFGARLTGHASTILELLRIMVDGFEYRILEGGLERPFKAELRGAGVSPR

SEQ ID NO: 5389 - protein, 658 aa, Desulfitobacterium hafniense
MTSNEGITISDDENTLTAGERGPTLIEDFLSREKLAHFDRERIPERVVHARGYGAHGEFQPYESLADLTMADFLQDPNKKTPLFVRFSQVVGSKGCNETNRDVRGFSIKFYTDEGNFDLIAINMPVFFIQDAIKFPDLIHAVKPEPDNEYPQGQTDHNTFWDFMANNKETAHMSLWIASNRAFPKSFRTMEGFGVHTFRLVNKDGKSHFVKFHIKPLLGVHSLIWDEAQRLGSDADFHRRDLWENIEIGNYPEYEMAIQVIKEEDEFAYDFDLLDPTKLWPEEEIPLRRIGKIILNRNVENAFAETEQSAFHPGNIVRGIDFSNDPLLQGRLFSYTDAQQARLGPNHQQLPINRPVCPFANNQRDGASRLVIDRGKVAYHRNGLANNSPYTVPGTQGGFVTYPSTVEGHKVRSTAPSFKDHYSQAKMFWNSMSEVEKRQIIGAYCFELGKCGPFVRQEWVDVLAHISTELAKSVSKELGTTVPADVEESPVTKSSPALSLHNTIFVPDTLRVAVFLAQGFDGPGVSKVLETLAEAKLRVVIVHDTLGKVSGTEGVTYEVHDSFLTGSPLVYDGILIVGSGNITPYFTYTAQKFTTDIYNHFKPIGIIQKGDAVLEPLGLLADEGIVTDSGPDFAGRFIKAMAKQRFWNRPSFLYPAMV

SEQ ID NO: 5390 - protein, 376 aa, Arabidopsis thaliana
MSAESCFGSSGDQSSSKGVATHGGSYVQYNVYGNLFEVSRKYVPPLRPIGRGAYGIVCAATNSETGEEVAIKKIGNAFDNIIDAKRTLREIKLLKHMDHENVIAVKDIIKPPQRENFNDVYIVYELMDTDLHQIIRSNQPLTDDHCRFFLYQLLRGLKYVHSANVLHRDLKPSNLLLNANCDLKLGDFGLARTKSETDFMTEYVVTRWYRAPELLLNCSEYTAAIDIWSVGCILGETMTREPLFPGKDYVHQLRLITELIGSPDDSSLGFLRSDNARRYVRQLPQYPRQNFAARFPNMSAGAVDLLEKMLVFEPSRRITVDEALCHPYLAPLHDINEEPVCVRPFNFDFEQPTLTEENIKELIYRETVKFNPQDSV

SEQ ID NO: 5391 - protein, 376 aa, Arabidopsis thaliana
MAKEIESATDLGDTNIKGVLVHGGRYFQYNVYGNLFEVSNKYVPPIRPIGRGAYGFVCPAVDSETHEEIAIKKIGKAFDNKVDAKRTLREIKLLRHLEHENVVVIKDIIRPPKKEDFVDVYIVFELMDTDLHQIIRSNQSLNDDHCQYFLYQILRGLKYIHSANVLHRDLKPSNLLLNSNCDLKITDFGLARTTSETEYMTEYVVTRWYRAPELLLNSSEYTSAIDVWSVGCIFAEIMTREPLFPGKDYVHQLKLITELIGSPDGASLEFLRSANGGKYVKELPKFPRQNFSARFPSMNSTAIDLLEKMLVFDPVKRITVEEALCYPYLSALHDLNDEPVCSNHFSFHFEDPSSTEEEIKELVWLESVKFNPLPSI

SEQ ID NO: 5392 - protein, 438 aa, Desulfotalea psychrophila
MRQQQITARTLGVCLIFLTLFIANSALAEQKSTDKTYKQLEVFATSLSILEQNYIQPLDPEKSLTDAISGILQGLDPHSSYLSAKEFHDLQSETSGSFSGIGIEVSTRNNNLTIIAPLDGSPAAQAGIEAQDQIIEINGKKTAEMSSQQALMLLRGPIGSSISLSLKREGEENLLHISLIRERISLQSVSFLPLGRDIFYSRITSFQSNTSHDYVEKLNRIKKKREIRGLILDLRNNPGGLLSQAISISDLFISSGAIVHTRGRAAEQNMTFEARDLGEDNDFPMLVLINGGSASASEIVAGALQDQGRAIIVGTDSFGKGSVQTIIPLPNGAALKITTAQYYTPKNRSIQAQGIHPDITLSRLKKGSSCRESADQSTEASLTNHLDNPNGKAKRAPRSAREKKVQKLLADDNQIRVARDILRGILRYSAYQDAQVGE

SEQ ID NO: 5393 - protein, 429 aa, Desulfovibrio desulfuricans
MRLSLWTATFIVFLTLTVSIGPGNATDGPGRFESLKRFSQVLDLVERFYVSDVSRDELMEGAIRGMLQNLDPHSAFLDAAEYREMQESTSGEFFGIGIEITQQNDRLVVVAPIADTPAARAGLRAGDIILAVDGKLTQEMTLRESVSRIRGPRGSTVKLTILHEGENSPETVSIERDSIPLISVKSHELEPGYLWVRLSRFSERTTNELHDAIREERKRGPIKGLILDLRNNPGGLLDQAVHVADTFLSEGTIVSIKGRIESNNRDFKATAQATDVKAPLVVLVNAGSASASEIVAGALRDHKRGLLLGERTFGKGSVQNVIPLADGSGLKLTIALYHTPDGTSIQAEGVEPDIKLPFVQPAREEESKAKHPFGIMREKDLARHLENGEDKKSPETERDKESVASLERDNQLRMALQLVKQLPRLQAIH

SEQ ID NO: 5394 - protein, 711 aa, Gibberella zeae
MAPRGFEDEELTISLSSSHVRRPQQTQPQSQSQQQDDSHDAPQAASRPADAPLKERIKTEQRIGAYKVLRTLGEGSFGKVKLAIHNGTGQQVALKIIARKKLISRDMAGRVEREIEYLQLLRHPHIIKLFTVIKTPNEIIMVLEYAGGELFDYIVQHGRMKEPEARRFFQQMLCAVEYCHRHKIVHRDLKPENLLLDENLNVKIADFGLSNIMTDGNFLKTSCGSPNYAAPEVIGGKLYAGPEVDVWSCGVILYVLLVGRLPFDDEHIPSLFAKIAKGTYSIPQWMPTGAANLIKKMLVVNPVHRATIEDIRADPWFTTELPVYLQLPVEEFFNTGVDPNKAIKKNDIAPNASEKVQERLHNEVTEKISKTMGYGKSDVEEALQAAEPSAIKDAYMIVRENKMMQVNHNSEALLAEPEGSSPMLSMSSARSTISQATTTPRPYVSKVGILPSSLPAYHKDYMEREKAGSVENSPPKVLINDEPQLNRTDAEKEETARRLRPHSRSQLRIDEANTRPQGMTPINPPKKTKPVRWQFGIRSRNSPWEALLCIHKALYKLGATYIPDEDYESRTAEERAEASGDSSFVDSHDGYRGSTSSIDPKKRYNLPADPWHINVRWDTSAIKKKAGNTPSAPSTPSSPSTPDGHHAKEPFVALHLDIQIYEMEHGVYLVDFKCSGYETAHGRLLEEKDVTSPFPFLDMAAKLIMQLAEAD

SEQ ID NO: 5395 - protein, 281 aa, Solanum demissum
MVGKISSDLPPGFRFHPTDEELIMYYLRYQATSRPCPVSIIPEIDVYKFDPWELPEKAEFGENEWYFFTPRDRKYPNGVRPNRAAVSGYWKATGTDKAIYSANKYVGIKKALVFYKGKPPKGVKTDWIMHEYRLSDSKSQTYSKQSGSMRLDDWVLCRIYKKKNLGKTIEMMKVEEEELEAQNVSINNAIEVGGPQTMKLPRICSLSHLLELDYFGSIPQLLSDNLLYDDQSYTMNNVSNTSNVDQVSSQQQNTNNITSNNCNIFFNYQQPLFVNPTFQSQ

SEQ ID NO: 5396 - protein, 413 aa, Arabidopsis thaliana
MASSSADNLTDKNIVFRKLKSKSENKVCFDCSAKNPTWASVTYGIFLCIDCSATHRNLGVHISFVRSTNLDSWSPEQLRTMMFGGNNRAQVFFKQHGWTDGGKIEAKYTSRAADLYRQILAKEVAKAIAEETNSGLLSSPVATSQLPEVSNGVSSYSVKEELPLSKHEATSATSSPKASNTVVPSTFKKPIGAKRTGKTGGLGARKLTTKPKDNLYEQKPEEVAPVIPAVSSTNNGESKSSAGSSFASRFEYNDDLQSGGQSVGGTQVLNHVAPPKSSSFFSDFGMDSSFPKKSSSNSSKSQVEESDEAREKFTNAKSISSAQYFGDQNKNADLESKATLQKFAGSASISSADFYGHDQDDSNIDITASDLINRLSFQAQQDLSSLVNIAGETKKKLGTLASGIFSDIQDRML

SEQ ID NO: 5397 - protein, 691 aa, Dechloromonas aromatica
MKQLCWIVLGLTVSAQAAELAPQPQHQRVVRISAALLGHYHYKPAVLDDALSEAIFERYLKTLDSEKYYFTQSDIDQLSEYRTRLDDAIIEENLQAPFAIFNLYARRAEEHFSYARSLLKGGFRFDQNDRFTFVRDKAEWASSDEALREIWQQRVKNDWLRLKLAGKSDPEIVTALDKRYEQSIRRINRLKSDDAFQMFMNAYTTAIEPHTTYLGPRASADFDISMRLSLTGIGAVLQERNDYTMVREVTPGGPAARSGQLKAGDRIVAVAQGEKGAFVDVVGARLDDTVALIRGAADSVVRLDILPANAGPDAKHRQITLVRKKVDLAQQAAKKAVLDVTDNGSARRIGVITLPAFYDDFEGRRKGDPNFRSATRDVAKLLKELGKEKVDGVVLDLRHNGGGSLKEAIELTGLFIDTGPVVMERNAQGQVFVDGDTTPGTAWDGPLGVLIDGESASASEIFAAAIQDYGRGIVIGEQSYGKGTVQTVLNLDQAVGSEKPALGELRMTIAQFFRINGSTTQVRGVQPDIALPAANDPTLTGEASNDNALPWTHIRAAAYDRVADKGEVIPALLARHVARAANDPEFQRLEETASELQRLRLQTSVSLNEAERRRENESLEKRLSGLARADDGLLDSEREPDTDGKDEKAGNKAKDTRLLAAARIIADEVDLQREKGKPGALERPNQAAINR

SEQ ID NO: 5398 - protein, 163 aa, Solanum demissum
MVGKISSDLPPGFRFHPTDEELIMYYLRYQATSRPCPVSIIPEIDVYKFDPWELPEKAEFGENEWYFFTPRDRKYPNGVRPNRAAVSGYWKATGTDKAIYSANKYVGIKKALVFYKGKPPKGVKTDWIMHEYRLSDSKSQTYSKQSGSMRVRTSLICRLIASN

SEQ ID NO: 5399 - protein, 368 aa, Triticum aestivum
AGSHRWPAAASRSSGGVATSCGRRGSGMERYEVIKDIGSGNFGVAKLVRDVRTKELFAVKFIERGHKIDENVQREIMNHRSLRHPNIVRFKEVVLTPTHLAIVMEYAAGGELFERICSSGRFSENEARFFFQQLLSGVSYCHSMQICHRDLKLENTLLDGSEAPRLKICDFGYSKSSVLHSQPKSTVGTPAYIAPEVLSRREYDGKVADVWSCGVTLYVMLVGAYPFEDPDEPKNFRKTITRILSVQYAVPDYVRISMECRHLLSRIFVANPEQRITIQEIKNHPWFLKNLPIEMTDEYQMSLHMVGVNAPPQTLEEVMAIIQEARIPGDGSKFAGQLSVPGLGSMELDDIDDVDADVEDSGDFVCAL

SEQ ID NO: 5400 - protein, 400 aa, Physcomitrella patens
MKRRNECEEHHVEMNGWNGYTNSDLSPAPTPTGPRGRGSRAKTVKQTKNGPQTPGPSGIGSPTSSAPTPTSTCRYDSSLGLLTKKFIDLIKQADDGVLDLNKAADTLHVQKRRIYDITNVLEGIGLIEKKLKNRIRWKGLGMVRNAEAKDDAAGLLAEVEDLRIKEKKLDESISEMRERLRSLSEDEHNKQWLYVTEDDIKNLHCFQNETLIAIKAPLGTTLEVPDPDEAVEYPHRRFQILLRSTLGPIDVYLVSRFEGRTEVPMETLPDSQEAGPSSSVDGMSHQENMVMVPEVGYGLSDLVPPVSHESASQAPEPTGSHPDFAGGIMRIAPAEVNTDTDYWLLSDAGVGISDMWRSDPSNAMWDEVVRLNPEFGSENIGSPRPHTPPSNNALEVDPVS

SEQ ID NO: 5401 - protein, 304 aa, Arabidopsis thaliana
TGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSAYSPLGSPGTTWLKSDVLKNPILNMVAEKLGKSPAQVALRWGLQMGHSVLPKSTNEGRIKENFNVFDWSIPDYMFAKFAEIEQARLVTGSFLVHETLSPYKSIEELWDGEI

SEQ ID NO: 5402 - protein, 358 aa, Arabidopsis thaliana
MDKYEVVKDLGAGNFGVARLLRHKETKELVAMKYIERGRKIDENVAREIINHRSLRHPNIIRFKEVILTPTHLAIVMEYASGGELFERICNAGRFSEAEARYFFQQLICGVDYCHSLQICHRDLKLENTLLDGSPAPLLKICDFGYSKSSLLHSRPKSTVGTPAYIAPEVLSRREYDGKHADVWSCGVTLYVMLVGGYPFEDPDDPRNFRKTIQRIMAVQYKIPDYVHISQECRHLLSRIFVTNSAKRITLKEIKKHPWYLKNLPKELTEPAQAAYYKRETPSFSLQSVEDIMKIVGEARNPAPSSNAVKGFDDDEEDVEDEVEEEEEEEEEEEEEEEEDEYEKHVKEAHSCQEPPKA

SEQ ID NO: 5403 - protein, 312 aa, Bacillus cereus
MCINLLCKLYICFDFLVKSCSNKVVAYKKCNNERETTVHIPTTTLHNGVKMPMIGLGVYKAKEGDEVKQAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKIKPMVNQVELHPMLTQFELRNFCQGEQIQMEAWSPLMRGGEVFQHPIIQAIATKYEKTPAQVILRWDIQSGIVTIPKSVTPSRIQENFSIFDFSLTEEEMTQINTLNRNLHVGTNPDKYDTL

SEQ ID NO: 5404 - protein, 206 aa, Triticum aestivum
MASRRRTLLKVIILGDSGVGKTSLMNQYVNKKFSNQYKATIGADFLTKEVQYEDRLFTLQIWDTAGQERFQSLGVAFYRGADCCVLVYDVNSMKSFDNLNNWREEFLIQASPSDPDNFPFVLLGNKVDIDGGNSRVVSEKKAKAWCASKGNIPYFETSAKEGTNVEDAFQCIVKDALKNEPEEELYIPDTVDVVGGNRTQRSSGCC

SEQ ID NO: 5405 - protein, 500 aa, Glycine max
  misc_feature (218)..(219): Xaa can be any naturally occurring amino acid
  misc_feature (403)..(403): Xaa can be any naturally occurring amino acid
  misc_feature (407)..(407): Xaa can be any naturally occurring amino acid
  misc_feature (409)..(410): Xaa can be any naturally occurring amino acid
  misc_feature (420)..(420): Xaa can be any naturally occurring amino acid
MGLVKKIGKYQLGRTIGEGTFSKVKLAVNGNNGQKVAIKVIDKHMVLENNLKNQAKREIRTMKLLHHPNIVRIHEVIGTKTKIYIVMEYVSGGQLLDKISYGEKLNACEARKLFQQLIDALKYCHNKGVYHRDLKPENLLLDSKGNLKVSDFGLSALQKHNDVLNTRCGSPGYVAPELLLSKGYDGAAADVWSCGVILFELLAGYLPFNDTNLMNLYXXIWKAEYRCPPWFTQNQKKLIAKILEPRPVKRITIPDIVEDEWFQTDYKPVFASEFDQNINLDDVDVAFNSIKENIRESTIPKSSSFINAFQLIAMSQDLDLSGLFEEQDEKKQRTRLGSKHTINETIEKIEAAATDVGLSIEKMNNFKIKMQPKQIMTRCSRSYLSAQVIEVAPTHCVIEISKXTGDXRXXHKFCESLSNXLKQKPDPSQSQDSVDCAAERKNKMLDATKSQKVKIANLFLAINLLEDGLNPCLFHFSEVHGSLTRMKQSTKKNHVANFLL

SEQ ID NO: 5406 - protein, 420 aa, Triticum aestivum
  misc_feature (214)..(214): Xaa can be any naturally occurring amino acid
MSNTASSAALLTPYKMGRFDLSHRVVLAPLTRERSFGNVPQPHAILYYQQRTTKGGLLIAEATGVSDTAQGYKDTPGIWTKEQVEAWKPIVNGVHAEGGIFFCQIWHVGRVSNHTFQPNGQAPISSTDKPLKPVVRANGIDVPTISTPRRLQTNEIPLVINDFRAAARNAIEAGFDGVEIHGAHGYLIDQFLKDQVNDRTDKYGGSLENRCRLXPLEVVQAVVDEVGADKVGIRLSPFANYSEASDSNPEALGLYMAHALNKFGILYCHMVEPRMVNIGEKFETPHSLRPIRDAFKGTFIVAGGYDRDDGNKAIADGYADLVAYGRLFLSNPDLPRRFEIGAPLNKYIRDTFYLSDPVIGYTDYPFLPSGCLDGPFRNESPPHQIVYLMYQYYVKGIRSLISMLMCIGAVWIKYVIIIAI

SEQ ID NO: 5407 - protein, 208 aa, Desulfovibrio desulfuricans
MTIRTFPIGPLETNCHILSHQGQALAVDPGGDPAQLLEYCTEKSLQLKHILLTHLHFDHLYGVAALAERTGAQVSANNADAYLMQTELGKGGMFGFPRVQPFDFTALEAGEHTFIGLSCTVLETPGHTPGSFSFYFPQAEAVFVGDLLFHRSVGRTDFPGGDSATLLNSVKKAIFSLPDTTVVYPGHGIETTVGDEKLNNPFFTEFRR

SEQ ID NO: 5408 - protein, 434 aa, Campylobacter upsaliensis
MKRKQILAALAGFTGSLILCLGLANVLYADDKTEQMQKRLEALEKLTKTLQIVEQYYVDEQNISDLVDKSLSGLLTNLDAHSSFLNEKDYNDMKMQMSGEFGGLGITVGMKDGALSVISPIEGTPADKAGIKSGDIILKINNEATLGMNLNDAVDKMRGKPSTKITLTIFREGAAKPFDVNLTREIIKVESVYSKRIEDEDILYLRVTSFNKNIVDEARKELKKYPNNKGVILDLRNNPGGILNQAIGLTNLFVDKGIIVSQKGRNESENKDYKADPKNKISNSSLVVLVNGGSASASEIVSGALQDLKRAIIVGENTFGKGSVQQTIPLNKTEALKLTIARYYLPSGRTIQAVGVKPDVEVFPGKVTAKEDGFSIKESDLKQHLEGELEKLEKKEDKKDTKENKNLITKKQINEDAQLKAAIDSIKILNIKGK

SEQ ID NO: 5409 - protein, 484 aa, Pseudomonas syringae
TDTLTRDNGAVVGDNQNSQTAGAQGPVLLQDVQLLQKLQRFDRERIPERVVHARGTGVKGEFTASADISDLSKATVFKSGEKTPVFVRFSSVVHGNHSPETLRDPHGFATKFYTADGNWDLVGNNFPTFFIRDAIKFPDMVHAFKPDPRTNLDNDSRRFDFFSHVPEATRTLTLLYSNEGTPAGYRFMDGNGVHAYKLVNAKGEVHYVKFHWKSLQGIKNLDPKEVAQVQSKDYSHLTNDLVGAIKKGDFPKWDLYVQVLKPEELAKFDFDPLDATKIWPDVPEKKIGQMVLNKNVDNFFQETEQVAMAPANLVPGIEPSEDRLLQGRVFSYADTQMYRLGANGLSLPVNQPKVAVNNGNQDGALNTGHTTSGVNYEPSRLEPRPADDKARYSELPLSGTTQQAKITREQNFKQAGDLYRSYSAKEKTDLVQKFGESLADTLTESKNIMLSYLYKEDPNYGTRVAEVAKGDLSKVKSLAASLKD

SEQ ID NO: 5410 - protein, 125 aa, Arabidopsis thaliana
MEEKKTESATKNVKKVNLLDHIAIKHLLDESVSDIVTSRGYKEDGSFTSTGLVVSSKLPRFSDQYTLTIDSADPQSISAGKSVQFTKSVTQWLTKDGVLVEGLFWKDVEALVKEYTEAGEPKKKR

SEQ ID NO: 5411 - protein, 696 aa, Penicillium janthinellum
TASGKLQRKFLDRFAISMGRGVALGKTYGTLGAASRGATLLQDLLFTEIIFAFDRERVPERAVHARGTGAHGTFLSYEDWSNLTAASFLSAEGKFTPEMTRFSTVSGARGSADTARDVHGFATRFYVDEGNFDIVGNNIPVFFIWDVIIEPTLMALHAQKPNPRFHLPRGQQDPNRISDNLTARGDSLAQGSQISSERGSPKAYSNTEPNKHRSFRLVTDNGKQFQCSNHWQPLQGFIDLGVEEAWRFPEEGEGYVAENLFESIELLTVGDEELEIQSMSFNNDLRERFNSSEVTKSSVVRLVPLITQGKLVFNKNIQMLFNEVIGAMFQPGHIVRGVDFTEDPLLQGRLFSYLDTQLNRHGPNIQQLGFNRPPRAPIHNNNRDGAGEMIDLPPFASFVETQEWGAKDIKQTAVGQNKFDQEHRFSHWKFGVNGFVHTRNDDNVTHARGFFTAPERGQQKKRVAAFDRMFTVVGLSVDGQQANSDQYADFDAAAGKKVAKAIGVEAPKPNSNYFHPTDVFGEHIAASGTKYGVPEGNTKGVLLASVNKPASIAQGAKLQVVASSGDFAEFFISAKQLNMREVTQGIIPLVPVLKLAKLDLGKTFRFQLMQVGNIEELERFGFDLPDLTDKQVDLSAMGMFETTFRPTSRAAQFEQGKTKLVKGLQGKNAFMDRALKQPSNNREKIQRFADRFAVQD

SEQ ID NO: 5412 - protein, 309 aa, Hypocrea jecorina
MVATSFKLNNGLEIPAVGLGTWQSKAGEVKAAVSYALQIGYKLIDGAYCYGNEDEVGEGLKEAFAAGVKREDIFVVTKIWATYNTRVVLGLDKSLRSLGLDYVDLLLVHWPVLLNPEGNHDKFPTLPDGKRDVIWDYNHVDGWKQMEAVLATGKTKSIGVSNYSKKYLEQLLPHATVIPAVNQIENHPSLPQQEIVDFCKEKGIHIMAYSPLGSTGSPLMSADPVVKIAEKKGISPTTVLLSYHVNRGSTVLAKSVTPARIKANLEIVDLDDEDMKLLNDYSNDLASKGELKRYVYPPFGIDFGFPDKS

SEQ ID NO: 5413 - protein, 208 aa, Saccharomyces cerevisiae
MSSRKKNILKVIILGDSGVGKTSLMHRYVNDKYSQQYKATIGADFLTKEVTVDGDKVATMQVWDTAGQERFQSLGVAFYRGADCCVLVYDVTNASSFENIKSWRDEFLVHANVNSPETFPFVILGNKIDAEESKKIVSEKSAQELAKSLGDIPLFLTSAKNAINVDTAFEEIARSALQQNQADTEAFEDDYNDAINIRLDGENNSCSC

SEQ ID NO: 5414 - protein, 492 aa, Helianthus annuus
MDPYKYRPSSAYNAPFWTTNYGAPVYNNDSSLTVGTRGPILLEDYHFVEKLANFDRERIPERVVHARGASAKGFFEVTHDISALTCADFLRAPGVQTPVIVRFSTVIHERGSPETLRDPRGFAVKFYTREGNFDLVGNNFPVFFVRDGMKFPDMVHSLKPNPKSHIQEDWRILDFFSHHPESLHMFTFLQDDVGVPQDYRHMDGSGVNTYTLINKTGKTHYVKFHWRPTCGVKCLLEDEAIKVGGMNHSHATKDLYDSIADGNYPEWKLFIQTMDPDHEDRFDFDPLDVTKTWPEDILPLQPVGRMVLNKNIDNFFAENEQLAFCPAIIVPGIYYSDDKLLQTRIFSYADTQRHRLGPNYLQLPANAPKCAHHNNHHDGFMNFMHRDEEVIYFPSRYDPVRHAEQSPIPPVMLSGKRNKCVIEKENNFKQPGERFRSWDPDRQERFIRRIVGALSDPRVTHEVCTIWVSYWSQADKSLGQKIASRLNVKPSY

SEQ ID NO: 5415 - protein, 492 aa, Helianthus annuus
MDPYKQRPSSAYNAPFWTTNAGLPVYNNTASLTVGNRGPILLEDYHLIEKLANFTRERIPERIVHARGASAKGFFEVTHDITHLTCADFLRAPGVQTPTIVRFSTVIHERGSPETIRDPRGFATKFYTREGNFDIVGNNFPVFFTRDAMAFPDVIHAFKPNPKSHIQEDWRILDFLSHHPESLNTMTFWLDDVGIPTDYRHMEGSSVNTLTLVNKEGKIHYVKFTWKPTCGVKCLMDDEAIKIGGANHSHATQDLYDSIQAGNFPEWKLYLQVIDPDHEDRLDFDPLDGTMTWPEDIIPLQPVGRMVLNKNIDNFFAENEQLAFNPGLVVPGIYYSDDKMLQGRIFAYSDTQRHRLGPNYLQLPVNAPKCAHHNNHYDGNMNFMHRDEEVDYFPSRYDRVQHAKQYPINSRQVTGTRDRTVIPKYNDFKQPGDRYRSWDPARQERFIVRMCKMLSDPRVTHELRSIWISYWTQADQSLGQKIASRLNVRPNY

SEQ ID NO: 5416 - protein, 525 aa, Arabidopsis thaliana
NDHIHRVPALTEEEIDSVAIKTFERYALPSSSSVKRKGKGVTILWFRNDLRVLDNDALYKAWSSSDTILPVYCLDPRLFHTTHFFNFPKTGALRGGFLMECLVDLRKNLMKRGLNLLIRSGKPEEILPSLAKDFGARTVFAHKETCSEEVDVERLVNQGLKRVGNSTKLELIWGSTMYHKDDLPFDVFDLPDVYTQFRKSVEAKCSIRSSTRIPLSLGPTPSVDDWGDVPTLEKLGVEPQEVTRGMRFVGGESAGVGRVFEYFWKKDLLKVYKETRNGMLGPDYSTKFSPWLAFGCISPRFIYEEVQRYEKERVANNSTYWVLFELIWRDYFRFLSIKCGNSLFHLGGPRNVQGKWSQDQKLFESWRDAKTGYPLIDANMKELSTTGFMSNRGRQIVCSFLVRDMGLDWRMGAEWFETCLLDYDPCSNYGNWTYGAGVGNDPREDRYFSIPKQAQNYDPEGEYVAFWLQQLRRLPKEKRHWPGRLMYMDTVVPLKHGNGPMAGGSKSGGGFRGSHSGRRSRHNGP

SEQ ID NO: 5417 - protein, 391 aa, Zea mays
MSNLTSSTSGGPNAAPAAAAAAPPAPAASGNNKRKRSLPGNPDPEAEVVALSPATLMATNRFVCEICGKGFQRDQNLQLTRERPQPAEAQRRKVYVCPEASCVHHDPARALGDLTGIKKHFFRKHGEKKWKCDKCSKKYAVHSDWKAHSKICGTREYKCDCGTIFSRRDSFITHRAFCDALTEESAKAIGLNAMAAVPAQHHHHPMLFSPPPTHVMQQDVALLQEHHHQEVMQQEHCNYAMKTEMPPWPGMTYDHPLLQPLCNAAAPQSSATSTPPPPTTMQLPAAYAHLSATALLQKAAQMGATVAGAGYTQMAGAATSATFGLGLPDLQNTQQQQHQDGEIMAGLARTASHGRGGEEGGGGGGDGMTRDFLGLRAFSHRDILGLAGLDS

SEQ ID NO: 5418 - protein, 492 aa, Helianthus annuus
MDPYKQRPSSAYDTPFWTTNAGAPVYNNTASLTVGNRGPILLEDYHLIEKLANFTRERIPERIVHARGASAKGFFEVTHDITHLTCADFLRAPGVQTPVIVRFSTVIHERGSPETIRDPRGFATKFYTREGNFDIVGNNFPVFFTRDAMAFPDVIHAFKPNPKSHIQEDWRILDFLSHHPESLNTMTFWLDDVGIPTDYRHMEGSSVNTLTLVNKEGKIHYVKFTWKPTCGVKCLMDDEAIKIGGANHSHATQDLYDSIQAGNFPEWKLFLQVIDPDHEDRLDFDPLDGTMTWPEDVIPLQPVGRMVLNKNIDNFFAENEQLAFNPGLVVPGIYYSDDKMLQGRIFAYSDTQRHRLGPNYLQLPVNAPKCAHHNNHYDGHMNFMHRDEEVDYFPSRYDRVQHAQKYPINPARVTGTRDRTVIPKYNDFKQPGERYRSWDPARQERFIVRMCKMLSDPRVTHELRSIWISYWTQADKSLGQKIASRLNVRPNY

SEQ ID NO: 5419 - protein, 457 aa, Salmonella enterica
MRYRFPDNFWWGSACSALQTEGDSLNGGKSQTTWDVWFERQPDRFHQGVGPAETSTFYRHWKQDIALLKQLKHNSFRTSLSWARLIPDGVGEVNPQAVSFYNHVIDELLAQGITPFITLLHFDMPMVMQEKGGWENRDVVEAFGRYAQTCFTLFGDRVKHWFTFNEPIVPVEGGYLYDFHYPNVVDFKRAATVAYHTVLAHSTAVRAGRYDGEIGIVLNLTPSYPRSQHPADVQAAHHADLLFNRSFLDPVLKGEYPADLVALLKTYDQLPACQPGDRQLIADGKIDLLGINYYQPRRVKCRDTAVNPQAPFMPEWLFDYYDMPGRKMNPYRGWEIYAPGIYDIITNLRDNYGNPRCFISENGMGVENEQRFVQAGQIHDDYRIDFISEHLKWLHKGISEGCHCLGYHMWTFIDNWSWLNGYKNRYGFVQLDLATQTRTVKKSGEWFAATAEHNGFD

SEQ ID NO: 5420 - protein, 178 aa, Zea mays
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 5421 - protein, 256 aa, Brassica oleracea
MGRGRVQLKRIENKINRQVTFSKRRAGLFKKAHEISVLCDAEVALVVFSHKGKLFEYSTDPCMEKILERYERYSYAERQLIAPESDVNTNWSMEYNRLKAKIELLERNQRHYLGEDLQAMSPKELQNLEQQLDTALKHIRSRKNQLMYESINELQRKEKAIQEQNSMLSKQIKERENVLRAQQEQWDEQNHGHNMPPPPPPQQHQIQHPYMLSHQPSPFLNMGGLYQEEDQMAMRRNDLDLSLEPVYNCNLGSFAA

SEQ ID NO: 5422 - protein, 473 aa, Triticum aestivum
MLLPVRRPHAAPSRPASPRHVSSSLGPRSRQVDRVLRGSTVARASPAATDASASAGLGRRAVVGMALAVSLSAPAYCRAPPPSSALTEENLLFLEAWRAVDRAYYDKSFNGQSWFRYRERALRDDPMNTRQETYAAIKKMLATLDDPFTRLLEPEKFKSLRSGTQGALTGVGLSIGYPLALKGSPAGLSVMSAAPGGPAEKAGIVSGDVILAIDDTSAQDMDIYDAADRLQGPEGSSIDLTILSGADTRHVVLKRERYTLNPVRSRMCEIPGSEDSSKIGYIKLTTFNQNAAGSVKEAIKKLREKNVKAFVLDLRNNSGGLFPEGIEIAKIWMDKGVIVYICDSRGVRDIYEADGASTIAASEPLVVLVNKGTASASEILAGALKDNKRAVVYGEPTYGKGKIQSVFALSDGSGLAVTVARYETPAHTDIDKVGVTPDRPLPASFPTDEDGFCSCLRDPASCNLNAARLFVRS

SEQ ID NO: 5423 - protein, 275 aa, Salmonella typhi
  misc_feature (175)..(175): Xaa can be any naturally occurring amino acid
MANPTIIRLQDGNVMPQLGLGVWKASNEEVIAAIHKALEVGYRSIDTATAYQNEEGVGKALKAASVAREELFITTKLWNDDQKRPREALQESLKKLQLDYLDLYLMHWPVPAIDHYVDAWKGMIALQKEGLVKSIGVCNFQIHHLQRLIDETGVPPVINQIELHPLMQQRQLHAXNATHKIQTESWSPLAQGGEGVFDQKVIRELADKYGKTPAQIVIRWHLDCGLVVIPKSVTPSRIAENFAVWDFRLDKDELGEIAKLDQGKRLGPDPDQSGG

SEQ ID NO: 5424 - protein, 159 aa, Zea mays
MSLIRRGNAFDPFSLDLWDPFEGFFPFGSGDVRSLVPSLPRTSSETAAFAGARIDWKETPEAHVFKADVPGLRKEEVKVEVEDGNVLQISGERNKEHEEKNDRWHRVERSSGKFLRRFRLPDNAKADQIKASMENGVLTVTVPKEEAKKADVKNVQITG

SEQ ID NO: 5425 - protein, 157 aa, Cuscuta japonica
MSLIPSFFEGRRSNAFDPFSLELWDPFFSNTVANLSGSSSAREASAFANARIDWKETPEAHIFKADVPGLKKEEVKVEVEEGKVLQISGERSKEKEEKNDTWHRVERSSGKFLRSFRLPENAKVDQVKAAMENGVLTVTVPKVEEKKAEVKSIQISG

SEQ ID NO: 5426 - protein, 140 aa, Oryza sativa
MVSFEMNDLKKIGLGLTGFGVFFSFLGIIFFFDKGLIAMGNILFLSGLGLTIGLKSTMQFFTKPKNYKGTISFGAGFFLVLIGWPFFGMLLEAYGFVVLFSGFWPTLVVFLQRIPIIGWIFQQPFVTSFLDRYRGKRVPV

SEQ ID NO: 5427 - protein, 461 aa, Sorghum bicolor
MDERRTILMDRYEIGRQLGQGNFAKVYFARNLTDGQSVAIKMIDKDKITRVGLIVQIKREISIMRLVKHPNVLQLFEVMASKSKIYFVLEYAKGGELFNKISKGKFSEDVARRYFHQLISAVDYCHSRGVYHRDLKPENLLLDENENLKVSDFGLSALAESKRHDGLLHTTCGTPAYVAPEVLSRRGYDGTKADIWSCGVILFVLVAGYLPFHDPNLIEMYRKISKAEYRCPRSFSGELKDLLFRMLDPDPSTRISISRIKRSTWYRKPIEVNSAKIKHDTTRDKVCNGEATTSNSIECSNSEETRGSSSLPNLNAFDIISLSTGFDLSNLFEEKYGRREERFTTRQPAGTVFAKLNELAERLKLKIKKKENGVLKLASPKEGIKGFLELDAEIFELAPSFLLVELKKTNGDTIEYQRLVKEEIRPALKDMVWAWQSDRHQQRNESVQGEQQLSSPLPPQQ

SEQ ID NO: 5428 - protein, 496 aa, Zea mays
MVLSHASSGRDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTDKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYRNIMQNCQDNAAILREGIAATGRFGVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVC

SEQ ID NO: 5429 - protein, 468 aa, Methanosarcina acetivorans
MISRKMNLESLDESKKYRVGAYSARYVPKTKEKGIPKYEFPEEGMSPRAAYQLVHDEQSLDGNPFLNLASFVNTWMEPEADKLVMENISKNIIDIFEYPQTSRVIHHNMVNMLGRLFNGHHTDFVGTSTAGSSEAIMLGLLAHKWSWKKSGRGTDKPNIIFGNDAHVCWDKFARYFDVDTRKVPIDKDRRTITAEAVAERIDENTICVGCVLGTTFTGEIDPVKDINDLLLEYKEEKGWDIPIHIDAASGGFILPFTEPDFEWDFRLERVKSINVSGHKYGLTYPGLGWLIFRNKNALPEDLIFHVNYLGEMEDSYTLNFSGGSAMVAAQYYNFLRFGRAGYTGIMKKILAVSQDLAEKVDRLGRFEMLNKGERLPIIAFRQKEKTGYSLLQLSHKLREKGWIVPAYCLPENAADIEIMRIVVRENLTPDMASIIVEDLEKACQFLENGTEAGAEKPCPSGKDMAHIC

SEQ ID NO: 5430 - protein, 542 aa, Bacteroides fragilis
MIMKRIIYLLIGLCSVLGLQAQNFGSPAMRKLQLAEFAISNLYVDTVNENKLVESAIIEMLAQLDPHSTYSDAEEVKKMNEPLQGNFEGIGVQFQMIEDTLLIVQPVSNGPSEKVGILAGDRIIAVNDTAIAGVKMGTEEIMGRLRGPKDSKVNLTIIRRGVKEPLLFNVKRDKIPILSLDAAYMIQPKIGYIRINRFGATTAEEFLKALKELQKKGMKDLILDLQGNGGGYLNAAIDLANEFLGQKELIVYTEGRSAQRSEFFAKGNGNFRNGRLVVLVDEYSASASEIVTGAIQDWDRGVVVGRRSFGKGLVQRPIDLPDGSMIRLTIARYYTPAGRCIQKPYDSSINEKPGKGKSSESSIEKYNQDLIDRYNHGEMVSADSIHFPDSLKCQTKKLGRTVYGGGGIMPDYFVPVDTTLYTDYHRNLVAKGVVIKTTMNFIEKNRKALLDKYKTFEKFNEKFEIDDQLLNYLREAADKEKIEFNEEQYNKALPLIKAQLKALIARDLWDMNEYFQVMNATNKSVERALEILNDKEYEKILK

SEQ ID NO: 5431 - protein, 254 aa, Oryza sativa
MISPDAARNVVGIIGNVISFGLFLAPVPTFWRICKRKDVEEFKADPYLATLLNCMLWVFYGIPIVHPNSILVVTINGIGLVVEGTYLFIFFLYSPNKKRLRMLAVLGVELVFMLAVILGVLLGAHTHKKRSMIVGILCVFFGSIMYFSPLTIMGKVIKTKSVEYMPFFLSLVCFLNGVCWTAYALIRFDIYVTIPNGLGAIFGAIQLILYACYYRTTPKKTKAAKDVEMPSVISGPGAAATASGGSVVSVTVER

SEQ ID NO: 5432 - protein, 320 aa, Candida albicans
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKEFYCVGIQG

SEQ ID NO: 5433 - protein, 713 aa, Bdellovibrio bacteriovorus
MNQKQLPWWTWVLPFIILLGGTFVSLTFKVSQGIYWIYFPINLGVIMALWWGPRVFAAVFLNALVAISLFELPRPMLYPLYALPETLEVIFSWVLVRERFKDVSAWKPSPKNISLYFVYGLLIPSLICSVAIQGLFVLTGIQDKSLFGWSTLITTVGDLTGAIFLTIPALILISPWLRKRNLSLFAVKPLPPTHWEVVTRKEKALFAVVLGGMLVLALSFHIPQTWYVYGILMLLSAAWYGMYAALVVNTWVVFLNIILPKIANLPWSNSFLEVQTPATLLTLCFCSLITGSAVTSLTGKIRELNETQGQLKSAKDQAEEASRAKSEFLARMSHEIRTPLNSVLGMLELLRETQLSKDQERYLTLFSHAGENLKALINDLLDFSKIEAKALTVENVSYNIHSTVRSVFDILQIKAEEQGLHFELHISKDVPPLQWGDPTRLRQVLFNLIGNALKFTNEGSVKVKLELTKDAPEQLLIEVQDTGIGIPRERQSKLFSSFAQGDPTIARKYGGTGLGLVISKNLVEIMGGTMEMKSLAGRGTTFKILLPHQPDFSSNIEKKAKPAMVWSQLPADKRFRLLLVDDSEDNRVLMIHYLKSLPFDCDEAVNGQEAFEKFKERKYDLVFMDMQMPIMTGYKSTELIRYYEKMNKLPHTPIIALTATAVVEDLQRAVSSGCDSYAVKPVKKAEILEILAQNLTTKSPTKEAFKEPPSPSI

SEQ ID NO: 5434 - protein, 910 aa, Legionella pneumophila
MLKSIGIKYQLRITTLIPAFLVALLFAFFYNGLFGKDLKQHMSRLGEAYIRQLLPAAQYAMLRNDYRTLQGLINASTINPEVKALAFYNADGRLIAYRGGKHSIHKPFNPPDYTGDYIESKQINPFTINFIAPITIPKFNLYSSTEFKELSTPKIFQADDILGWLSIDIDTQSLLIKRYQMLIVTIFITLFGLLMGLTIHYFLSKRIYMPIARLRRSMKQILSNEFETEIRVSSPGELGIIEKGCAHLQRQYLNTVRDLNHHIEIATADLQQSLELLEEKNIELSLEKKKTEEKSRQKSEFIANMSHEIRTPMNGVIGFTNVLLESKLDPLQLDYVKTIKSSAQDLLSIINDILDFSKIDAGKLNLDCIPLDIRGCIDEVLSLASPNAHKKGIDLIPITDINVPKMVLGDPLRIKQIISNLVTNAVKFTDHGYVLIRTKIEQETDKDYTLLFAITDTGIGISPEDQTKLFTAFNQADTSITRRYGGSGLGLVICKKLCEEMHGRISLTSEINKGSTFSARIKVEKLVAYEIEKNQTHRFAHLKIICFDDNPLHLEAIGNGLGFWGIEAIRVDSFNKLSRTLTKHKDCKIAFINVNQGCERQAAELIAKHKQIPFVLISKWPINDFAALGARGFLYKPISIQKLQDLIESIANENQTEKNTNQELDTLREQLRFLHPEILIAEDNPVNKMLLTSLLNNNANITTVDDGEMAVTACEDKKFDMILLDLHMPKLNGLEAAKMIRQKSLMNKHSPIVLITASSSDLSSIDMKKYGVDFCFQKPIDEKQLLIQILRIVDKTKHAAIDWQLCVQKVSGNQALAEEFLAKFIEELYKNREEFIGLMHQKNVKGLADLAHKLHGACCFCGVPILQKRVAQLERLARRTANADNLTEAFTDLIQSIDAVISEYENQYSQ

SEQ ID NO: 5435 - protein, 245 aa, Zea mays
  misc_feature (16)..(16): Xaa can be any naturally occurring amino acid
MISPDAARNVVGIIGXNVISFGLFLSPVLPFWRIYKAKDAEEFKPDPYLATLLNCMLWVFYGIPVVHPNSILVVTINGIGLVIEAVYLTIFFLYSDSQKRKKAFAILAVEILFMVAVVLGVILGAHTHEKRSMIVGILCVIFGSMTYASPLTIMSRVIKTKSVEYMPFLLSLVSFLNGCCWTAYALIRFDLYVTIPNALGAFFGLIQLILYFCYYKSTPKKEKNVELPTVSSNVGGGNVTVSVER

SEQ ID NO: 5436 - protein, 586 aa, Pisum sativum
MCGILAVLGCSDDSQAKRVRILELSRRLKHRGPDWSGLHQHGDNYLAHQRLAIVDPASGDQPLFNEDKSIIVTVNGEIYNHEELRKQLPNHKFFTQCDCDVIAHLYEEHGENFVDMLDGIFSFVLLDTRDNSFIVARDAIGVTSLYIGWGLDGSVWIASELKGLNDECEHFEVFPPGHLYSSKEREFRRWYNPPWFNEAIIPSTPYDPLVLRNAFEKAVIKRLMTDVPFGVLLSGGLDSSLVASVTARYLAGTKAAKQWGAKLPSFCVGLKGAPDLKAGKEVADFLGTVHHEFEFTIQDGIDAIEDVIYHTETYDVTTIRAATPMFLMSRKIKSSGVKWVISGEGSDEIFGGYLYFHKAPNREEFHQETCRKIKALHRYDCLRANKSTYAWGLEARVPFLDKDFIKVAMDIDPEFKMIKHDEGRIEKWILRKAFDDEENPYLPKHILYRQKEQFSDGVGYGWIDGIKDHAAKHVTDRMMFNASHIFPFNTPNTKEAYYYRMIFERFFPQNSARLTVPGGPSVACSTEKAIEWDASWSNNLDPSGRAALGVHVSAYEHQINPVTKGVEPEKIIPKIGVSPLGVAIQT

SEQ ID NO: 5437 - protein, 215 aa, Shigella flexneri
MNYRIIPVTAFSQNCSLIWCEQTRLAALVDPGGDAEKIKQEVDDSGLTLMQILLTHGHLDHVGAAAELAQHYGVPVFGPEKEDEFWLQGLPAQSRMFGLEECQPLTPDRWLNEGDTISIGNVTLQVLHCPGHTPGHVVFFDDRAKLLISGDVIFKGGVGRSDFPRGDHNQLISSIKDKLLPLGDDVTFIPGHGPLSTLGYERLHNPFLQDEMPVW

SEQ ID NO: 5438 - protein, 583 aa, Pisum sativum
MCGILAVLGCSDPSRAKRVRVLELSRRLKHRGPEWSGLHQHGDCYLAQQRLAIVDPASGDQPLFNEDNPSIVTVNGEIYNHEDLRKQLSNHTFRTGSDCDVIAHLYEEYGEDFVDMLDGIFSFVPLDTRDNSYIVARDAIGVTSLYIGWGLDGSVWISSEMKGLNDDCEHFECFPPGHLYSSKDSGFRRWYNPSWYSEAIPSAPYDPLALRHAFEKAVVKRLMTDVPFGVLLSGGLDSSLVASITSRYLATTKAAEQWGSKLHSFCVGLEGSPDLKAGKEVADYLGTVHHEFTFTVQDGIDAIEDVIYHVETYDVTSIRASTPMFLMSRKIKSLGVKWVISGEGSDEIFGGYLYFHKAPNKEEFHEETCRKIKALHQYDCQRANKSTYAWGLEARVPFLDKAFINVAMNIDPENKMIKRDEGRIEKYILRKAFDDEENPYLPKHILYRQKEQFSDGVGYSWIDGLKAHAAKHVTDKMMLNAGNIFPHNTPNTKEAYYYRMIFERFFPQNSARLTVPGGPTVACSTAKAVEWDAAWSNNLDPSGRAALGVHDSAYENHNKVNKTVEFEKIIPLEAAPVELAIQG

SEQ ID NO: 5439 - protein, 582 aa, Bifidobacterium adolescentis
MAKMIAYDDEARQGMLAGLDKLADTVKVTLGPKGRNVVLDKTYGAPTITNDGVSIAKEIDLDDPYERIGAELVKEVAKKTDDVAGDGTTTATVLAQSLVHEGLKNVTAGSNPIALRRGIEKAADAIVKELVAAAKDVETKDQIAATATISAADPEVGEKIAEALDKVGQDGVVTVEDNNRFGLDLDFTEGMRFDKGYIAPYFVTNAEDQTAVLEDPYILLTSGKLSSQQDVVHIAELVMKTGKPLLIIAEDVDGEALPTLILNNIRGTFKSCAVKAPGFGDRRKAMLQDMAILTGAQVVSDELGLKLDSVDMSVLGTAKKVIVSKDETTIVSGGGSKEDVAARVAQIRGEIANTDSDYDREKLQERLAKLAGGVAVIKVGAATEVEAKERKHRIEDAVRNAKAAIEEGLLPGGGVALIQAAAKAKDDVKLEGDEATGAAIVFRAVEAPIKQIAENAGLSGDVVIDKVRSLPDGQGLNAATNEYEDLLAAGVTDPVKVTRSALQNAASIAGLFLTTEAVVANKPEPPAAAPAAVFPLRRNAGTRRFPAPSSTTRAWLTSNGLMVATSMSTIGCVLAIMRMALK

SEQ ID NO: 5440 - protein, 548 aa, Oleispira antarctica
MAAKDVLFGDSARAKMLVGVNILADAVRVTLGPKGRNVVIEKSFGAPIITKDGVSVAREIELKDKFENMGAQMVKEVASQANDQAGDGTTTATVLAQAIISEGLKSVAAGMNPMDLKRGIDKATAAVVAAIKEQAQPCLDTKAIAQVGTISANADETVGRLIAEAMEKVGKEGVITVEEGKGLEDELDVVEGMQFDRGYLSPYFINNQEKMTVEMENPLILLVDKKIDNLQELLPILENVAKSGRPLLIVAEDVEGQALATLVVNNLRGTFKVAAVKAPGFGDRRKAMLQDLAILTGGQVISEELGMSLETADPSSLGTASKVVIDKENTVIVDGAGTEASVNTRVDQIRAEIESSTSDYDIEKLQERVAKLAGGVAVIKVGAGSEMEMKEKKDRVDDALHATRAAVEEGVVAGGGVALIRALSSVTVVGDNEDQNVGIALALRAMEAPIRQIAGNAGAEGSVVVDKVKSGTGSFGFNASTGEYGDMIAMGILDPAKVTRSSLQAAASIAGLMITTEAMVADAPVEEGAGGMPDMGGMGGMGGMPGMM

SEQ ID NO: 5441 - protein, 537 aa, Parascardovia denticolens
MAKIIKYDEEARQGMLEGLDELANTVKVTLGPKGRNVVLDKSYGAPTITNDGVSIAKEIDLEDPYQRIGAELVKEVAKKTDDVAGDGTTTATVLAQALVHEGLKNVTSGSNPIALRRGIEKASQTIVKNLLENAKPVETKDQIAATATISAGDPEVGEKIAEALDKVGQDGVVTVEDNNKFGLDLDFTEGMRFDKGYISPYFVTNADDQTAVLEDPYILLTSGKVSSQQDIVHIADLVIKSGKPLLIVAEDVDGEALPTLVLNKIRGTFNTVAVKAPGFGDRRKAMLQDMAILTGAQVVSDELGLKLDSIDDTVLGHAAKVIVSKDETTIVSGAGSKEDIAARVAQIRSEIEASDSDYDREKLQERLAKLAGGVAVIKVGAATEVEAKERKHRIEDAVRNAKAAIEEGLLPGGGVALVQAAGEAEKSVKLDGDEATGADIVFRAIEAPLKQIAENAGLSGEVVIDKVRTLPAGSGLNAATGEYEDLMKAGVTDPVKVTRSALQNAASIAGLFLTTEAVVANKPEPPAPAAAQPDMGY

SEQ ID NO: 5442 - protein, 431 aa, Thermus thermophilus
MDDHAEKFLWGVATSAYQIEGATQEDGRGPSIWDAFARRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRYFLDPILGKGYPESPFRDPPPVPILSRDLELVARPLDFLGVNYYAPVRVAPGTGTLPVRYLPPEGPATAMGWEVYPEGLHHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 5443 - protein, 483 aa, Nicotiana tabacum
MGFISSIDNELLSKVATNNGHGENSAYFDGWKAYEIDPFHPTQNSDGVIQMGLAENQLCFDLIQEWVVKNPKASICTAEGSQDFKDIAIYQDYHGLPEFRSAVARFMGKVRGDRITFEPERIVMSGGATGAHELLAFCLADPGEAFLVPTPYYPGFDRDLRWRTGVQLFPVVCESSNNFKVTKEALEAAYQKAQESNITVKGLLLNNPSNPLGTILDRETLKDTVRFINEKNIHLVCDEIYAATIFNKPDFISISEVIMEEDVECDRDLIHIVYSLSKDLGFPGFRVGIIYSYNDVVTNCARKMSSFGLVSTQTQFLISNMLSDENFVTKFIGESSERLQKRHGMFTRGLAQVGINTLKSNAGLFIWMDLRRLLKELTFEAELELWRIIINEVKLNVSPGCSFHCSEPGWFRVCFANMDDETMRIALRRINNFVIQRKGIEGGVKKLQCRRSKLEISLSFRKLDDFMNSPHSPMSSPLVQART

SEQ ID NO: 5444 - protein, 312 aa, Saccharomyces cerevisiae
MDSQPVDVDNIIDRLLEVRGSKPGQQVDLEENEIRYLCSKARSIFIKQPILLELEAPIKICGDIHGQYYDLLRLFEYGGFPPESNYLFLGDYVDRGKQSLETICLLLAYKIKYPENFFILRGNHECASINRIYGFYDECKRRYNIKLWKTFTDCFNCLPIAAIIDEKIFCMHGGLSPDLNSMEQIRRVMRPTDIPDVGLLCDLLWSDPDKDIVGWSENDRGVSFTFGPDVVNRFLQKQDMELICRAHQVVEDGYEFFSKRQLVTLFSAPNYCGEFDNAGAMMSVDESLLCSFQILKPAQKSLPRQAGGRKKK

SEQ ID NO: 5445 - protein, 102 aa, Castanea sativa
MAALVGGVSDVKGHENSLQIDDLARFAVDDHNKKANTLLQFKKVVNAKQQVVSGTIYILTLEVEDGGKKKVYEAKIWEKPWLNFKEVQEFKLIGDAPTHHSA

SEQ ID NO: 5446 - protein, 431 aa, Thermus filiformis
MAENAEKFLWGVATSAYQIEGATQEDGRGPSIWDTFARRPGAIRDGSTGEPACDHYHRYEEDIALMQSLGVGVYRFSVAWPRILPEGRGRINPKGLAFYDRLVDRLLAAGITPFLTLYHWDLPQALEDRGGWRSRETAFAFAEYAEAVARALADRVPFFATLNEPWCSAFLGHWTGEHAPGLRNLEAALRAAHHLLLGHGLAVEALRAAGAKRVGIVLNFAPVYGEDPEAVDVADRYHNRYFLDPILGRGYPESPFQDPPPTPNLSRDLELVARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQL

SEQ ID NO: 5447 - protein, 476 aa, Nitrosomonas europaea
MHNFIKKISLVFAGVIAGIMVSLNFSAIADKEIKEELQTLPIEELRTFSQVFGRIKSDYVEPVEDKKLITEAINGMLVGLDPHSAFLDSEEYKELQIGTQGEFGGLGIQVTMEDGLVKVISPIEDTPAFRAGVKTGDLIIKIDDTAVKGMTLNDAIKRMRGKPDTPITLTVIREGEAEPLTFTLVRAIIKIDSVKSKLIEPGYAYVRITQFQERTGENLAEAITKLYSGSKVPMKGLILDLRNDPGGLLNSAVAVSAAFLPSNALVVYTEGRTNDAKMQLRANPEYYLRGSGRDFLANLPQSIKTIPMVTLVNGGSASASEIVAGALQDHKRSIVMGSQTFGKGSVQTILPLSNNTAIKLTTARYFTPNGQSIQAKGITPDILDEETDNDSRLLREADLNRHLSNGQEEKTDKAAASDKKGAQSSKRSKNKADKKQKKHEPMEFGSSDDLLLAKAVNHLKSMAQKSKHKTAKSTQS

SEQ ID NO: 5448 - protein, 436 aa, Unknown
  Thermus sp. IB-21
MTENAEKFLWGVATSAYQIEGATQEDGRGPSIWDAFARRPGTIRDGSTGEPACDHYHRYEEDIALMQSLGVGAYRFSVAWPRILPEGRGRINPKGLAFYDRLVDRLLAAGITPFLTLYHWDLPQALEDRGGWRSRETAFAFAEYAEAVARALADRVPFFATLNEPWCSAFLGHWTGEHAPGLRNLEAALRAAHHLLLGHGLAVEALRAAGTKRVGIVLNFAPVYGEDPEAVDVADRYHNRYFLDPILGRGYPESPFQDSPPVPILSRDLELVARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQTGGSAR

SEQ ID NO: 5449 - protein, 382 aa, Guillardia theta
MSKNDFQITRMNDLVCIEFNSNGISRLRKISRKKIITESRTFPKNYFQKLFDLYFEYSYAKEFKKFPINLINEKDKRQIKKFLDDSIQLRDIRQVDPYFESKPTFWIRNNAILLSLEQIRAIVLFNKLFLFDPDNPKVQRAGKIISEKLEKFQEDSVEDRKTPFEFKALEGIFVNICMNLEKDFSYLEPTILENLDDLPTKLTSRMLEELRSFKQRLSQFSIRSQEVQRILQETLENENNLPNHYLSINNNNKKIKLKTTSDYYAIEIISEGFLQVVEHLTHRAELLDNAIDDTEDLVNIRLDTIRNKILFVELSLNIVSLTLSAGGLVAGLMGMNLGIPIFKEENSSTTFFILVSFLIIFSSLTLYLWLLNWCRIKGLYSI

SEQ ID NO: 5450 - protein, 908 aa, Serratia plymuthica
MTKYSLRARMMILILAPTLLIGLLLSTFFVVHRYNELQEQLVDAGASIIEPLAVASEYGMTFRSRESVRQLVSLLHRRHSDIVRSITVFDAQNNLFVTSNYHHNFAQLQLPKGVPMPTDLMLTRRGNSLILRTPILSESQYPDQNATDPVPQDNNLGYVAIELDLQSVRLRQYKEVFISTLLLLLCMCIAILFAYRLMRDVTGPIRNMVNTVDRIRRGQLDSRVEGFMLGELHMLKNGINSMAMSLTAYLEEMQQNIDQATSDLRETLEQMEIQNVELDLAKKRAQEAARIKSEFLASMSHELRTPLNGVIGFTRQMLKTEMSVTQTDYLQTIERSANNLLTIINDVLDFSKLEAGKLVLEHIPFSLRETLDEVIVLLAPSAHEKGLELTLDVHNDVPEQVIGDSLRLQQIITNLLGNAIKFTETGNIDIRVELRGQQDHQVELEVQIHDTGIGISERQQSQLFQAFRQADASISRRHGGTGLGLVITQKLVKEMGGDICFHSQLNRGSTFWFHITLELHEGMLSLPSSLPDLRGKTLGYIEANPMAAEATLNMLSVTSLVITHSPTLAQLPKKNYDFLLVGVPIPFRDNLAQHESKLKAALNIAGRVILALPCQSQINAEQLKQQGAIGCLIKPITSNRLFPLLRMEPPQRLLAAPERKRLPLTVMAVDDNPANLKLIGTLLAEQVEKTLLCESGEEALALARDNVLDLILMDIQMPNIDGIRTGELIRQLPHHNSTPIVAVTAHAVSGEREHLLQAGMDDYLAKPIDEAMLTRVLARYYSGEPAAEPLLSLDWPLALRQAANKEDLARDLLQMLLDFLPQVSERVQAVLDGTPDDSILDLIHKLHGSCSYSGVPRLKQLCFYLEQQLRKGVGNEELEPEWLELLDEIELVSQAARSHLESDRPTTS

SEQ ID NO: 5451 - protein, 404 aa, Haemophilus influenzae
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEDANWFPAIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIHSDEKMVLDLLRQEKVLLVHGKGFNWHSPDHFRIVTLPYVNQLEEAITKLARFLSDYRQ

SEQ ID NO: 5452 - protein, 481 aa, Arabidopsis thaliana
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVRNFTEGAMYSFPQIRLPTGALQAAKQAGKVPDVFYCLKLLEATGISTVPGSGFGQKEGVFHLRTTILPAEDEMPEIMDSFKKFNDEFMTQYDNNFGYSKM

SEQ ID NO: 5453 - protein, 403 aa, Streptomyces coelicolor
MQVIQSTKLANVCYEIRGPVLEEAMRLEAAGHRILKLNTGNPAAFGFECPPEILEDILRNVSTAHGYGDAKGLLAARRAVVMHNQTLGIETDVEHVFIGNGVSELIVMAMQGLLDDGDEVLVPAPDYPLWTAAVSLSGGTAVHYRCDEQSDWMPDLADVERKITDRTKALVIINPNNPTGAVYDDAMLRGLTDIARRHNLLVCSDEIYDKILYDDATHTPTAAIAPDLLTLTFNGMSKAYRVAGYRVGWMSISGPRAHAESYIEGLTILANMRLCANMPGQHGVVAALSGRQTINELVLPGGRLREQRDAAHEALTSIPGVTCVKPKGALYLFPRLDPKVFKIKDDRRMVLDLLRQEKIMVVQGTGFNWPEPDHFRVVTLPTAADLREAVDRIGNFLDGYSQP

SEQ ID NO: 5454 - protein, 370 aa, Burkholderia fungorum
MSALFSPLTLRSVTLPNRIVVSPMCQYSADRGEATAWHMIHLGSMALSGAGMLCIEATAVEPDGRITPGDLGLWDDVTEAALEPVLAAIRKHSHIKVTMQLSHAGRKASSHVPWEGGQLIPVSQGGWLPHAPSALPHKAGEEPPLALDVPALARIREAFAASARRAARLGIDGLEVHAAHGYLLHQFLSPIANQRDDEYGGSLENRMRFPLEIFDIVRAAFPADKPVGVRVSATDWVEGGWTLADTIAFAQELKKRGCDWIDVSSGGVSPLQKIPLEPGYQIPFAKAVKEATGLTTIGVGLITDPLHAEQLIEAGEADLIALARALLYNPRWPWHAAAQLGATVEAPPQYWRSQPREQKALFGDISFGQR

SEQ ID NO: 5455 - protein, 447 aa, Zea mays
  misc_feature (367)..(367): Xaa can be any naturally occurring amino acid
  misc_feature (374)..(374): Xaa can be any naturally occurring amino acid
MAAAAGDGAGEARARALLQQHRPFATPPGEYHHFGAPSAATDEMVEAVVLRTPLKRKHNDRTENEAAESNDWMSPGYANAGSSPVPTPPSGKGLKASTKPKATKGQKSGPQTPLGFGSPGNPSTPVGGCRYDSSLGLLTKKFLNLLKGAPGGIVDLNNAAETLEVQKRRIYDITNVLEGIGLIEKKLKNNIRWKGVDDSRPGEVSDDMSILQADIDALTLQERNLDERISEMRDRLRGLTEDENNQKWLYVTEEDIKSLPCFQNQTLIAIKAPHGTTLEVPDPDEVNDYPQRRYRIVLRSTMGPIDVYLVSQFEEMSGMETPPRPTQTISMDSLENPRTPLAADCNKVTGMESNIHGGLILPSDAPXSSSQDIXGMMKIVPSELDADTDYWLLSDNTGVSMTNMWETGPDEWDGIEKFNAEDFLEVGTPQQQDKPADVVDDDPSCII

SEQ ID NO: 5456 - protein, 541 aa, Gardnerella vaginalis
MAKIIAYEEDARQGMLAGLDRLANTVKVTLGPKGRNVVLDKSYGAPTITNDGVSIAKEIDLEDPYERIGAELVKEVAKKTDDVAGDGTTTATVLAQSLVHEGLKNVVAGSNPIALRRGIEKASEAIVKELLASAKDVETKDQIAATATISAADPEVGEKIAEALDKVGQDGVVTVEDNNKFGLDLDFTEGMRFDKGYISPYFVTNAEDQTAVLEDPYILLTSGKVSSQQDIVHVAELVMKSGKPLLIIAEDVDGEALPTLVLNKIRGTFNTVAVKAPGFGDRRKAMLQDMAILTGAQVVSDDLGLKLDSIDASVFGHAAKVIVSKDETTIVSGAGSKEDVEARVAQIRAEIENTDSDYDREKLQERLAKLAGGVAVIKVGAATEVEAKERKHRIEDAVRNAKAAIEEGLLPGGGVALVQAAAKVEKSADIVALSGEEATGAAIVFRAVEAPIKQIAQNSGVSGDVVLNKVRELPEGEGFNAATNTYEDLLAAGVTDPVKVTRSALQNAASIAGLFLTTEAVVANKPEKPAAAPQAGAEMGY

SEQ ID NO: 5457 - protein, 227 aa, Arabidopsis thaliana
MGRGKIVIQKIDDSTSRQVTFSKRRKGLIKKAKELAILCDAEVCLIIFSNTDKLYDFASSSVKSTIERFNTAKMEEQELMNPASEVKFWQREAETLRQELHSLQENYRQLTGVELNGLSVKELQNIESQLEMSLRGIRMKREQILTNEIKELTRKRNLVHHENLELSRKVQRIHQENVELYKKAYGTSNTNGLGHHELVDAVYESHAQVRLQLSQPEQSHYKTSSNS

SEQ ID NO: 5458 - protein, 737 aa, Mesorhizobium loti
MRKPRVTAATSGPDGLAPASDVAAIVAGTHGDPFAVLGVHEVGKGLFARCFVPHAETVTAYTLTGIEAGALSRRDDAGFFEGKLSIKKRQPLRYHAHNAGGDWWLTDPYSFGPVLGPMDDYYIAEGSHLRLFDKLGAHVIEHEGATGVHFAVWAPNAKRVSVVGDFNDWDGRRHTMRDRRDTGIWEVFIPDIGAGRPYKYEIIGPDGVRLPLKADPFAFKSELRPATASVVAVPPAHDWGDEAHRNYWRNADPRREAVSIYEVHAGSWQLHDDGTFLSWDELADRLIPYVVETGFTHIEFMPISEHPYDPSWGYQTTGLYAPSARFGDPDGFARFVDGAHRAGVGVILDWVPAHFPVDAHGLAHFDGTALYEHADPRKGFHPDWNTAIYNFGRREVVSFLVNNALFWAEKYHVDGLRVDAVASMLYLDYSRKAGEWIPNEKGGRENLEAVSFLQKMNKEVYGHHPGVMTIAEESTSWPKVSAPVHEGGLGFGFKWNMGFMHDTLEYFSKEPIFRKHHHNDLTFGLTYAFSENFVLPLSHDEVVHGKGTLLSKMAGDDWQKFATLRAYYGFMWGYPGKKLLFMGQEFAQRREWSEARALDWNLLDFRPHRGVWQTVRDLNYLYRSRPALHGRDCEPEGFSWLIVDDSQNSVFAWVRNAPGGSPVAVISNFTPVPRDNYRVPLPKAGKWREIINTDASEYGGSGMGNGGMVEARAEGKNISATMLLPPLSTIMLELVAD

SEQ ID NO: 5459 - protein, 169 aa, Glycine max
  misc_feature (63)..(63): Xaa can be any naturally occurring amino acid
LQVGIVSDMINVSRSMKCFFKGSNNSSLLHFSYNSADQSDSGDGGGIPAFTFYSITSHEKFAXFSMELCLKRLLVLEFMSISYDTSAVKQLHWSTQLYDDEFKDLRDCNLYCVVTHGPVPPRLRDGKSGIDALRFDNQPNPEVLQVYLTTWLAEVNMSLPSMIAMKFIL

SEQ ID NO: 5460 - protein, 497 aa, Methanosarcina acetivorans
MCGIAGVFGTPDSNLKVKKMLAALGHRGPDACGIHTAGDLSIGNTLLKITGDMPQPLTGKGALVLNGEIFNFRELAAEIGIKIDSDTELLFSLIETGVKEGSTPIDAVCSALSKVNGDYALAYACGGELVLARDPSGVKPLFYCSGTEGEKPEIAFASEKKALAFISRKAKPFPQGGILGFNTESGKITEKIPEGYLEIKSPEKRIYTEHEALSQLKETLEKAVELRLTPTTGIAFSGGIDSTFLAALAKRIDPGVSLYAVGLPDSHDITQAERAAEAIGMRKNLKVHFLSPEEIEAAVPRVVYATESTDPMTVAIGIPLYIVAKTAKEDGKRVLLTGQGADELFGGYRRHEEFLKKGAEVLDREIYSDLATISKINLERDDMVTMANSVELRVPFLDKEVIKTGLAIRPELKVLKKDGYYEDGYYERKYILRKAAKGLIPPEILWKEKKAMQYGTGVQKVLDRLARDSGFSKKQESHIEKYLMQIASEKGFEFVNN

SEQ ID NO: 5461 - protein, 644 aa, Nitrosomonas europaea
MCGITGVFDTRSTSEIDRNLLHRMNETLTHRGPDEGEVYVESGLGLGHRRLSIMDVSSGQQPLFNEDGSVVVVFNGEIYNFQKLVGELTALGHRFRTHCDTEVIVHAWEEWGERCVERFSGMFAFGVWDRNRQTLFMARDRLGIKPFYYTLLDNGLFLFASELKALLVHPDFDKTFDHRAIEDYFAYGYIPEPKTIFKNAFKLNPGHLLSLQRGQQTVQSREYWDIPFTPHGSLSEEEAAEELILRLRNAVDSHLMSEVPLGAFLSGGVDSSAVVAMMGGLMKEPVNTCSIAFSDPAFDESDYARLVAERYQTRHFTEQVQQDDFDLIDRLAALYDEPFADSSAIPTYRVCELARKRVTVALSGDGGDENFAGYRRYRWHMIEERLRSKLPLGLRKPLFGLLGSVYPKADWAPKFLRAKTTFESLARDSVEGYFHSVSILDNKLRMQLFTRDFYRDLQGYRAVEVLRDYADKSPTKDALSLIQYLDMKTYLVGDILTKVDRASMAHSLEVRVPLLDHELVEWVSGLPASMKLRQQEGKYILKRSLEPYLPNEVLYRNKMGFSVPLASWFRGPLRERVRTALLGNTLAGTGIFDMGFIKKMLDQHQSGRRDYSAPIWTLLMFEAFLRNILSMGNMSYTGQDKKVA

SEQ ID NO: 5462 - protein, 307 aa, Triticum aestivum
AYLGDISRTSLYKKAGWYRSGIPGISSTHASAHASEMLNDLLVKKNEETGWDTPIHVDAASGGFIAPFLYPELEWDFRLPLVKSINVSGHKYGLVYAGIGWCIWRSKEDLPDELIFHINYLGADQPTFTLNFSKGSSQVIAQYYQLIRLGFEGYRNIMDNCQENAMVLKEGLERTGRFNIVSKDQGVPLVAFSLKDSSRHDEFEISEFLRRFGWIVPAYTMPPDAQHVTVLRVVIREDFSRTFAERLVIDIEKVLHELDALPSRSSGPALQHPNGDTVSEKDLARQREVVSVWKRAVAARKKTQGVC

SEQ ID NO: 5463 - protein, 396 aa, Lycopersicon esculentum
MDGSVPQTDTMMSDVAAPPAQQPPPPSQPLAGMDNIPATLSHGGRFIQYNIFGNIFEVTAKYKPPIMPIGKGAYGIVCSALNSETNESVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRGPELLLNSSDYTAAIDVWSVGCIFMELMDRKPLFPGRDHVHQLRLIMELIGTPSEAEMEFLNENAKRYIRQLPLYRRQSFTEKFPHVNPAAIDLVEKMLTFDPRRRITVEDALAHPYLTSLHDISDEPICMTPFSFDFEQHALTEEQMKELIYRESIAFNPEYQRM

SEQ ID NO: 5464 - protein, 537 aa, Thermobifida fusca
MPKILEFDESARRALERGVNRLADAVKVTLGPKGRNVVIDKKWGAPTITNDGVTVAREVELEDPYENLGAQLVKEVATKTNDAAGDGTTTATVLAQALVNEGLRSVAAGASPILLKRGIDAAAQAVSETLLSRAREIDERGDIAYVATNSAQDKQIGELIAEAFDKVGKDGVITVEESQTFGMDLEFTEGLQFDKGYISPYFVTDPDRQEAVLEDALILIHQGKISNLAELLPLLEKIVQTKKPLLIIAEDVEGDALGALVLNKMRGTLSVAAVKAPGFGERRKAMLQDIAILTGGQVIAEEVGLTLENAELDVLGKARRITVTKDTTTIVDGAGDQSEVNDRINQIRKEIEATDSDWDREKLQERLAKLAGGVCVLRVGAATEVELKERKHRLEDAISATRAAVEEGIIAGGGSALVHAAKTLEGDLGRTGDEATGVAIVRRALVAPARWIANNAGAEGNVVVSRIAELEPGHGYNAATGEYGDLVAQGIIDPVKVTRSAVQNAASIAGMLLTTEALVVEKPEEEENAEGGHGHSH

SEQ ID NO: 5465 - protein, 545 aa, Unknown
  Exiguobacterium sp. 255-15
MAKDILFSEEARRAMLRGVDALADAVKVTIGPKGRNVVLERKFGSPLITNDGVTIAKEIELEDHFENMGAKLVAEVASKTNEIAGDGTTTATVLAQAMIREGLKNVTAGANPMVIRKGIEKAVRRAVEELHAIAKPIEGKEAIAQVAAISAADEEVGQLIAEAMERVGQDGVITIEESRGFTTELDVVEGMQFDRGYASPYMITDSDKMEAVLENPYILITDKKISNIQEILPVLEQVVQQNKPLLIIAEDVEGEALATLVVNKLRGTFNAVAVKAPGFGDRRKAMLEDISIVTGAELITEELGLDLKETQITQLGRASKVVVSKDNTTIVEGNGHSDSITARVGAIRSQIEETTSDFDREKLQERLAKLAGGVAVVKVGAATETELKERKLRIEDALNATRAAVEEGIVAGGGTAFIHVTKAVESILAVTTGDEATGVNIVLRALEAPLRQIAENAGQEGSVIVERLKHEAQGMGYNAATDEYVDMIETGIVDPAKVTRSALQNAASVSAMFLTTEAVIADKPEPAGAPAMPDMGGMGGMGGMM

SEQ ID NO: 5466 - protein, 256 aa, Agrobacterium tumefaciens
MKPLEIDVFLCRSDNFGVLLHDPESGATAAIDAPEEGPILRALDGHGWKLTHIFTTHHHQDHVEANLVLKDKFRCEVHGPYDEAIAIPGLDRSQADGDEFEFAGRRVQVIATPGHTAGHICYYLPDDGLLFAADTLFAMGCGRLFERPAADMWHSFQKLMALPDDTRVYFGHEYTLSNARFALTVDPDNAVLRERAARVETARQANEFTIPTTIGLEKQTNPYMRVADAGIRRHLGLEGAADADVFAEIRTRKDNF

SEQ ID NO: 5467 - protein, 481 aa, Arabidopsis thaliana
MSLKALDYESLNENVKNCQYAVRGELYLRASELQKEGKKIIFTNVGNPHALGQKPLTFPRQVVSLCQAPFLLDDPNVGMIFPADAIARAKHYLSLTSGGLGAYSDSRGLPGVRKEVAEFIERRDGYPSDPELIFLTDGASKGVMQILNCVIRGQKDGILVPVPQYPLYSATISLLGGTLVPYYLEESENWGLDVNNLRQSVAQARSQGITVRAMVIINPGNPTGQCLSEANIREILRFCCDERLVLLGDEVYQQNIYQDERPFISSKKVLMDMGAPISKEVQLISFHTVSKGYWGECGQRGGYFEMTNIPPRTVEEIYKVASIALSPNVSAQIFMGLMVSPPKPGDISYDQFVRESKGILESLRRRARMMTDGFNSCKNVVCNFTEGAMYSFPQIKLPSKAIQAAKQAGKVPDVFYCLKLLEATGISTVPGSGFGQKEGVFHLRTTILPAEEEMPEIMDSFKKFNDEFMSQYADNFGYSRM

SEQ ID NO: 5468 - protein, 198 aa, Zea mays
MWISDSAFVEPSSSSPSASASPPPSPPPARLLRQRNRRRRRSSRKQGSASAVDGVADPEAEDVWRGAQWEAAWPARRDSKPVVLAGGDDAVGRSRSLTDDDLEELKGCADLGFGFNYDEIPELRSTLPALELCYSMSQRLQLDDEKPQQHEGAAPDAATPSPPVTNWKISSPGDSPDEVKARLKYWAQAVACTVRLCS

SEQ ID NO: 5469 - protein, 199 aa, Ceratopteris pteridoides
RNGLLKKAHELSVLCDAEIALIIFSSTGKLFEHSSSRGIKKILERYKRCSGILQDVGGTVIRDVEYWKQEAERLKERLTYMEEIQRNMLGESLGSLQIKDLQNLEAKLDSGLYKIRGAKTQLMVRQVQELQKKEQILLQQNEALRTKLAELSRLQAPVSGLTTATTSQDVQESSSGSGSRQHETSLSAAETTLQLGFAQ

SEQ ID NO: 5470 - protein, 1135 aa, Psychrobacter arcticus
MAYKKRFDTSSAYGQLVILVFLPICLLAAVGGILVFYETMRASNSEQAVLAEAVLIRYSPTIAEIVPELLAQNDAKAQTTENNNESTTNSVLQAAMATLEGIQDKLGRMRAEQHVQRIAIVNQNNEVLATVGYGTDEAWPAVDPSERFLAQQPTPIGTAYGSILGEFDGQTLWLLVDMDSEPLYIARYRIAMALVITGLFTLLILLLSLNIYSKRWIAPIYELRLQLQRTHVDNLYQPIPVESNGELNLLQQDLVRTLRRLYVSFQELKEHAEQTEDDLRLAFDEMEMQNISIRNARDAAISTSQAKSAFLANISHELRTPLNSIDGFINLLARHGELNPEQDLYVQTIRKSSAHLLALVNDVLDFSKIEAGKLVLDRHEFDLYDTIYDVVDMLSPVSAEKGLRMAVLFYNDVPMRVNGDALRLKQVLTNIVGNAIKFTDSGDVVVRVSLDDYQDNYLMISVQDSGKGISLSDQKMLFQSFSQGDPSITRQYGGTGLGLVISKQLTRLMGGDIGFYDNMQENISNQGATFWFRMPAHVDVLEAATGQTIELPVLAPLASATDEFNVLIWINHTASIQVLKASLHHLPITLTQANSLPGLLESLKEHGNYWDWVIVDDDTQDDMMALLKQIRLHYQGKLAVFGYQVAADQALLNRYHANILYEPLDKRQLYAMLDTQKRSVPTGIAEPRWKGVTVLAVDDHLPNLLVLDALLSELGIHVITASNGFDAIEMISKQQTKNIKSAKTEKQSLSKKTQISKAVTRDDVSKSAVSALHIEDTTTEEKGKAQHKNSIDLIFMDIQMPRMSGHEAARQIRKIEAADSHIPIIALTAHGLADERDKLIASGINDYVGKPISQPQLLQVLQKWLGRSASSSPLTAENDEHSQSLSIASGAPPTYQMIRSEQVKSYKPTKMSNEKRVTRPLSLKKIRDDYLRDSQPREDYRRESRRDTQPRYESLRFQEQGQSVFGTRSIQTLDDNKDELLVNTAYLQKNSHLNASVFNTLDILNWQDALMRSANKPDLAAKLIIMMLDTINDEKQALTQAWEAHNRSMLAQIAHRILGGSRYTGVPQLRQASQDLEERCLLNIQHTTPAQFAMLEPYYEALLTALNNLQTLDLSAYPQLNYHRLSENDMTWKMI

SEQ ID NO: 5471 - protein, 359 aa, Streptomyces coelicolor
MSALFEPFRLRDTTIPNRIWMPPMCQYSAAPEGPSAGVPGDWHFAHYGARAVGGTGLIVVEATGVSPEGRISPQDLGLWNDTQVEAFRRITGFLRSQGTVPAVQLAHAGRKASTAQPWRGGAPVGADAYGWQPLAPSALAFDERHPVPTELTVPQIQEAVGRFADAARRALAAGFEIAEIHGAHGYLIHEFLSPHSNQRTDAYGGSYANRTRFALEVVDAVREVWPDDKPLFFRVSATDWLEEGGWTPDDTVRFARDLEAHGIDLLDVSTGGNVPRVRIPTGPGYQVPFAARVKAGSTLPVAAVGLITEPGQAEKILANGEADAVLLGRELLRNPSWAQHAARELGVDARMPDQYGWGM

SEQ ID NO: 5472 - protein, 130 aa, Zea mays
  misc_feature (45)..(45): Xaa can be any naturally occurring amino acid
  misc_feature (115)..(115): Xaa can be any naturally occurring amino acid
YRRIRSDIDEHEGGLEAFSRSYEKFGFNRSAEGITYREWAPGAFXAALVGDFNNWDPNADRMSKNEFGVWEIFVPNNADGTSPIPHGSRVKVRMDTPSGIKDSIPAWIKYSVQAXGEIPYDGIYYDPPEE

SEQ ID NO: 5473 - protein, 357 aa, Unknown
  Brevibacterium sp. HCU
MSHLLFEPLTLRGLTFRNRIWVPPMCQYSVETLDGVPAPWHTVHYGAMARGGAGAVIVEATGVAPEARISAKDLGWNDEQRDAFVPIVDFLHTQGAAAGIQLAHAGRKASTYPEWGTDRDGSLPVDEGGWQTVAPSALAFDGLAEPRALTETEIAEVVAAFRSSARRAIEAGFDFVEIHAAHGYLLHEFLSPLSNNRTDSYGGSLENRARLLLDIVDATRTEVGEDVPVFVRLSATDWTEGGLTLDDTVEVAGWLKEHGVDLIDVSSGGNVMASIPVGPGYQTTLAAGVRQGSGLPTAAVGLISEPFQGEHILATGQADVILVGREYLRDPNFALRAADALRFDIDYRPAQYHRAYK

SEQ ID NO: 5474 - protein, 275 aa, Bifidobacterium longum
MAIQSTIMLNNGTVIPQVGLGVFQTPDGDTTVNAVQTALENGYRHIDTAMIYHNEASVGEGIRRAGVPRSDFFLTTKLWNDDIRARRGKDAFQESLDRLGVDYVDLYLIHWPADGWQQAWDDLQEIYASGRAKAIGVSNFQKHHIDELLTHSDVVPAVDQVESSPQFTNQELIGQLRAKGIHTEAWSPLGGTGGNLLSNPVLAGIGAKYGRSAAQVVIRWHIQRGIVVLPKSTHAERIKQNFEVFDFNLSVDDMTAISAINTGKRNGADPDNFNF

SEQ ID NO: 5475 - protein, 728 aa, Shigella flexneri
MSDRIDRDVINALIAGHFADPFSVLGMHKTTAGLEVRALLPDATDVWVIEPKTGRKLAKLECLDSRGFFSGVIPRRKNFFRYQLAVVWHGQQNLIDDPYRFGPLIQEMDAWLLSEGTHLRPYETLGAHADTMDGVTGTRFSVWAPNARRVSVVGQFNYWDGRRHPMRLRKESGIWELFIPGAHNGQLYKYEMIDANGNLRLKSDPYAFEAQMRPETASLICGLPEKVVQTEERKKANQFDAPISIYEVHLGSWRRHTDNNFWLSYRELADQLVPYAKWMGFTHLELLPINEHPFDGSWGYQPTGLYAPTRRFGTRDDFRYFIDAAHAAGLNVILDWVPGHFPTDDFALAEFDGTNLYEHSDPREGYHQDWNTLIYNYGRREVSNFLVGNALYWIERFGIDALRVDAVASMIYRDYSRKEGEWIPNEFGGRENLEAIEFLRNTNRILGEQVSGAVTMAEESTDFPGVSRPQDMGGLGFWYKWNLGWMHDTLDYMKLDPIYRQYHHDKLTFGMLYNYTENFVLPLSHDEVVHGKKSILDRMPGDAWQKFANLRAYYGWMWAFPGKKLLFMGNEFAQGREWNHDASLDWHLLEGGDNWHHGVQRLVRDLNLTYRHHKAMHELDFDPYGFEWLVVDDKERSVLIFVRRDKEGNEIIVASNFTPVPRHDYRFGINQPGKWREILNTDSIHYHGSNAGNGGTVHSDEIASHGRQHSLSLTLPPLATIWLVREAE

SEQ ID NO: 5476 - protein, 538 aa, Scardovia inopinata
MAKIIKYDEEARQGMLEGLDELANTVKVTLGPRGRNVVLDKTYGAPTITNDGVSIAKEIDLEDPYARIGAELVKEVAKKTDDVAGDGTTTATVLAQSLVHEGLRNVTAGSNPIALRRGIEKASDAIVERLLSNAKPVETKEQIAATATISAGDPEVGDKIAEALDKVGQDGVVTVEDNNKFGLDLEFTEGMRFDKGYISPYFVTNADEQTAVLEDPYILLTSGKVSSQQDIVHIAELVMKSGKPLLIVAEDVDGEALPTLVLNKIRGTFNTVAVKAPGFGDRRKAMLQDMAILTGAQVVSDELGLKLDSIDDTVFGHASKVIVSKDETTIVSGAGSKEDVAARVAQIRSEIEDSDSDYDREKLQERLAKLAGGVAVIKVGAATEVEAKERKHRIEDAVRNAKAAIEEGLLPGGGVALVQAAADVQKNVKLEGDEATGAGIVFRAIEAPLKQIAQNAGFSGEVVIDKVRTLPAGSGLNAATGEYEDLLSAGVTDPVKVTRSALQNAASIAGLFLTTEAVVANKPEPPAPAAAPNPDMGY

SEQ ID NO: 5477 - protein, 520 aa, Arabidopsis thaliana
RESLCLCKRYLSLRRTEETSRINQSINFSELTLDFSFEVMESVPESVPSPNSNTPSIPPPVNSVPPFLSKTYDMVDDPLTNEVVSWSSGNNSFVVWSAPEFSKVLLPKYFKHNNFSSFVRQLNTYGFRKVDPDRWEFANEGFLRGRKQLLKSIVRRKPSHVQQNQQQTQVQSSSVGACVEVGKFGIEEEVERLKRDKNVLMQELVRLRQQQQATENQLQNVGQKVQVMEQRQQQMMSFLAKAVQSPGFLNQLVQQNNNDGNRQIPGSNKKRRLPVDEQENRGDNVANGLNRQIVRYQPSINEAAQNMLRQFLNTSTSPRYESVSNNPDSFLLGDVPSSTSVDNGNPSSRVSGVTLAEFSPNTVQSATNQVPEASLAHHPQAGLVQPNIGQSPAQGAAPADSWSPEFDLVGCETDSGECFDPIMAVLDESEGDAISPEGEGKMNELLEGVPKLPGIQDPFWEQFFSVELPAIADTDDILSGSVENNDLVLEQEPNEWTRNEQQMKYLTEQMGLLSSEAQRK

SEQ ID NO: 5478 - protein, 494 aa, Pisum sativum
MDPYKHRPSSAFNSPFWTTNSGAPVWNNNSSLTVGSRGPILLEDYHLVEKLAQFDRERIPERVVHARGASAKGFFEVTHDISHLTCADFLRAPGVQTPVIVRFSTVIHERGSPETLRDPRGFAVKFYTREGNYDLVGNNFPVFFVHDGMNFPDMVHALKPNPQTHIQENWRILDFFYNFPESLHMFSFLFDDVGVPQDYRHMDGFGVNTYTLINKAGKSVYVKFHWKPTCGVKCLLEEEAIQVGGSNHSHATKDLYDSIAAGNYPEWKLYIQTIDPAHEDRFEFDPLDVTKTWPEDIIPLQPVGRMVLNKNIDNFFAENEQLAFCPAIMLPGIYYSDDKMLQTRVFSYADSQRHRLGPNYLQLPVNAPKWSHHNNHHEGFMNAIHRDEEVNYFPSRHDTVRHAERVPIPTTHLSARREKCNIPKQNHFKQAGERYRTWAPDRQERFLRRWVEALSDTDPRITHEIRSIWVSYWSQADRSLGQKLASHLNMRPSI

SEQ ID NO: 5479 - protein, 537 aa, Bifidobacterium animalis
MAKIIEYDEEARQGMLAGLDKLADTVKVTLGPKGRNVVLDKTYGAPTITNDGVSIAKEIDLEDPFERIGAELVKEVAKRTDDVAGDGTTTATVLAQSLVHEGLKNVVAGSNPIALRRGIEKASDALVKQLVASAKPVETKEQIAATATISAGDPEVGEKIAEALDKVGQDGVVTVEDNNRFGLDLDFTEGMRFDKGYISPYFVTNAEDQTAVLDDPYILLTSSKVSSQQDVVHIAELVMKTGKPLLIVAEDVDGEALPTLILNNIRGTFKSCAVKAPGFGDRRKAMLQDMAILTGGQVVSEDLGLKLDSIDLSVFGTAKKVIVSKDETTIVSGGGSKEDVAARVAQIRAEIEKTDSDYDREKLQERLAKLAGGVAVIKVGAATEVEAKERKHRTEDAVRNAKAAIEEGLVPGGGVALVQAAEKVEKDFNLEGDEATGAAIVFSGIEAPIKQIAENAGLSGAVVIDKVRSLPEGEGFNAATDTYEDLMAAGVTDPVKVTRSALQNAASIAGLFLTTEAVVANKPEPAAAPAAGHNMGY

SEQ ID NO: 5480 - protein, 239 aa, Glycine max
MVQSKKFRGVRQRHWGSWVSEIRHPLLKRRVWLGTFETAEEAARAYDQAAILMSGRNAKTNFPITQTPEGDPKSTTSEDTPSTTSKDLEEILHAKLRKCGKVPSPSMTCLRLDPENSHIGVWQKRAGRRSDSNWVMTVQLGKKSVNVNNNDTHHQADSSSSSSLSSSLPSSEHHHIESPSLAVTGNLHHQEVVRGEIDEEERIALQMIEELLNDRNCPSPSFNNNIQERDGADHDHFFL

SEQ ID NO: 5481 - protein, 137 aa, Zea mays
MKMRNAPLLFPPPCTAPLTVTGPQQRSMAEVHNERPVGMVGGVRDAPVGRENDLEAIELARFAVAEHNSKTNAMLEFERLVKVRHQVVAGTLHHFTVEVKEAGGGEKKLYEAKVWEKAWENFKQLQSFELVGDAAVA

SEQ ID NO: 5482 - protein, 403 aa, Streptococcus agalactiae
MKIFDKSMKLEHVAYDIRGPVLEEADRMRANGEKILRLNTGNPAAFGFEAPDEVIRDLITNARESEGYSDSKGIFSARKAVMQYYQLQNIHVDMDDIYIVNGVSEGISMSMQALLDNDDEVLVPMPDYPLWTACVSLAGGNAVHYICDEEANWYPDIDDIKSKITSKTKAIVLINPNNPTGAVYPREILQEIVDIARQNDLIIFSDEVYDRLVMDGMEHIPIASIAEDIFTVTLSGLSKSHRICGFRVGWMVLSGPRQHVKGYIEGLNMLANMRLCSNVLAQQVIQTSLGGQQSIDSMLLPGGRIYEQRNYIHKAINEIPGLSAVKPNAGLYLFPKIDTDMYRIDNDEEFVLNFLKQEKVLLTHGRGFNMNTADHFRIVYLPRVDELTELQEKMARFLSQYKR

SEQ ID NO: 5483 - protein, 453 aa, Persea americana
MDNKGGILMQRFELGRLLGQGTFAKVYHARNLKSSQSVAIKVIDKEKVLKVGMIDQIKREISTMRLASHPNVVQLYEVMATKTKIYFVLEYVKGGELFNKVAKGKLKEDVAWKYFQQLVSAVDFCHSRGVYHRDLKPENLLVDENENLKVTDFGLGALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIAKIKDNSWFKRGFEAKFAKGETKSKELAPLDTDAAFASSDTGVAARKPELVKPQHLNAFDIISLSAGFDLSGLFEDTNCRKEARFASKQPASAIISKLEDIAKRLRLKVKKKDEGILKLEGSKEGRKGVLSIDAEIFVVNPSFHLVEVKKSSGDTLEYQKLWNQDMRPALTDIVWAWQGDQQQQQESLVCSLGQSL

SEQ ID NO: 5484 - protein, 543 aa, Bradyrhizobium japonicum
MAAKDVKFSGDARERMLRGVDILANAVKVTLGPKGRNVVIEKSFGAPRITKDGVTVAKEIELEDKFENMGAQMVREVASKTNDLAGDGTTTATVLAQAIVREGAKAVAAGMNPMDLKRGIDIAVAAVIKDIEKRAKPVASSSEVAQVGTISANGDAAIGKMIAQAMQKVGNEGVITVEENKSLDTEVDIVEGMKFDRGYLSPYFVTNAEKMTAELEDAYILLHEKKLSGLQAMLPVLEAVVQSGKPLVIIAEDVEGEALATLVVNRLRGGLKVAAVKAPGFGDRRKAMLEDLAILTGGQLISEELGIKLENVTVKMLGRAKKVVIDKENTTIVNGAGKKPDIEARVGQIKAQIEETTSDYDREKLQERLAKLAGGVAVIRVGGATEIEVKEKKDRVEDALNATRAAVQEGIVPGGGVALLRAKKAVGRLTNANDDVQAGINIVLKALEAPIRQISENAGVEGSIVVGKILENKSETFGFDAQNEDYVDMVEKGIIDPAKVVRTALQDASSVAGLLVTTEAMVAEAPKKDAPPAMPAGGGMGGF

SEQ ID NO: 5485 - protein, 546 aa, Azotobacter vinelandii
MAAKEVKFGDSARKKMLVGVNVLADAVKATLGPKGRNVVLDKSFGAPTITKDGVSVAKEIELKDKFENMGAQLVKDVASKANDEAGDGTTTATVLAQAIVNEGLKAVAAGMNPMDLKRGIDKATIAIVAELKSLAKPCSDSKAIAQVGTISANSDESIGNIIAEAMNKVGKEGVITVEEGSGLENELSVVEGMQFDRGYLSPYFINKPDTMVAELDNPLLLLVDKKISNIRELLPVLEAVAKSGRPLLIVAEDVEGEALATLVVNNMRGIVKVAAVKAPGFNDRRKAMLQVIAILTGATVISEKVGLSLESATLEHLGKPKALVLNKENTTIMHGAGAQADIEAAVAQIRKQIEETSSDYDREKLQERLAKLAGGVAVIKVGAATEVEMKEKKARVEAALHATRAAVEEGVVPGGGVALVRALQAIEGLKGDNEDQNVGIALLRRAVEAPLRQIVANAGDEPSVVVDKVKQGSGNFGFNAASGVYGDMIEMGILDPAKVTRSALQAASSIGGLMITTEAMVADIVEDKAAPAMPDMGGMGGMGGMM

SEQ ID NO: 5486 - protein, 392 aa, Heteropterys sincorensis
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIISQSPNVMDLVKCDGAALYFKNKAWFLGVTPTQEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDVEMDAI

SEQ ID NO: 5487 - protein, 561 aa, Sulfolobus solfataricus
MTFGYKLDEDGVTFNLWAPYQRKVKLKILNRGIYEMERDDKGYFTITLDNVRVGDRYKYILDDNSEVPDPASRYQPEGVHGYSEIISPDFEWDDENSVKVKREDLVIYELHIGTFTSEGTFEGVIKKLNYLKELGVTAIEIMPIAQFPGKKDWGYDGVYLYAVQNSYGGPSGFRKLVNEAHKLGLAVILDVVYNHVGPEGNYMVKLGPYFSEKYKTPWGLTFNFDDAGSDEVRKFILENVEYWINEFHVDGFRLDAVHAIIDNSPKHILEDIADVVHKYDKIVIAESDLNDPRVVNPKEKCGYNIDAQWVDDFHHAIHAFLTGERQGYYSDFGSIGDIVKSYKDVFIYDGKYSNFRRKTHGKSVGDLDGCKFVVYIQNHDQVGNRGGGERLIKLVDKESYKIAAALYILSPYIPMIFMGEEYGEENPFYYFSDFSDPKLIQGVREGRRRENGQETDPQSDCTFNDSKLSWKINDDILSFYKSLIKIRKEYGLACNRKLSVENGNYWLTVKGNGCLAVYVFSKSVIEMKYSGTLVLSSNSSFPSQITESKYELDKGFALYKL

SEQ ID NO: 5488 - protein, 392 aa, Heteropterys steyermarkii
DLEPVNPANVPVTAAGALKSYKLASKAISRLQSLPSGNISLLCDVLVKEVRDLTGYDRVMVYKFHEDEHGEAVSECRRSDLESYLGLHYPATDIPQASRFLFMKNKVRMICDCLAPPVKVIQDEKLPQPLSLCGSTLRSPHGCHAQYMTNMGTIASLVVSVTINEDDDMMDGDQQQLTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKVFLEVVKWRSMPWEDVEMDAI

SEQ ID NO: 5489 - protein, 392 aa, Heteropterys ternstroemiifolia
DLEPVNPADVPVTAAGALKSYKLASKAISRLQSLPSGNISLLCDVLVKEVRDLTGYDRVMVYKFHEDDHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGASLNFKNKTWLLGVTPTEEQIRDIAEWLLEYHSGNTGLSTDSLMEAGYPGASVLGDAVCGMAAVSITSRDSLFWFRSHTAKEIKWGGAKHNPDDKDDLRKMHPRSSFKAFLEVVKWRSMPWEDVEMDAI

SEQ ID NO: 5490 - protein, 392 aa, Heteropterys trichanthera
DLEPVNPADVPVTAAGALKSYKLASKAIARLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDAVCGMAAVSITSRDFLFWFRSHTAKEIKWGGAKHHPDDKDDLRKMHPRSSFKAFLEVVKWRSMPWEDVEMDAI

SEQ ID NO: 5491 - protein, 220 aa, Ceratopteris richardii
MGRGKIEMKRIENRTTRQVTFCKRRAGLVKKARELSVLCDADVALIVFSSSGRLFEYAGSRSMREIIQAYVDAHEDSSSLLQLRSEEACVSQDLRAELTELRKEVESLRQEKRRKDGDIHDLKLLSADELDSLEGEVETSLCSIRKRQKQLYREKMNETFRKEEELRKENEKLRKQVEELQCARWEICCAQGFEASATSMCTSHGMTSERSDSFLDLRLN

SEQ ID NO: 5492 - protein, 445 aa, Zea mays
MAEPAAAGRKTRVGPYEVGKTIGEGSFAKVKHAHDSRTGAVRAIKVLDRNHVLRHKMVEQIKREISTLKLIKHPNVVQLHEVMASRTKIYMVLEFVDGGELFDKIVNSGRLGEDEARIYFHQLINVGDYCHSRGVYHRDLKPENLLLASHGTLKVSDFGLSAFAPQTKEDGLLHTACGTPNYVAPEVLADKGYNGMAADVWSCGIILFVLMAGYLPFDDANLMRLYKLICHATFSCPPWFSSGARKFIKRILDPNPDTRIKIAEILEDEWFKKGYKPPHFEQGEDVNLDDVDAAFNDSEDRLVAEKREKPESMNAFALISRSQGFNLGNLFEKEMMGMVKRETSFTSQCTAQEIMSKIEDACGPLGFNVRKQNYKMKLKGDKSGRKGHLSVATEVFEVAPSLHMVELRKTGGDTLEFHNFYKNFSSELKDIVWKAESDASMKQTK

SEQ ID NO: 5493 - protein, 374 aa, Pseudomonas putida
MTQSELFKTTQLGPYTLKNRIVLPPLTRSRSSQPGNIANDLMATYYRQRSGAGFMVTEGTQIEPRGQGYAWTPGIHSPEQIQGWRKVTDAVHAEGGVIFAQLWHVGRVSHTSLQPGGEAPVAPSAIRADNVKVFIETGPGTGALADPSTPRALSTKEVKELVKLYAQAARNALDAGFDGVELHCANGYLVNQFISAHTNQRDDEYGGSLQNRLRFLREITLAVAGVVGKERMGVRFAPLFATTDEDRVYLGLVEEDPHQTYIEAVKILEEVGIAYLSLAEADWENAPELPETFREDVRKSFSGKILYAGKYTAERGNRVIKAGWGDLIAFGRPFIANPDLPARIANNWPLNPVDPSSMYGGTDKGYTDYPTYKS

SEQ ID NO: 5494 - protein, 392 aa, Jubelina wilburii
DLEPVNPADVPVTAAGALKSYKLAAKAISRLQSLPSGNISLLCDVLVKEVRDLTGYDRVMVYKFHEDEHGEVVSECRRSDLEPYLGLHYPATDIPQASRFLFMKNKVRMICDCLAPPVKVIQDERLPQPLSLCGSTLRSPHGCHAQYMTNMGTIASLVMSVTINEDDDTMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTVEQIRDIAEWLLEYHSGNTGLSTDSLMEAGYPGASVLGDAVCGVAAVSITSRDFLFWFRSHTAKEIKWGGAKHDPDDKDDGRKMHPRSSFKAFLEVVKWRSMPWEDIEMDAI

SEQ ID NO: 5495 - protein, 140 aa, Triticum aestivum
  misc_feature (8)..(8): Xaa can be any naturally occurring amino acid
SAFIQGVXFFTNEDYATNSDGLVIHDGTWTYKIPTVDTIPKQFNVELINSAHDQKRVLSSKASGEPPLLLASSVHCAMREAIRAARKEFSVCTGPANSTITFQMDVPATMPIIKELCGLDVVERYLESMSAASPTATAQA

SEQ ID NO: 5496 - protein, 239 aa, Glycine max
  misc_feature (188)..(188): Xaa can be any naturally occurring amino acid
  misc_feature (193)..(193): Xaa can be any naturally occurring amino acid
  misc_feature (207)..(207): Xaa can be any naturally occurring amino acid
  misc_feature (222)..(222): Xaa can be any naturally occurring amino acid
METIGSVDDLLDFSSDIGEEDDYDDKPRKACPSLNSKCAGPSLFNPLVQEFAEEELEWLSNKDAFPSVETFVDLSSIQPGTTKNQKSAPVLECSTGSSNSNNSTNSISLLNSCDHLKVPVRARSKSRSRHRPGLAENSSQQVWWRQPSNGTSKADEGMKISSIGRKCQHCGAEKTPQWRAGPSGPKTXCNACXVRFKSGRLVPEYRXCSSPTFHSDLHSNSXRRSRDEEAEQMGMDKCK

SEQ ID NO: 5497 - protein, 131 aa, Zea mays
  misc_feature (8)..(8): Xaa can be any naturally occurring amino acid
  misc_feature (28)..(28): Xaa can be any naturally occurring amino acid
  misc_feature (118)..(118): Xaa can be any naturally occurring amino acid
LYRRIRSXIDEHEGGLEAFSRSYEKFGXNRSAEGITYREWAPGAFSAALVGDFNNWDPNADRMSKNEFGVWEIFLPNNADGTSPIPHGSRVKVRMDTPSGIKDSIPAWIKYSVQAPGXIPYDGIYYDPPEE

SEQ ID NO: 5498 - protein, 871 aa, Rhodopirellula baltica
MPALLIRCGSTTRGIRSRWSNVAVPSEPMSSVSEFQTSSTYRALANALPLNLLIKAADGRRVFANDSYLKWRGVTWQELAGKHDEDLFPPEIARKYREDDQKVMQTGESLHSVESAKLADDSIGWIERVKTAVHDHHGNLLGVQVLFWDVTAKVEEEKATQFEQSLLKTLLANIPDSIYFKDIDSRFIRVSHAMAMKFGRASVDEVHGRTDADIFTPEHAEGARLDELRVIETGEALVDRVERETWPDREDTWCMTTKMPLRNDTGEIIGTFGISRDITDLKRSEAALHEAVRMADAANRSKSEFLANMSHEIRTPMNALIGMADLLSQTKLDPDQQDYVQIIQESSNGLLRLINDILDFSKIEARRLELESVPFSLGKTIESTLRSFSFKASEKGLELQRDISPELPDRLIGDPGRVRQVLTNLIGNAIKFTDHGGVRVRVEVLRREERADRDLAATHSGRESPERDDMVELRLSVCDSGIGIPPAQQDAVLNPFTQADASTTRRFGGTGLGLSISRQLVELMGGELHLQSEVGVGTTFSFQLKMPVCPASMPNEVDDEEEDLGGPARQRLAPLHVLVAEDGVTNQHVIAGLLRSLGHKCSIASDGRETLTKWRSESYDVVLMDMHMPVMDGLEATRAIRQEEWGTERHTPIVALTAAAMSEDAAACREAGMDSYLTKPIHSRKLRDALAPYQRELPPADDGSHEETLEQAFSPAAHLATEQDSTTINAAHAAFPSLGSTSDAISLSPENIGCLDLDSARSRIPGGTAGVLRLAFVFRTECAQLVDQLSNEIPAGLNDETRRNAHTLKGACGLLGAKQLQEAAERIEEAGRENRVQDSPELLADLQHEAQRVLRAIDELLSQSDNADQPK

SEQ ID NO: 5499 - protein, 412 aa, Debaryomyces hansenii
MPATEIIPLKHTDLFKSIKVGDHTLSNKVVHAPTTRFRALDDHTPSDLEFEYYSKRSQFPGSLLVTEATFVSEQAGLYSNVPGIWEAKHVQAWKKITDEVHKNGSFIACQFWYLGRVGDPKLLKKRGLDFVSSSDNYVDKKSKKYAESVGNPLRALTEDEVHDLVFKTYANAAKNALAAGFDYIELHGAHGYLIDQFLQPSANTRNDKYGGSIEKRAKFVLDLIDHLTSIVGAHRLAIRLSPWAKFQGIKSEEDTVHPITTFSYLLHELQNRADAGNQLAYISIVEPRVQGTISVGEDQQKGNNDFVGQIWKGIILKSGNYTYDAPNFKTMLQDISDNRTLVGFSRYYTSNPDLVKRLYEGWDLVPYDRPTFYTKNNWHYNTFANYEEEDKSIKEEEEKRFAKDIGLLKAHL

SEQ ID NO: 5500 - protein, 72 aa, Oryza sativa
ARWWLEEYKFDGFRFDGVTSMMYTHHGLQVAFTGNYGEYFGFATDVDAVVYLMLVNDLIHGLYPEAVAIGED

SEQ ID NO: 5501 - protein, 282 aa, Mesembryanthemum crystallinum
MSLIANFESDFAVLESIRRHLLEDWDPRAGAPAITTGSGPVYHRNSSFSSLYPCLTDNWGELPLKEDDSEDMVLFGVLRDAVHTGWSPQSGSESGSGSPAPVTVKPEPVDSPVSSPAPVRVAGGEAPVAAAPARGKHYRGVRRRPWGKFAAEIRDPAKNGARVWLGTFETAEDAALAYDRAAFRMRGSKALLNFPLRVNSGEPDPVRITSKRSSPERSVSSSSSESASPKRRKKEEVVVGPVAGQARPGLQQVGNVVEGMQVGVGCQVGVGTMPLGDQLLVT

SEQ ID NO: 5502 - protein, 333 aa, Zea mays
MAIAGRAPNHSPPLSSRPFNPIPSPRLSTHLLSPACARLSSFLPRPLAFAWLHRAGRAGEEKLATSYQLSAGGGSLPAAGVSCKGWELAMGRGRVELKRIENKINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFHPLEAAAEPTLQIGFAPEHMNNFMPAWLP

SEQ ID NO: 5503 - protein, 259 aa, Psychrobacter arcticus
MSIRIHPIKAFNDNYIWILINESNKQAIVIDPGQAAPVVAYLEESELELTSIWTTHHHYDHIGGVAELQESYPMTHLVAHTEHNVDEDQTIKDGSTVSAWGCSVQVWDVSGHTASHVAYILDIDGSKHCFCGDTLFSAGCGRVFTGTIEQLHDSFERLNGLPADTLLYPAHEYTASNLRFGLSIEPDNEAMQQALAQAEDITAQGIPTLPVTLEHERAINVFLRTQEASVIAGVKSEMNIEDEKSLTIFAALRELKNNF

SEQ ID NO: 5504 - protein, 487 aa, Streptomyces coelicolor
MSQRVLTTESGAPVADNQNSASAGIGGPLLIQDQHLIEKLARFNRERIPERVVHARGSGAYGHFEVTDDVSGFTHADFLNTVGKRTEVFLRFSTVADSLGGADAVRDPRGFALKFYTEEGNYDLVGNNTPVFFIKDPIKFPDFIHSQKRDPFTGRQEPDNVFDFWAHSPEATHQITWLMGDRGIPASYRHMDGFGSHTYQWTNARGESFFVKYHFKTDQGIRCLTADEAAKLAGEDPTSHQTDLVQAIERGVYPSWTLHVQLMPVAEAANYRFNPFDVTKVWPHADYPLKRVGRLVLDRNPDNVFAEVEQAAFSPNNFVPGIGPSPDKMLQGRLFAYADAHRYRLGVNHTQLAVNAPKAVPGGAANYGRDGLMAANPQGRYAKNYEPNSYDGPAETGTPLAAPLAVSGHTGTHEAPLHTKDDHFVQAGALYRLMSEDEKQRLVANLAGGLSQVSRNDVVEKNLAHFHAADPEYGKRVEEAVRALRED

SEQ ID NO: 5505 - protein, 295 aa, Unknown
  Frankia sp. EAN1pec
MSTRTHITLNNGVEMPALGLGVFQTPPEETRSAVETALSAGYRHIDTAAAYGNERQVGEAVLKSGVDRTDVFLETKIWISDYGYDQTLHGFEKSARKLGVDQIDLLILHQALPSEFDRTLEAYRALEALLADGKVRAIGVSNFMVEHLTALLERASVVPAVNQIEVHPYFTQREVQAIDTKHGILTQAWSPIGGITFYRAGSHGSTLRDPAIGEIAQAHGRTPAQVMLRWHLQQGRSAIPKSTRPERIAENFDVFDFELTDKQLAVIDGLDTGRRGGPEPSDITLATFSKAIPEA

SEQ ID NO: 5506 - protein, 263 aa, Prunus ilicifolia
AHYKTEVDVGNAIAEAIRSGLVKREELFITSKASNHGHVVEACKNSLEKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRESLVRFCKKHGVTPMAHTPLGGATANVKSFGSISPLEDPVLLGLAKKYKKSVAQIALRWNIERDTPVIPKSSKVERLKENLEVLNFKLEKEDIELINTIDKKSRTTLPSKTWGLDVYA

SEQ ID NO: 5507 - protein, 392 aa, Mascagnia rigida
DLEPVNPADVPVTAAGALKSYKLAAKAISRLQSLPSGNISLLCDVLVREVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQPQMARKLWGLVVCHHTSPRFVPFPLRYACEFLIQVFGVQINKEVELAAQVREKHILQIQTMLCDMLLRDAPVAIITQSPNVMDLVKCDGAALYFKNRTWLLGVTPTEEQIRDIAEWLLEYHSGNTGLSTDSLMEAGYPGASALGDAVCGMASVSITSRDFLLWFRSHTAKEIKWGGAKHDPEDKDDGRKMHPRSSFKAFLEVVKWRSKPWEDIEMDAI

SEQ ID NO: 5508 - protein, 366 aa, Pseudomonas putida
MSALFEPFELKSHCLRNRIAVPPMCQYMANEGLVNEWHHIHYASIARGGAGLVIVEATAVSPEGRITPSCAGLWSDKQGEAFIPIAQAIKAAGSVAGIQLAHAGRKASANRPWEGNGHIAEDDHRGWQTIAPSAIAFGAHLSKVPRAMSLSDIAQVREEFVMAARRALSAGFEWLELHFAHGYLGQSFLSAHSNRRSDGYGGNVENRRRFLIETMSAVREVWPEHLPLTVRLGVIEYDNQDEQTLLEAIALIRQLKNAGADLVNVSTGFNIPNTDTPWAPAFLAPIAERIRHEAGIPVAAAWGIESPALADRLVRDGQADLVMVGRAHLADPHWPYAAARTLGVERPAWVLPPPYAHWLERYTPVE

SEQ ID NO: 5509 - protein, 250 aa, Prunus andersonii
LKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKENLEVLNFKLEKEDIELINTIDKKSRTTL

SEQ ID NO: 5510 - protein, 392 aa, Philgamia glabrifolia
DLEPVNPADVPVTAAGALKSYKLAAKAISRLQSLPSGNISVLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHSQYMTNMGTIASLVMSVTINEDDDTMDGDQQQMTRKLWGLVVCHHTSPRFVPFPLRYACEFLIQVFGVQINKEVELAAQVREKHILQIQTMLCDMLLRDAPVAIITQSPNVMDLVESDGTALYFKNKTWLLGVTPTEEQIRDIAEWLLQYHSGNTGLSTDSLMEAGYPGASALGDSVCGMAAVSITSRDFLFWFRSHTAKEIKWGGAKHDPDDKDDLRKMHPRSSFKAFLEVVKWRSMPWEDIEMDAI

SEQ ID NO: 5511 - protein, 392 aa, Unknown
  Sphedamnocarpus sp. Davis 39-01
DLEPVNPADVPVTAAGALKSYKLAAKAISRLQSLPSGNISVLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHSQYMTNMGTIASLVMSVTINEDDDTMDGDQQQMARKLWGLVVCHHTSPRFVPFPLRYACEFLIQVFGVQINKEVELAAQVREKHILQIQTMLCDMLLRDAPVAIITQSPNVMDLVKSDGTALYFKNKTWLLGVTPTEEQIRDIAEWLLQYHSGNTGLSTDSLMEAGYPGASALGDSVCGMAAVSITSRDFLFWFRSHTAKEIKWGGAKHDPDDKDDLRKMHPRSSFKAFLEVVKWRSMPWEDIEMDAI

SEQ ID NO: 5512 - protein, 275 aa, Escherichia coli
MANPTVIKLQDGNVMPQLGLGVWQASNEEVITAIQKALEVGYRSFDTAAAYKNEEGVGKALKNASVNREELFITTKLWNDDHNRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 5513 - protein, 392 aa, Unknown
  Tristellateia sp. Davis 19-01
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDGRLPQPLSLCGSTLRSPHGCHAQYMANMGTIASLVMSVTINEDDDTMDGDQQQMARKLWGLVVCHHTSPRFVPFPLRYACEFLIQVFGVQINKEIELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDAVCGMASVSITSRDFLFWFRSHTAKEIKWGGAKHDPDDKDDGRKMHPRSSFKAFLEVVKWRSLPWEDMEMDAI

SEQ ID NO: 5514 - protein, 509 aa, Arabidopsis thaliana
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEG

SEQ ID NO: 5515 - protein, 392 aa, Unknown
  Tristellateia sp. Davis 29-01
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLSPPVKVIQDERLPQPLSLCGSTLRSPHGCHAQYMANMGTIASLVMSVTINEDDDTMDGDQQQMARKLWGLVVCHHTSPRFIPFPLRYACEFLLQVFGVQINKEIELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDAVCGMASVSITSRDFLFWFRSHTAKEIKWGGAKHDPDDKDDGRKMHPRSSFKAFLEVVKWRSLPWEDVEMDAQ

SEQ ID NO: 5516 - protein, 131 aa, Zea mays
  misc_feature (77)..(77): Xaa can be any naturally occurring amino acid
LYRRIRSDIDEHEGGLEAFSRSYEKFGFNRSAEGITYREWAPGAFSAALVGDFNNWDPNADRMSKNEFGVWEIFLPXNADGTSPIPHGSRVKVRMDTPSGIKDSIPAWIKYSVQAPGEIPYDGIYYDPPEE

SEQ ID NO: 5517 - protein, 166 aa, Glycine max
  misc_feature (31)..(31): Xaa can be any naturally occurring amino acid
  misc_feature (70)..(70): Xaa can be any naturally occurring amino acid
  misc_feature (100)..(100): Xaa can be any naturally occurring amino acid
  misc_feature (156)..(156): Xaa can be any naturally occurring amino acid
PEGPNSSISSSIKHILLESVPEVVTIRVFVXHVILRAVMSRIVAVAPAVGLFVQLTGRIPPENRDFLIGXVASYATCPALLQLIDSTPAEETPFCSLYNXSVACLRVRGSAVSSKWLTHPDLTALAISGADSKSTAASYHIPFTDTVTPLPTKYGXLVHPLLWQDV

SEQ ID NO: 5518 - protein, 373 aa, Zea mays
  misc_feature (161)..(161): Xaa can be any naturally occurring amino acid
  misc_feature (177)..(177): Xaa can be any naturally occurring amino acid
  misc_feature (191)..(191): Xaa can be any naturally occurring amino acid
MCGILAVLGCSDWSQAKRARILACSRRLKHRGPDWSGLYQHEGNFLAQQRLAVVSPLSGDQPLFNEDRTVVVVANGEIYNHKNVRKQFTGTHNFSTGSDCEVIIPLYEKYGENFVDMLDGVFAFVLYDTRDRTYVAARDAIGVNPLYIGWGSDGSVWIASXEMKALNEDCVRFEIFXPPGHLYSSAGGGFXRWYTPHWFQEQVPRTPYQPLVLREAFEKAVIKRLMTDVPFGVLLSGGLDSSLVASVTKRHLVETEAAEKFGTELHSFVVGLEGSPDLKAAREVADYLGTIHHEFHFTVQDGIDAIEEVIYHDETYDVTTIRASTPMFLMARKIKSLGVKMVLSGEGSDELLGGYLYFHFAPNKEEFHRETCR

SEQ ID NO: 5519 - protein, 309 aa, Cryptococcus neoformans
MSAPTSFKLNNGVEIPAVGLGTWQAPPGQVQAAVAHALKNGYRHLDCALIYQNEAEVGDGIKESGVPRSEIFITSKVWNTHQPNVADGLRQTLEALQTDYLDLYLIHWPVRLVPNESSGLLPVNPDGSRAVDRDWDQSETWRQMEEVYASGKVKAIGVANWSIPYLEELKKTWKIVPAVNQVELHPFLPQHKLVKYCRDLGILLEAYSPLGSTNAPLLSDPEINAIAEKYKTSPATICISYQVNRGIVVLPKSVSPKRIEDNLKTIPIEKEDMVKLDGMAAAGKAQRINTPKWGWDLGFDDWYGPVKQQ

SEQ ID NO: 5520 - protein, 389 aa, Arabidopsis thaliana
MNHNSNLVLPSHQTETQTQDETDISVWRFRGSDNAAKASSVTMRVIVYKLFDECSLDVKKPLLPLAHGDPSVYPCYRTSILVENAVVDVLRSGKGNSYGPAAGILPARQAVADYVNRDLTNKVKPNDVFITVGCNQGIEVVLQSLARPNANILLPRPSYPHYEARAVYSGLEVRKFDLLPEKEWEIDLPGIEAMADENTVAMVIINPNNPCGNVYSYDHLKKVAETAKKLGIMVITDEVYCQTIFGDKPFVPMGEFSSITPVITLGGISKGWIVPGWRIGWIALNDPRGILKSTGMVQSIQQNLDITPDATTIVQAALPEILGKANKELFAKKNSMLKQNVELVCDRLKEIPCLVCNKKPESCTYLLVPPPTSLILFHDSRSIWMILIS

SEQ ID NO: 5521 - protein, 568 aa, Oryza sativa
MMAAEGIIVQSFNADLLYEPWEVVDDEGQSFTMFAPFWNRCLSMPYDPAAPLLPPKRINSGDLSMCPSDDLIFEDDSEEGSNALLARAWSPGWQNRDKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDRANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPRTEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 5522 - protein, 468 aa, Thiobacillus denitrificans
MTQKSKFVLVGVAGVLAGAALTLNLSAIADKEAGAPLPIEELRAFTDVFARVKNDYVEPVEDKKLITEAINGMLTGLDPHSAYLDVEGFKDLQVGTQGEFGGLGIEVGMEEGFIKVVSPIEDTPAFKAGVKPGDLIVKLDDTPVKGMALNDAVKRMRGKPGSKIRLTVARKGVDKPIVLTLTRAIIKIRSVKSKLMESGYGYVRVTQFQEHTGELLAEALNALYKNNKAPLKGLILDLRNDPGGLLNGAVAVTAAFVKPDALVVYTEGRTPDAKMQLTARRENYLRPMQADYLKNLPQGVKQVPMVVLVNSGSASASEIVAGALQDHKRAVVMGTRTFGKGSVQTILPLGNGTAIKLTTARYFTPNGRSIQAKGIEPDIVVEDPSMPSEDDGLGIREADLAKHLANPSDKEGTSIVVPADDEAGPAEQPSRERKPLAPLEPGEIVSKNDFQVNQALNLLKGLQILQAH

SEQ ID NO: 5523 - protein, 285 aa, Saccharomyces cerevisiae
MKFLLQQIRNMHVKPIKMRWLTGGVNYSYLLSTEDRRNSWLIDPAEPLEVSPKLSAEEKKSIDAIVNTHHHYDHSGGNLALYSILCQENSGHDIKIIGGSKSSPGVTEVPDNLQQYHLGNLRVTCIRTPCHTKDSICYYIKDLETGEQCIFTGDTLFIAGCGRFFEGTGRDMDMALNQIMLRAVGETNWNKVKIYPGHEYTKGNVSFIRAKIYSDIGQNKEFDALEQYCKSNECTTGHFTLRDELGYNPFMRLDDRAVRLAVGDTAGTYPRSVVMQELRKLKNAM

SEQ ID NO: 5524 - protein, 486 aa, Burkholderia pseudomallei
MSSSISIAPAVVWFRDDLRVSDHPALMRAAESGRPVIGVYVFDERAGGRPLGGAARWWLHGSLRALGAALAALGGTLALLRGDEHDTIVSFAAALGAGAVYWSRRYALAARAVDNAVQTALDAQGIAVETFNASLLFEPGDLVNADGRPYQVFSAYWRAAMRRGVPAPPLGAPRRLNGGALPAALARQCVALDALGLEPTGPDWAGGLRDAWRFGEDAAHRRLRAFVDSRLGGYAAERDRPGIASTSRLSPYVRFGNLSARQLWHAAADAYAHGAATQADLDKFLSELGWREFGWTQLHHFPDLPRRNLRHTLDGMPWRDDPAALAAWRRGATGYPFVDAGMRELWATGWMHNRVRMVCASFLVKHLLIDWRAGEAWFWDTLVDADAASNAANWQWVAGCGADAAPYFRIFNPVAQGRKFDPDGAYVRRWVPELAGLPPATIHEPWAAPGAQLAAAGVRLGETYPLPIVAHDAARRRALDAFGAIR

SEQ ID NO: 5525 - protein, 251 aa, Prunus andersonii
AHYKSEADVGNAIAEAIQRGLVKREELFITSKASNHGHVVEACKNSLKKLQLDYLDLYLVHYPLATKHSVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKENLEVLNFKLEKEDIELINTIDKKSRTTL

SEQ ID NO: 5526 - protein, 252 aa, Prunus mexicana
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNLERGTPVIPKSSKVERLKENLEILNFKLEKEDIELINTIDKKSRTTL

SEQ ID NO: 5527 - protein, 214 aa, Citrus limon
IDFRPVKPYEVPMTAAGALQSYKLAAKAITRLQSLPSGSMERLCDTMIQEVFELTGYDRVMAYKFHEDDHGEVVSEITKSGLEPYLGLHYPATDIPQAVRFLFMKNKVRMIVDCRARHVKVLQDEKLPFDLTLCGSTLRAPHSCHLQYMENMNSIASLVMAVVVNDEEEEGDNTLPQKRKRLWGLVVCHNTTPRFVPFPLRYACEFLAQVFAIH

SEQ ID NO: 5528 - protein, 251 aa, Prunus fasciculata
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCQKHGVVPMAHTPLGGATANVKAFGSISPLEDPVLIGLAKKYQKSVAQIALRWNIERGTPVIPKSSKVERLKENLEVLNFKLEKEDIELINTTDKKSRPL

SEQ ID NO: 5529 - protein, 256 aa, Rhodospirillum rubrum
MSTLDIHQIAVLSDNYIYLVRCRATGACAVIDPSLAEPVLAAAESLGWTITHILNTHHHYDHTGGNEEIKAATGCEIIGFAGDAHRLPGIDRTVVEGDRVAIGQAEARVIETPGHTLGHIAYWFAESSALFCGDTLFSAGCGRLFEGSAGQMWDSLRKLRALPAQTLVFCGHEYTQPNITFALTIDPRNEALRARALEVDALRAAGRPTVPAFLGDEARSNPFLRADSADFQEAFGMTGADPVEVFARTRLKKDHF

SEQ ID NO: 5530 - protein, 446 aa, Xanthomonas oryzae
MPDSSDGGAAYYCAMQQSRKVRHRSRFSTNASAIAVTLPSTGWRRCVLSASLESARVRHHCYGAPRSARRRAWRVITFDWLLMSKSTQSPLFSPVRLGALDLANRVVMAPLTRNRAIAGQVPSPLAAEYYGQRATAGLIVAEGTQISPLGQGYLDTPGIYTKEQIQGWRAVTDEVHRRGGKIVLQLWHVGRVSHTSVLPPGEVPVAPSAIRAEGKTFTKNGFEDVSEPRALALDEIPGLIEDYRIAARNAIDAGFDGVEVHAANGYLLDQFLRDSSNQRTDAYGGDIENRTRLLAEVVQAIADEIAAERTGVRLSPVTPVYGAHDSNPQPLFERAVERLNLIGGLAFVHVIEGATGGPRDNIAFDYAALRAKFDGAWIANNGYDRGMSEHAISSDYADAIAYGRPFIANPDLVRRLRENAPLAELDQATMYGGGAKGYTDYPALPE

SEQ ID NO: 5531 - protein, 252 aa, Prunus fasciculata
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCQKHGVVPMAHTPLGGATANVKAFGSISPLEDPVLIGLAKKYQKSVAQIALRWNIERGTPVIPKSSKVERLKENLEVLNFKLEKEDIELINTIDKKSRTTL

SEQ ID NO: 5532 - protein, 392 aa, Verrucularia glaucophylla
DLEPVNPADVPVTAAGALKSYKLAARAISRLQSLPSGNISLLCDVLVKEVRDLTGYDRVMVYKFHEDEHGEVVSECCRPDLDAYLGLHYPATDIPQASRFLFMKNKVRMICDCLAPPVKVIQDQRLPQPLSLCGSTLRSPHGCHAQYMANMGTIASLVMSVTINEDDNIVDDNQLRMERKLWGLVVCHHTGPRFVPFPLRYACEFLIQVFGVQINKEVELAAQVTEKHILRTQTLLCDMLLRDAPVAIITQSPNVMDLVKCDGAALYYRKKFWLLGVTPTEAQIRDIAEWLLEYHSGNTGLSTDSLMEAGYPGASVLGDAVCGMASVKISSRDFLFWFRSHTAKEIKWSGAKHDPGDKDDIRKMHPRSSFKAFLEVVKWRSLPWEDMEMDAI

SEQ ID NO: 5533 - protein, 252 aa, Prunus subcordata
AHYKSEADVGNAIAEAIHSGLVKREELFITSKASNHGHVVEACKSSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNIERGTPVIPKSSKVERLKENLEILNFKLEKEDIELINTIDKKSRTTL

SEQ ID NO: 5534 - protein, 556 aa, Emericella nidulans
MLEDPSYAEIVRWGDDGDSFVVLECEKFTKTILPKHFKHSNFASFVRQLNKYDFHKVRQNNEENGQSPYGQNAWEFKHPEFRANSKESLDNIRRKAPAPRKQAQAHDDSVPTQQIDLLNQQIVAQQQQIQHISDRYAQMSVDHQLMLQEVLRVQKTVVNHENVIHQLVNYLVSIDARQKRDNKAGSFQAQVGASPSQVTPMDDGVSTPLQQASKLLSDMNAEVQFNLVPVESMGEPPKTGVVSTPTMETAPRRMEPVVYPVGATNGIDPMYGEHVNNVPYTVPPKQDMDDRRQFPDNRKKSNHVDPGWMRSPRILLVEDDATCRQIGGKFLYSFSCEIDTALDGLEAVNKVQDGSKYDLILMDIIMPNLDGVSACHLIRQFDRTPIIAMTSNIRSDDIQALLPAWYAASVICSRMDDVLPKPFTRKSLLEMLEKHLVHLKTVPQGMEGHQATTPVTIAGQSSAAQSVTIKEDTSSPSQSPAAAMTAWQSPNQFQPMAAVPANLQQVQGQYVPANPATTAYAMDQEWYAISSTAYGSDGRCWARSKCDRSHVGTSLN

SEQ ID NO: 5535 - protein, 131 aa, Zea mays
  misc_feature (89)..(89): Xaa can be any naturally occurring amino acid
LYRRIRSDIDEHEGGLEAFSRSYEKFGFNRSAEGITYREWAPGAFSAALVGDFNNWDPNADRMSKNEFGVWEIFLPNNADGTSPIPHGXRVKVRMDTPSGIKDSIPAWIKYSVQAPGEIPYDGIYYDPPEE

SEQ ID NO: 5536 - protein, 428 aa, Clostridium perfringens
MSRNKDEKNKYNNIIKNLKKKKGFRALAMGVALTLIIGVSVYAGNRLTAFGILPITSVSAVQSSLEKVNDTENFKKVLEVREMLYRWYDGEIDDSKLAEGAIKGMVSSLGDQYTYYMNEKEFSDFKEKSQGNYMGIGIQVAVKDGKIVVISPIQGGPAEKAGIKTGDIILKVNGEPVSGNELDKAVSMMKGTTKENIKLTLYREGKGEFDVDVMRDVIKTFNVKSEMIDGDIGYIEVLAFDEGTAKDFETQLKALEEKGMKGLILDLRGNPGGFMKECVDLVSNFVPKDKVIVSTIDKYGNKEESVSKGGIAQGMPLVVLIDGGTASASEIVAGAIRDYDLGTLVGTTSFGKGIVQVVLDKIGQEKDGTALKVTISKYYTPNGENIHKKGIGPDVTIEYPKELKEKTYSRSTDPQFEKALEIIQEKIK

SEQ ID NO: 5537 - protein, 547 aa, Xylella fastidiosa
MAAKEIIFSEKARSRMVHGVNLLANAVKATLGPKGRHVVLDKSFGSPIITKDGVSVAKEIELADKFENMGAQMLKEVASKTNDHAGDGTTTATVLAQALIREGCKAVAAGMNPMDLKRGIDKAVIAAVTELKKISKPTSDDKAIAQVATISANSDESIGNIIAEAMKKVGKEGVITIEEGTTLENELDVVEGMQFDRGYSSPYFINNQQSQIVELDNPYILLHDKKISSVRDLLTVLDAVAKESKPLLIVAEEVEGEALATLVVNNIRGIIKVCAVKAPGFGDRRKAMLEDMAVLTGGTVISEEVGLSLEKATTSHLGKAKKVRVSKENTTIIDGMGDNDAINGRVKQIKTQIEETTSDYDREKLQERVAKLAGGVAVIKVGAATEVEMKEKKARVDDALLATRAAVEEGVIPGGGVALIRAITAISNLKGANEDQTHGIQIALRAMEAPLREIVANAGEEPSVILNKVKEGKDNFGYNAATGEFGDMVNLGILDPTKVTRSALQNAASIAGLMITTEAMVAEAPKKDEPTPPAAGGGMGGMGGMDF

SEQ ID NO: 5538 - protein, 546 aa, Unknown
  Burkholderia sp. 383
MAAKEIIFSDVARAKLTEGVNILANAVKVTLGPKGRNVVLERSFGAPVVTKDGVSVAKEIELADKLQNIGAQLVKEVASRTSDAAGDGTTTATVLAQAIVREGQKYVAAGLNPLDLKRGIDKAVAAAVDELKKISRPTTTSKEIAQVATISANGEESIGQRIAEAIDRVGKEGVITVEDGKSLADELDVVEGLQFDRGYLSPYFINNPDKQIAEIESPYILLHDKKISNIRDLLPVLEQVAKSGRPLLIIAEDVEGEALATLVVNNIRGILKTVAVKAPGFGDRRKALLEDIAILTGGQVIAEETGLTLEKATLAELGQAKRIEVGKENTTVIDGAGDAKNIEARVKQIRVQIDEATSDYDREKLQERVAKLAGGVAVIKVGGATEIEVKEKKDRVDDALHATRAAVEEGIVPGGGVALIRVRQAIRELQGVNADQNAGIKIVLRALEEPLRQIVTNAGEEASVVVAKVAEGSGNFGYNAQTGVYGDLVESGVLDPTKVTRTALQNAASVAGLLLTTDATVFEAPKDAAPTAAPGGPGAGGPGFDF

SEQ ID NO: 5539 - protein, 131 aa, Zea mays
  misc_feature (9)..(9): Xaa can be any naturally occurring amino acid
LYRRIRSDXDEHEGGLEAFSRSYEKFGFNRSAEGITYREWAPGAFSAALVGDFNNWDPNADRMSKNEFGVWEIFLPNNADGTSPIPHGSRVKVRMDTPSGIKDSIPAWIKYSVQAPGEIPYDGIYYDPPEE

SEQ ID NO: 5540 - protein, 563 aa, Xylella fastidiosa
MCSIFGIFNLQPSDNLQILRHQALECSQRQRHRGPDWSGVYVDVGAILVHERLAIVDPAGGAQPLFSEDGTLALAVNGEIYNHAVLKGTLQQPYAFQTHSDCEVINALYREETPTSFLNRLNGIFAFALWDKTTGRGLIARDPMGVVPLYWGHDQDGRLRVASEMKALVEHCPDVAQFPPGHWYDTTTGTLVKYYERPWKNYSAVEGVQVSLQELREAFERAVHRQLMTDVPYGVLLSGGLDSSLVAAVAARYARHRIETNDQSEAWWPRLHSFAIGLKDSPDLSAANVAAEALNTVHHRFEYTFQEGLDVLPEVIRHIETYDVTTIRASTPMFLLARRIKAMGVKMVLSGEGSDEIFGGYLYFHKAPNAREFHEELVRKLNALYYYDCLRANKAMMAWGVEPRVPFLDREFLDVAMRMDAQHKMVDKTSNGPQRMEKGILRAAFDGYLPPSILWRQKEQFSDGVGYGWIDGLKAHAETQVSDHALATAETRFQVNPPQTKEAYYYRSIFERFFPSPAAAETVPGGKSIACSSPAAIAWDASFATMADPSGRAVSGVHQQALL

SEQ ID NO: 5541 - protein, 254 aa, Legionella pneumophila
MTILPISAFSDNYIWTFIDKIAGVLDCVDPGEAAPIIRFAQSNQLTLRTILLTHHHYDHIGGVDSLIKQWPSCKVYGPIDERINNVTHPIKQGQSVQVGSLHFHILFNPGHTSTHISYYEPQQGWLFCGDTLFSAGCGRVFDGTIEELHESLLLFKKLPRNTKVFCAHEYTFQNLKFAHTVEPCNSSVINYMQQILKQPSSCTLPSNIDLELSINPFLRTDKEQVKQYALSHGANSSDSLDVFKVLRNQKNSFK

SEQ ID NO: 5542 - protein, 122 aa, Zea mays
DEHEGGLEAFSRSYEKFGFNRSAEGITYREWAPGAFSAALVGDFNNWDPNADRMSKNEFGVWEIFLPNNADGTSPIPHGSRVKVRMDTPSGIKDSIPAWIKYSVQAPGEIPYDGIYYDPPEE

SEQ ID NO: 5543 - protein, 565 aa, Bacteroides thetaiotaomicron
MKKLLNRRIALVLVAVIATVAFFSFKSGDDRNFQIAKNLDTFNAIVKELDMFYVDTIDPNKTIREGIDNMLFSLDPYTEYYPEEDQSELEQMVKGSFGGIGSLITYNTKLKRSMIAEPFEGTPAAKAGLKAGDILMEIDGKDLLGKNNSEVSQMLRGQAGTSFKLKVERPNEKGGQTPMEFTIVRESIQTPAIPYATVMDNKVGYISLSTFSGNPSKDFKKALLDLKKQGATSLVIDLRNNGGGLLDEAVEIANYFLPRGKVIVTTKGKTKQASNTYKTLREPLDLDIPIAVLVNSGTASASEILSGSLQDLDRAVIVGNRTFGKGLVQVPRSLPYGGMMKVTTSKYYIPSGRCVQAIDYKHRNEDGSVGTIPDSLTNVFYTAAGREVRDGGGVMPDITVKQEKLPNILFYLVRDNLIFDYATQYCLKHPTVAAPEKFVVTDADYNDFKELVKKADFKYDQQSEKILKTLKEAAEFEGYMTDAAEEFKALEKKLNHNLDRDLDYFSKDIKRMIANEIIKRYYFQRGGIIEQLKDDDDLQEAIKVLNDPAKYKEMLSAPITKAEKK

SEQ ID NO: 5544 - protein, 374 aa, Arabidopsis thaliana
MEMVNAEAKQSVPLLTPYKMGRFNLSHRVVLAPLTRQKSYGSVPQPHAILYYSQRTSPGGFLIAEATGVSDTAQGYPDTPGIWTKEHVEAWKPIVDAVHAKGGIFFCQIWHVGRVSNRGFQPRRQAPISCTGKPIMPQMRANGIDEARFTPPRRLSIEEIPGIVNDFRLAARNTMEAGFDGVEIHGAHGYLIDQFMKDKVNDRTDEYGGSLQNRCKFALEVVDAVAKEIGPDRVGIRLSPFADYMESGDTNPEALGLYMVESLNKYGILYCHMIEPRMKTVGEIAACSHTLMPMREAFKGTFISAGGFTREDGNEAVAKGRTDLVAYGRWFLANPDLPKRFQLDAPLNKYNRSTFYTSDPVVGYTDYPSLESTA

SEQ ID NO: 5545 - protein, 512 aa, Xanthomonas oryzae
MSECFMRVAVLSVALSLALFASPGWAQKAGPAAAQATADDPEANEAAVSKVPLDEIRRFVAVYNAVKQAYVDPVEDKKLMHAAVRGLLSDLDPHSTYFDKEDAEAFDEQATGAYDGIGVELLQQQDNTLKVIAPIDDTPAARAGIRAGDVIVAIDGKPIDASKAMEPLRGASGSKVVLTIVRDKTPKPFDVTLQRETIRVASVRSKMLEPGYGYIRISTFQADTGADFQKNLKQLQAGGKLRGLVLDLRSNPGGLLTSAVQVADDLLDKGNIVSTRGRISISDAKFDATPGDLVNGAPVVVLVDAGSASASEVLAGALRDNKRARIIGSRTFGKGSVQTVLPLDNGDSVKLTTARYYTPSGKSIQASGIVPDVMLTPEPQPGDADVPASLTDYNEATLPGHLRGDDEGEEGYSAGDVLPGDGPISEALAELKQPGSAAKAQAARKAKAQAAQKAKAAKTGAEPKPAAARPATTDKPKSAEPAGKAKPATAPTAPTEPAQPTPPADKPAEPVN

SEQ ID NO: 5546 - protein, 593 aa, Schizosaccharomyces pombe
MVKRHKNTIGVWRLGKTLGTGSTSCVRLAKHAKTGDLAAIKIIPIRYASIGMEILMMRLLRHPNILRLYDVWTDHQHMYLALEYVPDGELFHYIRKHGPLSEREAAHYLSQILDAVAHCHRFRFRHRDLKLENILIKVNEQQIKIADFGMATVEPNDSCLENYCGSLHYLAPEIVSHKPYRGAPADVWSCGVILYSLLSNKLPFGGQNTDVIYNKIRHGAYDLPSSISSAAQDLLHRMLDVNPSTRITIPEFFSHPFLMGCTSLSSMDSTTPPTPSLSIDEIDPLVVDCMCVLWKKSSSKKVVRRLQQRDDNDEKYVYKVLSEILRDDMLKKQRFDENKYLSLYDLIHDNNLFTKASISTTSLVKSNVSTNSRKSSNFEDELARRVSSPLSALNQMSQSPIPIRVSSDKDYDSYACHEVVSNPSTLDDDYNYMFVCPPEEYTYSTDNVRTDSLDLQSLPTPTLEQLESVPFNRYGYVRIFPSTTLSSTASGYYTPDSLSTPEPSIDGLTNLDDVQVGGFVQGSGNQNRRPISFPVISNMQPNITNVRSASAPLCSSPVPSRRYSQYATNIRYTPRKVSSGSVLRKISSFFRKD

SEQ ID NO: 5547 - protein, 252 aa, Prunus pumila
AHYKSEADVGNAIAEAIQSGLVKREELFITSKASNHGHVVEACKNSLKKLQLDYLDLYLVHYPLATKHSGVGTTASLLGENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKGNLEILNFKLEKEDIELINSIDKKSRTTL

SEQ ID NO: 5548 - protein, 252 aa, Prunus salicina
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVIPMAHTPLGGATANVKAFGSISPLEDPVLIGLAKKYQKSVAQIALRWNLERGTPVIPKSSKVERLKENLEILNFKLEKEDIELINTIDKKSRTTL

SEQ ID NO: 5549 - protein, 148 aa, Arabidopsis thaliana
MASLEMNDLKKIGLGLTGFGVFFTFLGVIFVFDKGLIAMGNVGLFIPSLILFLAGVTLTIGINPAIQFFTKRQNFKGTISFGLGFLLVVFGWPIFGLLLESYGFLVLFSGFWPTLAVFLQRIPLLGWLLQQPYIRSLLDRYRGRRVPV

SEQ ID NO: 5550 - protein, 252 aa, Prunus armeniaca
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYKRSVAQIALRWNLERGTPVIPKSSKVERLKENLEILNFKLEKEDIELINTIDKKSRTTL

SEQ ID NO: 5551 - protein, 728 aa, Escherichia coli
  misc_feature (490)..(490): Xaa can be any naturally occurring amino acid
MSDRIDRDVINALIAGHFADPFSVLGMHKTTAGLEVRALLPDATDVWVIEPKTGRKLAKLECLDSRGFFSGVIPRRKNFFRYQLAVVWHGQQNLIDDPYRFGPLIQEMDAWLLSEGTHLRPYETLGAHADTMDGVTGTRFSVWAPNARRVSVVGQFNYWDGRRHPMRLRKESGIWELFIPGAHNGQLYKYEMIDANGNLRLKSDPYAFEAQMRPETASLICGLPEKVVQTEERKKANQFDAPISIYEVHLGSWRRHTDNNFWLSYRELADQLVPYAKWMGFTHLELLPINEHPFDGSWGYQPTGLYAPTRRFGTRDDFRYFIDAAHAAGLNVILDWVPGHFPTDDFALAEFDGTNLYEHSDPREGYHQDWNTLIYNYGRREVSNFLVGNALYWIERFGIDALRVDAVASMIYRDYSRKEGEWIPNEFGGRENLEAIEFLRNTNRILGEQVSGAVTMAEESTDFPGVSRPQDMGGLGFWYKWNLGWMHDTXDYMKLDPVYRQYHHDKLTFGILYNYTENFVLPLSHDEVVHGKKSILDRMPGDAWQKFANLRAYYGWMWAFPGKKLLFMGNEFAQGREWNHDASLDWHLLEGGDNWHHGVQRLVRDLNLTYRHHKAMHELDFDPYGFEWLVVDDKERSVLIFVRRDKEGNEIIVASNFTPVPRHDYRFGINQPGKWREILNTDSMHYHGSNAGNGGTVHSDEIASHGRQHSLSLTLPPLATIWLVREAE

SEQ ID NO: 5552 - protein, 274 aa, Clostridium acetobutylicum
MLDINSFTVLNNGVKMPWLGFGTYKIEYEESSVDYIKTALKVGYRHLDTAAVYGNEPIVGKAVKESGIPRNEIFITSKVWNNKHGYDKTLKAFEDTLKRLDTDYLDLYLIHWPKTLNKETWKALEKLYKDGRVRAIGVSNFKVHHLEEILEDCEIVPMVNQVEYHPQFPQTEVHEFCKKNKIQLESWGPLMQGKIFDIPLMKELSLKYGKTISQIALRWDLQMGVVTIPKSINENRIKENCDLYDFEISKEDMKKIESLNTGVRIGHDPDTITF

SEQ ID NO: 5553 - protein, 167 aa, Pyrococcus furiosus
MVRRIRRWDIWDPFDLIREIQEEIDAMFDEFFSRPRLWTYRRWSEPAMYEERVGEVWREPFVDIFDNGDEFVITAELPGVRKEDIKVRVTEDTVYIEATVKREKELEREGAVRIERYFTGYRRAIRLPEEVIPEKAKAKYNNGVLEIRVPKKHPTKKESEGFEVKVE

SEQ ID NO: 5554 - protein, 134 aa, Zea mays
MRKHRIVSLVSALLILLALAVSSTRNAQEDSMANNTGTLVGGIQDVPGSENDLHLQELARFAVDEHNKKANALLGFEKLVKAKTQVVAGTMYYLTIEVKDGEVKKLYEAKVWEKPWENFKELQEFKPVEECASA

SEQ ID NO: 5555 - protein, 364 aa, Methanosarcina barkeri
MAEDTDLFSQYRMGDLTLPNRIVMAPMTRNRAGDDDIPVPLTVTYYVQRASAGIIITEGSQVSPQGVGYMHTPGIYSAAQVAGWKKVTDAVHREGGRIFIQLWHVGRVSHPDLLGGALPVAPSALPVEGFTHASGGKKPIPVPRALKTEEVPDIVRQFRQAAENAKTAGFDGVEIHGANTYLLDQFLRSGSNKRTDKYGGSLENRTRLPLEVTKAVIEVWGGDRVGYRISPHNNAHSMSDENPLETFSYFARELNKTGLGYLHLIEPIGGRMGFAPPEARLGPILRRIFERTFILNGGYGLHSGNEAIANGEADLIAFGVPFLANPDLPERFRQNAPLNEPDESTFYVGGAKGYTDYPALVVHR

SEQ ID NO: 5556 - protein, 131 aa, Zea mays
LYRRIRSDIDEHEGGLEAFSRSYEKFGFNRSAEGITYREWAPGAFSAALVGDFNNWDPNADRMSKNEFGVWEIFLPNNADGTSPIPHGSRVKVRMDTPSGIKDSIPAWIKYSVQAPGEIPYDGIYYDPPEE

SEQ ID NO: 5557 - protein, 509 aa, Solanum tuberosum
MSIVTCEKAAASLSSSSNMNNDTNGAFCYTPQHQLVTPQYQNPPQQIKKKRNQPGNPDPEAEVIALSPKTLVAANRFFCEICNKGFQRDQNLQLHRRGHNLPWKLKKRENKEVVRKKVYICPESSCVHHDPSRALGDLTGIKKHFSRKHGEKKWKCEKCSKRYAVQSDCKAHFKTCGTREYKCECGTIFSRRDSFITHRAFCETLAMESARSVINGRNPTIFSPQLNLQFQQPHFFNSHEQIQATTFPMKKEQQSSDFRHIEIPPWLITTNSQPFQLGAINHGPSPRSNFSSSSIFPATTRLDQQYTQSGHKDLNLHHPNPNLRGPTLGYDSTGESGAVSPVHISATRLLQKAAQFGATISNKASAVTATAAYTGTVKIPHNTHVSVTSTDSATKQTHQKLSSREDLTSITGPANISGIMTSFSNGFDGSTMFEDAILFGGFNNLNSKKEDEEEDQQLYFNGSMNEEDHILTKDFLGLKPLSHTDDIFNIAALVNTEPHHFKNHKTWQS

SEQ ID NO: 5558 - protein, 273 aa, Panax ginseng
PYYVAPEVLLKHYGPEADVWTAGVILYILLGGVPPFWAETQQGIFDAVLKGHIDFESDPWPLISDSAKDLIRKMLCSRPSDRLTAHEVLCHPWICENGVAPDRALDPAVLSRLKQFSAMNKLKKMALRVIAESLSEEEIAGLKEMFKAMDTDNSGAITFDELKAGLRKYGSTLKDTEIRDLMDAADVDNSGTIDYGEFVAATIHLNKLEREEHLMAAFQYFDKDGSGYITVDELQQACAEHNMTDVFLEDIIREVDQDNDGRIDYGEFVAMMK

SEQ ID NO: 5559 - protein, 166 aa, Cryptococcus neoformans
MSTAASNPATYKFNHTMIRIKDPKVSLPFYEKVLGMKVFYESPGGDFTNYFLAFANGFDDADLNKENIRDKLFDREGVLELCHNWGTENDASFKGYASGNEEPGRGFGHICITVDNLEAACKRFDELGVKFKKRPEDGRMRHIAFIYDPDGYWVEIVARSLNASNI

SEQ ID NO: 5560 - protein, 336 aa, Caulobacter crescentus
MGRSAFGSRTRMTAFVDLAARLAAEPADAALKDVVLTIAETCAQISRVVASGALSGSLGAAGSTNVQDEEQKKLDVITNDMLSDALKACGPVAGLASEELEEVEPTGRVGGYLVTFDPLDGSSNIDVNVSVGTIFSVLPAPAGHAPTEGDFLQPGRNQVAAGYAVYGPQTMLVVTLSGGVNGFTLSADGRWLLTHPDLAIKPDTAEFAINMSNQRHWAPAVRRYIDGCLQGKDGARGKNFNMRWVASMVADVHRIMMRGGVFMYPWDAREPDKPGKLRLMYEANPMSLLAERAGGKSIEGLNEILDINPAKLHQRVPVVLGSANEVEVIRAEMRAG

SEQ ID NO: 5561 - protein, 252 aa, Prunus fremontii
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKENLEVLNFKLEKEDIELINTIDKKSRTTL

SEQ ID NO: 5562 - protein, 297 aa, Zea mays
  misc_feature (191)..(191): Xaa can be any naturally occurring amino acid
METSAATPTRPPHQAATSPSPSPSSSLRLWRPAAQRNMRNQWSHLSAAKEQWLAAVADGRAHASALVNVHLSCRNMPTMDLGVLKDMPGIRDKANSKLALREEQYSGMLLSAYKEMVRQLSYLVEASHSMRCFSKAAPNCSITQFSDRQDNLNDSGDGGGAPVFKWFSVLEFESLAQELVQMFVSEQKLKXRLLLLEFLSIALKEGVELQTSLNWGDELYDGESNKLQSIGLQSGDAYSPPENWCAERLGSQRPGNLPLHEVLQVYLTTWHANMNINRSRIGEIFELVEEEMKIKLS

SEQ ID NO: 5563 - protein, 382 aa, Xanthomonas oryzae
MSAGGNVCAAARFIGDAKRTSPMHATIKRPGASVCRQHPYRVTITYGESRVSSTGLDPHAAAPQPTPTPPRSGLAARIGSLRRWVDSQTDEPLDEARADRIDWLRALPFIALHLACLAVFWVGASWFAVGMAVALYALRMFTLTGFYHRYFSHRAFKTSRVLQFVFAAIGATCVQRGPLWWAAHHRNHHRHTDTGRDPHSPAQHGFWWSHTGWFLTPRNFRTDWDVIPDLRRFAELRFLDRFDIVMPALLALGLYLLGDWLAVAAPALKTNGAQLLAWGFAISTVALFHATFTINSLAHRFGSQRFDTRDDSRNNWLLALLTFGEGWHNNHHFFPGSVRQGLRWWEYDVTWYGLTAMSWVGLVWDLKPMPKRLTQRAERVRQ

SEQ ID NO: 5564 - protein, 252 aa, Prunus dulcis
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCKKHGVVPMAHTPLGGATANVKAFGSISPLEDPVLIGLAKKHQKSVAQFALRWNLERGTPVIPKSSKVERLKENLEVLNFKLEKEDIELINTIDKKFRTTL

SEQ ID NO: 5565 - protein, 252 aa, Prunus maritima
AHYTSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSMAQIALRWNLERGTPVIPKSSKVERLKENLEILNFKLEKEDIELINTIDKKSRTTL

SEQ ID NO: 5566 - protein, 185 aa, Lycopersicon esculentum
MASESKDSPSNNPGLHATPDEATKGYFLQQTMFRIKDPKVSLEFYSKVLGMSLLKRLDFPEMKFSLYFMGYEDTASAPSDPVERTAWTFSQKSTLELTHNWGTESDPNFTGYHNGNSEPRGFGHIGVTVDDVYKACERFESLGVEFVKKPLDGKMKGIAFIKDPDGYWIEIFDTKIIKDAAGSAS

SEQ ID NO: 5567 - protein, 654 aa, Zea mays
MAGPEKTVVWFRRDLRIQDNPALAAAAKGGSVLPIFIWCPSDYGQYYPGRCSRWWLKQSLAHLGKSLELLGCPLVLIRAEDSTLAALLECVRSISATRVVYNRLYDPISLVLDNKIKNELPAHGISVQSFNGDLLYEPWDVYDENGQAFTTFNKYWEKCMNLPIEISQYLAPTRLVAAPGLANVRCCSIDDLGLESSKDVESSNALLSRAWSPGWRNAENMLEEFVSYGLPEYSEHGMKVGGSTTSLLSPYLHFGELSVRMIYQLVKMRQVKWQNEGKSEAEESVRLFLRSIGFREYSRYLCFNYPFTHERSFLGNLKHYPWLLDEGRFKSWRQGMTGYPLVDAGMRELWATGWTHNRIRVIVSSFAVKFLQIPWIWGMKYFWDVLLDADLESDILGWQYISGSLPDGHELSRLDNPEVQGQKYDPDGEYVRTWIPELARMPTEWIHSPWAAPNSILQVAGVELGFNYPKPIVELHMARECLDDAISTMWQLDTAAKLAELDGEVVDDNLNNIRNFDIPKVVLNKKLSPSTSSMEHRVLSTNGKDEKSQPTEVKALYKQIIRDDMMNDSNMDDTCSTANLKVTRKRSSSDSAFNVPSCSSSLVMESRIHHNEPSSVLYSGYFQKTADRDGTSKVEDNDSEDSGTSISRPSKKAA

SEQ ID NO: 5568 - protein, 97 aa, Glycine max
  misc_feature (24)..(24): Xaa can be any naturally occurring amino acid
  misc_feature (27)..(27): Xaa can be any naturally occurring amino acid
  misc_feature (59)..(59): Xaa can be any naturally occurring amino acid
  misc_feature (76)..(76): Xaa can be any naturally occurring amino acid
MACRKMITLCLIDCLSLFSLTKNXGLXAKVPFLDKNFIGVAMNMDPDYKMIKQEHCRIXKCVLKRPFDDEERPYLXRHGMQLMEQVSDVSGYGWMHG

SEQ ID NO: 5569 - protein, 337 aa, Methanococcus maripaludis
MITIDGSYLEGGGQIVRTAVSLSAITKKPVKIINIRKNRKNPGLSNQHIACVAAVSKICNAKVEGLIKGSETLVFYPGKIISKNFEIDIKTAGSISLVIQSILPISLAIDKNVEITIIGGTNVEFSPPIDYIKNITLKFLENIGINSEITILKRGFFPKGGGIVKITIKPSKINPYELIENENIEIKGIVFNQNLDENISKRIRKSASDELLNRGFCPEIKLEKINGESAGVGIFLYTNYIGSDRLGKKGLLSEAVGTTASEKLLEELNTKMAIDSHLADQIIPFMPFSDITIGVSKITNHTLTNIYVVEKFFDVKFNIEKYEEKNANGYIISTKGV

SEQ ID NO: 5570 - protein, 134 aa, Zea mays
MRKHRIVSLVSALLILLALAVSSTRNAQEDSMANNTGTLVGGIQDVPGSENDLHLQELARFAVDEHNKKANALLGFEKLVKVKTQVVAGTMYYLTIEVKDGEVKKLYEAKVWEKPWENLKGLQEFKPVEEGASA

SEQ ID NO: 5571 - protein, 535 aa, Streptococcus salivarius
MAKDIKFSSDARAAMVRGVDTLADTVKVTLGPKGRNVVLEKAFGSPLITNDGVTIAKEIELEDHFENMGAKLVSEVASKTNDIAGDGTTTATVLTQAIVREGLKNVTAGANPIGIRRGIEAAVATAVEELKAIAQPVANKEAIAQVAAVSSRSEKVGEYISEAMERVGNDGVITIEESRGMETELEVVEGMQFDRGYLSQYMVTDNEKMVADLENPFILVTDKKISNIQDVLPLLEEVLKTSRPLLIIADDVDGEALPTLVLNKIRGTFNVVAVKAPGFGDRRKAMLEDIAVLTGATVITEDLGLELKDATMAALGQASKVTVDKDSTVIVEGAGSTEAIANRVNLIKSQLETTTSEFDREKLQERLAKLSGGVAVVKVGAATETALKEMKLRIEDALNATRAAVEEGIVAGGGTALVNVIAKVAELDLEGDDATGRNIVLRALEEPVRQIAYNAGYEGSVIIDKLKNSPVGTGFNAANGEWVDMVEAGIIDPVKVTRSALQNAASVASLILTTEAVVANKPEPEAPAAPAMDPG

SEQ ID NO: 5572 - protein, 134 aa, Zea mays
MRKHRIVSLVFALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENLKGLQEFKPVEEGASA

SEQ ID NO: 5573 - protein, 652 aa, Mycobacterium bovis
MCGLLAFVAAPAGAAGPEGADAASAIARASHLMRHRGPDESGTWHAVDGASGGVVFGFNRLSIIDIAHSHQPLRWGPPEAPDRYVLVFNGEIYNYLELRDELRTQHGAVFATDGDGEAILAGYHHWGTEVLQRLRGMFAFALWDTVTRELFCARDPFGIKPLFIATGAGGTAVASEKKCLLDLVELVGFDTEIDHRALQHYTVLQYVPEPETLHRGVRRLESGCFARIRADQLAPVITRYFVPRFAASPITNDNDQARYDEITAVLEDSVAKHMRADVTVGAFLSGGIDSTAIAALAIRHNPRLITFTTGFEREGFSEIDVAVASAEAIGARHIAKVVSADEFVAALPEIVWYLDEPVADPALVPLFFVAREARKHVKVVLSGEGADELFGGYTIYREPLSLRPFDYLPKPLRRSMGKVSKPLPEGMRGKSLLHRGSLTLEERYYGNARSFSGAQLREVLPGFRPDWTHTDVTAPVYAESAGWDPVARMQHIDLFTWLRGDILVKADKITMANSLELRVPFLDPEVFAVASRLPAGAKITRTTTKYALRRALEPIVPAHVLHRPKLGFPVPIRHWLRAGELLEWAYATVGSSQAGHLVDIAAVYRMLDEHRCGSSDHSRRLWTMLIFMLWHAIFVEHSVVPQISEPQYPVQL

SEQ ID NO: 5574 - protein, 630 aa, Geobacter sulfurreducens
MTPWCLDIGATPVTGGVHFRVWSPLADSVEVIRCARGEEASCPLSRVGEYFQGTIPGMGPGDCYWYLLDGTLRRPDPASRCQPGGVHGPSQVVAPDSFAWADGQWRGVALEELITYELHVGTFTPEGTFGAAVERLDYLQELGITALELMPVAEFPGSRNWGYDGVFPFAPHHAYGGPDGLKSLVDACHRRGLAVILDVVYNHLGPEGNYLHAFAPYFTDHYRTPWGDAVNFDGPGSDGVRHYVIGNALHWISEYHLDGLRLDAIHGIYDFSAGHILRDITRAVDSLARHLGRTVHVIAESDLNDVRTIAPPESGGHGVHTQWCDDFHHSLVTLLTGERNGYYADFGLFSHLEKAFREGFVYSGEYSRHRRRRHGSPSGDQPPRRMVVFSQNHDQIGNRALGDRPSTRLSPEQLKLAAGAVILSPYLPLIFMGEEYGETAPFPYFTSHGDPALVEAVRRGRREEFAAFGWEAEVPDPQDEATFRSALIDPELRSVGWHQQVFSFYREVIRLRRQLPSFRRPEREEIQVTGLEADRVVVVRLCRGQAELVVLFALAETSCRVRLPFRHGRYRKLLDSAEPRWGGPGALAPEALDGGDEGIGITLAPFSVVLYGRDRDDRRRNGGPMPTEEG

SEQ ID NO: 5575 - protein, 398 aa, Thermoanaerobacter tengcongensis
MSKKRFYVLLAVLLIVTNVFTFFIANTVSVALPGGKVIVSREDYRLLNQYKKLFEVGKILESRYVDKVNPSTLLEGALKGMAGSLQDPYTVYMNKKEFAEFMTQTTGTYGGIGIIVAVDQEDHIVVVSPIKNTPGERAGIKSGDIILEVNGKKVSGKNLDEAVSMMRGPKGTQVTLTIMRDGKTFTKTITREIIKLETVFDYMLPDKIGYIKITLFDQSTSSDFKKALERLKKDGMKGLIIDLRDNPGGLLEECVNIADMLLPKGVIVTTKGRAESQEFYSKGTGLGMPLVVLVNKGSASASEILAGAIKDRKAGVLVGTTTFGKGLVQTVVNFGDGTGLKYTIARYYTPNGTDIQGKGIEPNYVVELPKDYTLKDTPDLKGDTQLIKAYEIIKSEIK

SEQ ID NO: 5576 - protein, 532 aa, Arabidopsis lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALRIHEKFTKQRHQRPLLVALTGNT

SEQ ID NO: 5577 - protein, 416 aa, Zea mays
MAAAFDAYTDKNAVFRRLKAKPENKMCFDCNAKNPTWASVTYGIFLCLDCSAAHRSLGVHITFVRSTNLDSWTPDQLKMMAFGGNNRAHAFFKQHGWTDGGKVEAKYTSRAAELYRQMLTKEVAKSATTDNALPSSPVASEASKPPSDDFPEFKLPDVPAPPAEDLNGKHEPKSPKAAPRSPKAATHPTFATSVKKPIGAKKVGGKTGGLGVRKLTTKPNESLYEQKPEEPKPAVPALAASTKKGGQALHSRFEYVENEPSADSRTGGSVSRVSGHVAPPKSSDFFQEYGMGNGFQKKSSNASKTQVEETDEARKKFSNAKAISSSQFFGTQNREEKEAQLSLQKFAGSSSISSADLFGRNDADNSNLDLSAADLINRISFQASQDLSSLKDIAGETGKKLTSLASNFISDLDRIL

SEQ ID NO: 5578 - protein, 252 aa, Prunus maritima
AHYKSEADVGNAIAEAIQSGLVKREELFITSKASNHGHVVEACKNSLKKLQLDYLDLYLVHYPLATKHSGVGTTASLLDENKVLDIGVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNLERGTPVIPKSSKVERLKENLEILNFKLEKEDIELINTIDKKSRTTL

SEQ ID NO: 5579 - protein, 252 aa, Prunus maritima
AHYKSEADVGNTIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNLERGIPVIPKSSKVERLKENLEILNFKLEKEDIELINTIDKKSRTTL

SEQ ID NO: 5580 - protein, 99 aa, Triticum aestivum
  misc_feature (24)..(24): Xaa can be any naturally occurring amino acid
  misc_feature (69)..(69): Xaa can be any naturally occurring amino acid
  misc_feature (81)..(82): Xaa can be any naturally occurring amino acid
  misc_feature (88)..(88): Xaa can be any naturally occurring amino acid
MGSEGPSIVTVHVTGFKKFHGVAXNPTEKLVNNIKSFIEKRGLPKNLVLGSCEILETAGQGALGSLYKXLESAIADRENGXXQGQIIXVHFGVNSGASR

SEQ ID NO: 5581 - protein, 231 aa, Prunus maritima
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATASVKAFGSISPLEDPVLIGLAKKYQKSVAQIALRWNLERGTPVIPKSSKVERLKENLEILNF

SEQ ID NO: 5582 - protein, 360 aa, Rubrivivax gelatinosus
MTSLFDPIRLGDIELRNRIAMAPLTRNRAVAGRVPSPLAVEYYRQRADAGLIVTEATQISPLGQGYLDTPGIYSREQVEGWKAVTRAVHERGGKIVVQLWHVGRISHVSLLPEGEVPVAPSAITAKSKTFTRNGFEDVSAPRALALAELPGIVEQYRVAARNAIEAGFDGVEVHGANGYLLEQFLRDSTNHRTDAYGGSIENRARLLLEVMRAVTAEIGAGRTGLRLSPVTPANDAALDSDPQALFNHVAEQLAPLKLAFLHVIEGATGGPRDVAPFDYAALRARVKAPWIVNNGYDRDMAIEAVADGRADVVAFGRPFISNPDLVQRLRVGAPFAALDRDTLYGGGAKGYTDYPALQAP

SEQ ID NO: 5583 - protein, 541 aa, Unknown
  uncultured bacterium
MAAKQITYEMEAREAIRRGIRQLSHAVKVTLGPRGRNVILEKSFGAPTVTKDGVTVAKEVELEDTNENMGAQMVKEVASKTSKDAGDGTTTATIYAEAIFDEGLKNLAAGANAMDLKRGIDAAVDAVVDALRQMAVPVKNKEQIAQVGTCAANQDREIGNNIAQAMEKVGKDGVITVEEGKSIETTVDLVEGMQFDKGYISPHFVNKPESMEVVLDNPYVLVHEKKLASVKDLLPLLEQVAKAGKPLLVIAEDVEGEVLATLVLNKLRGIIQGCAVKAPGFGDRRKAMLEDVGTLTGGSAVFEDLGISLEKMNLSELGKAKRVIVDKETCTLIEGAGRTQDVKGRIEAIKNEIELTTSDYDREKLEERLAKLSGGVAQINVGAATEVEMKEKKARVEDALHACRAAVEEGILPGGGVAVLRCGEALDAAYKRSRGDQKTGVNLIRRALRSPIKQIAENAGLDGSIVCQKVIEGQGSFGYNALTEEYGDLVKMGVIVPLKVERIALQNAASVAGLLLTTDAIVSEIKEKDDDKKMPGGMPGM

SEQ ID NO: 5584 - protein, 494 aa, Arabidopsis thaliana
MVLTKTATNDESVCTMFGSRYVRTTLPKYEIGENSIPKDAAYQIIKDELMLDGNPRLNLASFVTTWMEPECDKLIMDSINKNYVDMDEYPVTTELQNRCVNIIARLFNAPLEESETAVGVGTVGSSEAIMLAGLAFKRKWQNKRKAEGKPYDKPNIVTGANVQVCWEKFARYFEVELKEVNLSEGYYVMDPDKAAEMVDENTICVAAILGSTLNGEFEDVKRLNDLLVKKNEETGWNTPIHVDAASGGFIAPFIYPELEWDFRLPLVKSINVSGHKYGLVYAGIGWVVWRAAEDLPEELIFHINYLGADQPTFTLNFSKGSSQIIAQYYQLIRLGFEGYKNVMENCIENMVVLKEGIEKTERFNIVSKDQGVPVVAFSLKDHSFHNEFEISEMLRRFGWIVPAYTMPADAQHITVLRVVIREDFSRTLAERLVADISKVLHELDTLPSKISKKMGIEGIAENVKEKKMEKEILMEVIVGWRKFVKERKKMNGVC

SEQ ID NO: 5585 - protein, 252 aa, Prunus takesimensis
  misc_feature (18)..(18): Xaa can be any naturally occurring amino acid
AHYKSEADVGNAIAEAIXSGLVKREELFITSKASNHGHVVEACKNSLKKLQLDYLDLYLVHYPLATKHNGVGATASLLDENKVLDIDVTVSLETTWHDMEKTVSLGLVRSIGLSNYELFLTRDCLSYAKIKPQVSQFETHPYFQRESLVRFCKKHGVIPMAHTPLGGATANVKAFGSISPLEDPVLLALAKKYQKSVAQIALRWNLERDTPVIPKSSKVERLKENLEVLNFKLEKEDIELINTIDKKSRTTL

SEQ ID NO: 5586 - protein, 492 aa, Capsicum annuum
MDLSKYRPSSAYDSPFLTTNAGGPVYNNVSSLTVGPRGPVLLEDYHLIEKLATFVRERIPERVVHARGASAKGFFEVTHDISHLTCADFLRAPGVQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKAGKAHYVKFHWKPTCGVKSMTEEEAIRVGGTNHSHATKDLYDSIAAGNYPEWKLFIQIMNPEDVDKFDFDPLDVTKTWPEDILPLMPVGRLVLNRNIDNFFAENEQLAFNPGHIVPGVYYSEDKLLQTRIFAYADTQRHRIGPNYMQLPVNAPKCAHHNNHRDGAMNFMHRDEEVDYLPSRFDPCRPAEQYPIPSCVLTGRREKCVIPKENNFKQAGERYRSWAPDRQDRYINKWVESLSDPRATHEIRSIWISYLSQADKSCGQKVASRLTVKPTM

SEQ ID NO: 5587 - protein, 188 aa, Triticum aestivum
  misc_feature (156)..(156): Xaa can be any naturally occurring amino acid
MCGILAVLGVGDVSLAKRSRIIELSRRLRHRGPDWSGIHSFEDCYLAHQRLAIVDPTSGDQPLYNEDKTVVVTVNGEIYNHEELKAKLKPHKFQTGSDCEVIAHLYEEYGEEFVDMLDGMFSFVLLDTRDKSFIAARNAIGICPLYMGWGLDGSVXFSSEMKALSDDCKRFISFPPGPLYSSKNGGPK

SEQ ID NO: 5588 - protein, 317 aa, Oryza sativa
MSKYGTIPTSSSSSSSGAAPPPLPLGGGGGASPLDFFSRAKARGATALATRRPWRELADPHALGLPPSLADAYLRVRANLAHYAMNYAIVVLAVVFLSLLWHPASLIVFLVCMVAWLVLYFLRDEPIVLFGRVVGDGAVLAALAAVTLVLLLLTGATANIVSSLLIGVLLVVLHAALHKAEENVDDEVGRCLLTQSIEALNLCVKCELDNENTDTYNELNSNVVFRRFDAICSGSECVIHAELCCHTALFIRAVSRSLGSDPAMIQGCELQRIPLVYPTFVNVMQPFPLVFMYQIGREKVKTRLDSGVENQCPVTCV

SEQ ID NO: 5589 - protein, 486 aa, Unknown
  Exiguobacterium sp. 255-15
MKTLPNDFLWGGALAAHQFEGGWNAGGKGPSVVDVMTAGEHGVARRITETIEEGTFYPNHEAIDFYHRYKEDIALFAEMGLKCLRTSIGWSRIFPNGDETEPNEAGLQFYDDVFDELLKHGIEPIITLSHFEMPLHLAREYGGFRNRKVAEFFERFAEVCFTRYKDKVTYWMTFNEINNKMDVENPLFLWTNSGVKVEPGENAMEVMYQTGHHELIASALVVAKGKAINPDFQIGAMISHVPIYPYSSHPEDVMLAEKSMRQRYFFPDVQARGYYPNYALKEFEREGYQIPILDGDDEILKNGTVDYIGFSYYMSTTVKHDATVNNTGNIVNGGLANGVENPYIQSSDWGWAIDPIGLRYVLNRLYDRYQLPLFIVENGFGAVDTIEDGKIHDAARIDYLKTHIEALTEAVTEDGVELMGYTPWGIIDIVSFTTGEMKKRYGMIYVDRDNEGNGSMERMKKDSFDWYKQVIATNGQDLAYDKAAQR

SEQ ID NO: 5590 - protein, 326 aa, Medicago sativa
MEQAVLDDIINRLLEVRCRPGKQVQLSETEIRQLCSTAREIFLQQPNLLELEAPIKICGDIHGQYSDLLRLFEYGGLPPQANYLFLGDYVDRGKQSLETICLLLAYKIKYPENFFLLRGNHECASINRIYGFYDECKRRFNVRIWKVFTDCFNCLPVAALIDEKILCMHGGLSPDLHNLDQIRNLQRPTDVPDTGLLCDLLWSDPSKEVQGWGMNDRGVSYTFGADKVSEFLQKHDLDLICRAHQVVEDGYEFFANRQLVTIFSAPNYCGEFDNAGAMMSVDETLMCSFQILKPADKKTKLNFGSTTTTKPGNSPAGVKSFLGTKV

SEQ ID NO: 5591 - protein, 423 aa, Xanthomonas axonopodis
MSTAPQKPLAIRERLSEVRYEIRGELARRARELEAQGRKLIKLNIGNPGAFGFRAPEHLQRAIADDMGRTDPYTHQQGLPEAREAIATAYARRQHPDAHPDRIFVGNGVSELIDLSLRALLNPGDEVLVPSPDYPLWSAATILNDGRPVYYRCAPENGFQPDPVEIETLVSSRTRAIVLINPNNPSGASYSRELLERIVAIATKHNLLLMVDEIYDQVLYDDAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLSLVAPAGALYAFPAVVGAAARNFDDHAFALDLMNEEGVLVVPGSSFNVPYRHHFRVTLMPEAGVMRDVFARIDRALARRAEAVTKVVPLKPRSVA

SEQ ID NO: 5592 - protein, 325 aa, Medicago sativa
MEQSVVDIINRLLEVRNRPGKQVQLSESEIRQLCNVSRDIFLKQPFLLQLEAPIKICGDVHGQYSDLLRLFEYGGFPPEANYLFLGDYVDRGKQSLETICLLLAYKIKYPENFFLLRGNHECASINRIYGFYDECKRRFNVRLWKTFTDCSNCLPVAALIDEKILCMHGGLSPDLHNLDQIRNLQRPTDVPDTGLLCDLLWSDPSKDVQGWGMNDRGVSYTFGADKITEFLEKHDLDLICRAHQVVEDGYEFFANRQLVTIYSAPNYCGEFDNAGAMMSVDETLMCSFQILKPADKKTKLNFGSTTTAKPENSPAGVKYLLGAKV

SEQ ID NO: 5593 - protein, 375 aa, Staphylococcus aureus
MKSKYEPLFDKVELPNGVELRNRFVLAPLTHISSNDDGTISDVELPYIEKRSQDVGITINAASNVSDVGKAFPGQPSIAHDSDIEGLKRLATAMKKNGAKALVQIHHGGAQALPELIPDGDVVAPSPISLKSFGQKQEHSAREMTNEEIEQAIKDFGEATRRAIEAGFDGVEIHGANHYLIHQFVSPYYNRRNDVWANQYKFPVAVIEEVLKAKEAYGNKDFIVGYRLSPEEAESPGITMEITEELVNKISHMPIDYIHVSMMDTHATTREGKYAGQERLPLIHKWINGRMPLIGIGSIFTADEALDAVENVGVDLVAIGRELLLDYQFVEKIKDGREDEIINYFDPEREDNHHLTPNLWHQFNEGFYPLPRKDK

SEQ ID NO: 5594 - protein, 438 aa, Zea mays
MAEKENILMQRYEMGKLLGKGSFAKVYHARNVKTSESVAIKVIDKDKIKKCGLMDQIIQEISVMKLVKHPNIVQLYEVMATKTKIYFVIEYVKGGELFKKVQRGRLKEDVARTYFQQLISAVDFCHTRQVYHRDLKPENLLLDGSHNLKISDFGLSALPNCKRKDGLLHTICGTPAYVAPEVISQKGYDGAKADIWACGVILYVLLAGYLPFQDKNMMDMYKKICKAELKWPSWFSSDVRKLLRRILHPNPNRRISIEEIRTHPWFRIGLDARLFDSTTRDHVPSDMDLALNSLNSNMVECNSAAEKLTILNAFDIISLSNGFDLSGIFENSNKESKFMSTNTAMTIITKLMEVAKSLDLKVITKTGGLLNMEAAKSGIKGVMSINAEIFQITPNYHLVEIKKINGDILEYHNFMNQSMRPALEDIVWAWHGEQPDEK

SEQ ID NO: 5595 - protein, 286 aa, Unknown
  Synechococcus sp. WH 8102
MQAPRGPLPARQRKLKMGTTSFMVVMHVLATVALLPRFWSWQGLVAFGVLYWVTVLGVTLGLHRLVAHRSLVVPVWVERMLVIMGTLACQSGPIEWVGLHRHHHRFSDQPIDHHDAGRGLWWSHSEWMLHDIPALKELDRYAGDLQVDPFYRWLDRWFLLLQIPLGLGLYWIGEAAQVHGGGIGLVLWAIPLRLVIVYHVTWLVNSATHAFGYRNFDCPDLSRNCWWVALLSFGEGWHNNHHAHPASARHGLRWFEFDLTWQHVRLLKRLGLASRVRTARYVPGAS

SEQ ID NO: 5596 - protein, 326 aa, Medicago sativa
MERGVVDGIINRLLEVRGRPGKQVQLSEAEIKQLCLVSKDIFMNQPNLLKLEAPIKICGDIHGQYSDLLRLFEYGGFPPRSNYLFLGDYVDRGKQSLETICLLLAYKIKYPKNFFLLRGNHECASINRIYGFYDECKRRYNVKLWKMFTDCFNCLPVAALIDEKIICMHGGLSPELHDLNQIKNLRRPCEVPESGLLCDLLWSDPSSDVRGWGESERGVSYTFGADRVKEFLQKHDLDLICRAHQVVEDGYEFFANRQLVTIFSAPNYCGEFDNAGAMMTVNESLVCSFQILKPLDKKPKFSFGSTTTVKSSSPTKFKQAFFGAKE

SEQ ID NO: 5597 - protein, 248 aa, Unknown
  Malus x domestica
MGRGRVELKRIENKINRQVTFAKRRNGLLKKAYELSVLCDAEVALIIFSSRGKLYEFCSSFSMMKTLEKYQSCSYGSLEANLPANETQNSYQDYLMLKARVEVLQQSQRNLLGEDLSHLNTKELEHLEHQLETSLKQIRSRKTQFILDQLSDLQNREQMLVEANKALKRKLEETSVQAPEGMAWEAAGHGPNNIQQTRLPSHSEAFFHPLEGNNSSSQIGYTHMGSDNEMNVGNPGQYVNGYIPGWML

SEQ ID NO: 5598 - protein, 323 aa, Medicago sativa
MSAQGQPPQPQPAQVIDEAVLDDIIRRLTEVRLSRPGKQVQLSEAEIKQLCSASRDIFLQQPNLLELEAPIKICGDIHGQYSDLLRLFEYGGLPPQSNYLFLGDYVDRGKQSLETICLLLAYKIKYPENFFLLRGNHECASINRIYGFYDECKRRFNVRLWKAFTESFNCLPVAALIDEKILCMHGGLSPDLTNLDQIRNLPRPVPIPDTGLLRDQFWSDHGKDVKGWGMNDRGVSYTFGPDKVAEFLTRHDLDLICRAHQVVEDGYEFFADRQLVTIFSAPNYCGEFDNAGAMMSVDENLMCSFQILKPAEKKTKFVMSNKM

SEQ ID NO: 5599 - protein, 235 aa, Unknown
  Malus x domestica
MGRGKVELKRIENKINRQVTFAKRRNGLLKKAYELSVLCDAEVALIVFSTSGKLYEFCSGPSIAKTLERHQRCTYGELGASQSAEDEQSRYQEYLKLKTKVEALQRTQRHLLGEDLVHLGTKELQQLENQLDVSMKKIRSTKTQFMHVQISELQRKEEMLLEANTGLRRKLEEITAGHQRSWNGNHQAAQLEGFPEHLQYNNALQIGTPVVTNDEANVATSSAQNGTGFFPGWML

SEQ ID NO: 5600 - protein, 935 aa, Acinetobacter baumannii
MSNFNKTLSKRLRLNHAYGQLIALIFVPIMILTCVGAFLVLTETSRSAKQQQLHHASAILARYNQIAKDLYTLVELQPDEYDHAQHIMQSMFSEKNLKRAALIDSNGQTYLSIGYRDNRYWPNFTQNNNFFGPISYNHNNIYGVRIIDTAGKPPVWLLIEMDNQPLELARYRILIALVITGLMTLLLLLLCLNFYSRRWIAPMYEIRMQLQRLNADTLDQHIVINSSGELRLLQRDIANVVKRLHFSFLELKEHTEQTEEDLRRTLDTLEVQNITYRQARDQAISSNQAKSVFLANISHELRTPLNSIDGFIHLLLRQQNLSNEQNLYLQTIRKSSAHLLALINDVLDFSKIDAGKLELETAPFDLEEAVFDVMDMLSPLAAQKHIAMAFYYADNIPQQVIGDALRFKQILTNLISNAIKFTPDGEIIVRVRMEHDDIGQCLLHFSVQDSGIGLSGTDRKKLFESFSQGDASVTRQFGGTGLGLAISKQLVHLMHGQIGFEDNQERAPTEKGSTFWFTAQFAVDEEHEIEHPHFEHLQVVSYLAHPATASVLRYYLENYQVPHIETQSILDLFSRLKHLDQKDNTWLIVDHSGDTEALLKEIRSRYQGNLAVYGYQMTLEPNMLTEYRARPLYQPLSRSGLIQLLSDQPIFEEEQQDFNGQGLHILAVDDHLPNLIVLEALLGELNVKTTKALSGQEALNIIQERIDQKLKPFDLVFMDIQMPVMSGIDTTRAIRSLESTLDGEMQLPIIALTAHALADEKQKLLKVGMNDYVTKPIQMEQIIQILTQWTKNNFTAQNLAKDHHVVAEALDPEILNWQQSLQLAANKEDLAQDLLKMLVDSFPTELEEMQQLIELEDFPQLEHVLHRLYGATRYVGTPKLQQVTGDFEQFISTLRKERRRADDGFIEEVMRRFDELGLVIKEVESAAHQILVIPD

SEQ ID NO: 5601 - protein, 309 aa, Yarrowia lipolytica
MTSLDFTMNNGKTIPAIGLGTWKSTTEEVAGAVECALTEGGYRHIDTAFNYRNEDAVGLGIKRAMEKGVKREDIFVTTKIWVTYHDRVEENLDLSLERLGLDYVDMLLIHWPVPLNPNGNDPVYPLREDGSRDIDESGSQPKTWKQMEAVLKTGKTKSIGVSNFSIPYLEELLKEAEVVPAVNQVELHPLLPQLELMEFCKKHNIVMTAFSPFGSVGGPLLKNELVLKLADKYKTTPGGILTSYHIGNGTVVIPKSVTNSRIIENGKSAVTLNQEDLKSLNDLHKTEGIHRTSKPKWGVDLGFPDFDFC

SEQ ID NO: 5602 - protein, 487 aa, Oryza sativa
MMLKDLAEIQQQQLLAAAEENMSNLTSASGDQASVSSHPAPPPAKKKRSLPGNPDPEAEVIALSPRTLMATNRYVCEICGKGFQRDQNLQLHRRGHNLPWKLKQRNPKEVVRKKVYVCPEAGCVHHDPARALGDLTGIKKHFSRKHGEKKWKCDKCSKRYAVHSDWKAHSKVCGTREYRCDCGTLFSRRDSFITHRAFCDALAEESARAVTAAAAVAGQQQHGGGMLFSQVADVLDHQAAMAMGGHGLMQELCLKREQQQQQQQFAPSWLTAQQQQQQLEAMAGAGNPAAMYGSARLDQEFIGSSTPESGGAQQAGLSFGFSSTSSAPPHPAASSAHMSATALLQKAAQMGATLSRPSSHAHMAAAAAASTHNSSSSAATTNAPPPPPTSNVSSTCVGAGGYGLAFEASHFIAADESSRGARSDRDTGNGVAGAGNDGLTRDFLGLRAFSHGNIMSMAGFDPCMSTTSASSAAPYDHHHHSNKPWHS

SEQ ID NO: 5603 - protein, 546 aa, Cryptococcus neoformans
MPVFSTLINSTESYQRRFDQMARAVLVYWVLKYVLLDGFRHIKARGLCGTANEIRNKIKSLVVRIMLAFPSNRAKLNSELAKTRAELKEKLAPSQYPDGVRLTTVRTLPETGRGREWLESEWENLKKLEKADVDNGRVSGAVYHGGDELNAVINEAMAKFVVTNPLHPDVFPGVRKMESEIVSMCLNLFNGPNGAGTTTSGGTESILMSVKTHRDWARVTKGITRPEMVIPSSAHAAFWKASEYFNIKLHVIPVNQKTRKAEVAAMKRAINPNTIMIVGSAPNFPDGAIDPIPELGALAKRRNVGLHVDCCLGSFIMPFLEKAGFSEGIDPFDFRVPGVTSISCDTHKYAFCPKGTSVIMYRSSELRRFQYYVITDWAGGVYASPSMAGSRPGSVLAGAWAVLNHIGADGYTSSCRQIISAARYLTSSLRTLFPDDLYVLGDPKGPVVAFNSKTINIYAVGDVMSKKGWHLSALGGDGGLHMAFTRLSAKSVDKLIEDLGDALKEVKASPQGAGGDMVALYGLGQTSAGPHVVGKLAETFLDTLYE

SEQ ID NO: 5604 - protein, 139 aa, Glycine max
IMDNCQENAMVLKEGLEGTGRFNIVSKDQGVPLVAFSLKDSSRHDEFEISEFLRRFGWIVPAYTMPPDAQHVTVLRVVIREDFSRTFAERLVIDIEKVLHELDALPSRSSGPALQHPNGDTVSEKDLARQREVVSVWKR

SEQ ID NO: 5605 - protein, 422 aa, Glycine max
HASANESVAIKVIKKERLQKERLVKQIKREVSVMRLVRHPHIVELKEVMANKAKIFMVVEYVKGGELFAKVAKGKMKEDVARKYFQQLISAVDFCHSRGVTHRDLKPENLLLDENEDLKVSDFGLSALPDQRRSDGMLLTPCGTPAYVAPEVLKKKGYDGSKADIWSCGVILFALLSGYLPFQGENVMRIYSKSFKADYAFPEWISPAAKNLISNLLVVDPQKRYSIPDIMKDPWFQIGFLRPIAFSMKESALEDNIDFSGDDVPSPGSDDGNSSSNNEDGELTGAKPARPSYNAFEIISSLSHGFDLRNLFETRKRSPSMFISKFSASAVMAKLEGVAKKLNFRVTGKKEFMVRMQGATEGRKGKLAMTVEVFEVAPEVAVVEFSKSAGDTLEYLNFCEDQVRPSLRDIVWSWQGDANCHQ

SEQ ID NO: 5606 - protein, 520 aa, Brassica napus
  misc_feature (69)..(69): Xaa can be any naturally occurring amino acid
  misc_feature (96)..(96): Xaa can be any naturally occurring amino acid
  misc_feature (118)..(118): Xaa can be any naturally occurring amino acid
  misc_feature (140)..(140): Xaa can be any naturally occurring amino acid
  misc_feature (233)..(233): Xaa can be any naturally occurring amino acid
  misc_feature (252)..(252): Xaa can be any naturally occurring amino acid
RPVASTIPKPQTLYLGIISASSSLWILSKYRPSIPFHAPFYTTNGGAPVSYNISSLTIGQRDPVLLEDXHLNLKVDNFNRERIPERVVLARGSSAXGFFEVTHDNSKLTCADVLRAPXGFQTPFIVRFSISRSRCRACPXESMRDIRGFAVKFYTREGNFDLVGNNTPVFFIRDGIQFPDVVHALKPNPNTNIQEYWRILDYMSHLPESLLTWCWMFDDVGIPQDYRHMEGFXGVHTYTLVSKSGKVLFVKXHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPIPNKSYTGIRTKCIIKKENNFKQPGDRYRSWAPDRQDRFVKRWVEILSEPRLTHEIRSIWISYWSQADRSLGQKLASRLNVRPSI

SEQ ID NO: 5607 - protein, 252 aa, Prunus fruticosa
VDYKSEADVGNAIAEAIQSGLVKREELFITSKASNHGHVVEACKNSLKKLQLDYLDLYLVHYPLATKHNGVGATASLLDENKVLDIDVTVSLETTWHDMEKTVSLGLVRSIGLSNYELFLTRDCLSYAKIKPQVSQFETHPYFQRESLVRFCKKHGVIPMAHTPLGGATANVKAFGSISPLEDPVLLALAKKYQKSVAQIALRWNLERDTPVIPKSSKVERLKENLEVLNFKLEKEDIELINTIDKKSRTTL

SEQ ID NO: 5608 - protein, 481 aa, Leptospira interrogans
MSRKTLTTAGGHPVSQNQHSLTAGPRGPVLIQDTHLIEKLAHFNRERIPERVVHAKGAGAYGTLTITQDLTKYSRASIFSKKGKQTSLFLRFSTVAGEKGSADTERDPRGFAVKFYTDEGIWDLVGNNTPVFFARDPLKFPDFIHSQKRDPVTGYKNPIRMWDYWAGSPEAFHQITILFGDRGIPDGYRFMNGYGSHTFGLWNSKGERFWTKFHFKSMQGIRNLSMEKASALAGTDPDYATRDLFEAIERKEFPKWKFCVQIMPEKEATKYKFNPFDLTKVWSHKDYPLIEVGVLELNSNPKNYFEEVEQAAFSPSNMPPGIGASPDKMLQGRLFAYPDAHRYRLGIQYQQLPVNRPKNSVNVYHRDGRTRFQCDGNYDNYEPNGFEGPVQDSSYAEPPLSISGDMDRYNSHIGNDDYSQAGDLYRLMSVEERERLTSAIASTMHNLPKPLLEANLKHFHLCDPEYGEQLAAKVGLALSRV

SEQ ID NO: 5609 - protein, 148 aa, Brassica napus
YADTQRHRLGPNYLQLPVNAPKCAHHNNHHEGFMNVMHRDEEVNYFPSRYDPVRHAEKYPTPPAVCSGKRERCVIEKENNFKEPGERYLKYRSFTPERQERFIGRWIDALSDPRITHEIRSIWISYWSQADKSLGQKLASRLNVRPSI

SEQ ID NO: 5610 - protein, 403 aa, Pseudomonas putida
MQFSKSNKLANVCYDIRGPVLKHAKRLEEEGHRILKLNIGNPAPFGFEAPDEILQDVIRNLPTAQGYSDSKGLFSARKAVMQYCQQKDIEGVTIEDIYLGNGVSELIVMSMQALLNNGDEVLIPAPDYPLWTAAVSLAGGKPVHYLCDEQADWFPDLEDIKAKITPNTKALVIINPNNPTGAVYSKELLLGMLELARQHNLVVFSDEIYDKILYDEAVHISTASLAPDLLCLTFNGLSKSYRVAGFRSGWLIISGPKHHAHSYIEGIDMLANMRLCANVPAQHAIQTALGGYQSINDLVLPPGRLLEQRNRTYELLNDIPGVSCVKPMGALYAFPRIDPKVCPILNDEKFALDLLLSEKLLIVQGTAFNWPWPDHFRVVTLPRVDDLEAAIGRIGNFLKGYSQ

SEQ ID NO: 5611 - protein, 515 aa, Schizosaccharomyces pombe
MGQGSSKHADSKLDSYPSFSRSDTQGSIKSLKSLKTVLGKGKDSNHDRRTSTDTTHSRHRYPETPPSLPPPPSPGILATSPAVLQKHQQEDSGNSSQSPTSPHPSNQPAMLSPSTAASQHHHHHSSSSSYAVSPTSPTSPTSSGPIGSNFDSASEHNGPVYPQDQQGPVIIPNSAISSTDPDDPETVVSLNVDEMIQRLIHVGYSRKSSKSVCLKNAEITSICMAVREIFLSQPTLLELTPPVKIVGDVHGQYSDLIRLFEMCGFPPSSNYLFLGDYVDRGKQSLETILLLFLYKIRYPENFFLLRGNHECANITRVYGFYDECKRRCNIKIWKTFINTFNCLPIASVVAGKIFCVHGGLSPSLSHMDDIREIPRPTDVPDYGLLNDLLWSDPADTENDWEDNERGVSFVFNKNVIRQFLAKHDFDLICRAHMVVEDGYEFFNDRTLCTVFSAPNYCGEFDNWGAVMSVNSELLCSFELIKPLDQAAIRRELKKSKRSGMAIYQSPPAEQVTQSV

SEQ ID NO: 5612 - protein, 543 aa, Rhodospirillum rubrum
MAAKDVKFSSDARDRLLRGVDTLANAVKVTLGPKGRNVVIDKSFGAPRITKDGVSVAKEIELKDKFENMGAQMLREVASKSADVAGDGTTTATVLAQAIVREGSKAVAAGMNPMDLKRGIDLAVAAVVKDVKTRSRKIATNDEIAQVGTISANGDEEVGKIIARAMDKVGHEGVITVEEAKGLDTELDVVEGMQFDRGYLSPYFVTNAEKMVADLENPYILIHEKKLSGLQPLLPVLEAVVQSGRPLLIIAEDVEGEALATLVVNRLRGGLKVASVKAPGFGDRRKAMLEDIAILTGGQVISEDLGIKLETVTLDMLGTAKTVTITKDNTTIVDGAGVKADIDARCAQIRATIEDTTSDYDREKLQERLAKLSGGVAVIRVGGASEVEVKEKKDRVDDAMHATRAAVEEGIIAGGGVALLHAAKALDALSPANADQKVGIEIVRRALQAPVRQIAENAGVDGAVVAGKLLESSDADFGYNAQTGVYENLVKVGVIDPTKVVRTALQGAASVASLLITTEAMVAEIPEKKPALPAGGGMGDMDF

SEQ ID NO: 5613 - protein, 785 aa, Pseudomonas putida
MLAQRKERETGSGLMDIKFTNRLSYKQARLTVLVGFILGTLLSLIQIGIDYASEDASINREVNALLQISHNPASRIAYNIDSELALELTRGLLQSPAVIRARLIDNNETVLADVERPKLQDRYRPLSDFLFGEQRQFKERLYLTHMPEQYLGTLYLDIDTFAFGSRFLDRAGITLLNGFARSLVLTGLLLALFYMMLTKPLVTVIGALSGSDPRKPRQTRLECPHGHEHDEIGVLVKVANQQFVSMATEIEQRRTAENRLTQYLNELEDIVSARTNELKASNSSLSLSNQELEQARSRALDMAQARAAFLANMSHEIRTPLNGMLGMIALALDNPLPSEQRQQLAIAHDSGKVLVELLNDILDLSKFDAGQLELERIAFDMGSMVEDTANLLSQNTAQSVELTCLIASDFPSSVLGDPTRVRQIVSNLLSNALKFTRFGRVDVRLAAIVGGVRLEVRDTGIGIPEDAQARIFQPFTQAGAGITRQYGGTGLGLALTRNLCKAMQGHLHIRSEPGFGSCFTAELPLTVHTEAIPPAPLHGRVAALSAAGSGLNELLQHLLPAWGLTYQRHDSCATLVAAVIDLLITDDVEHLFELRPALKTPILLVTAYGNFLPNEQSLALAPLHQLARPLARNALYQTLRRTLQGHEPEHPLAIPAITQEQGRARILLVEDNPVNQLVAKGMLAKLGCQVQLATQGAEALELLAREEFDLVLMDCNMPVMDGYEASRRIRQSGRWPELPIVALTANAMPEERERCRAAGMNDYLAKPFRREELLALVDHWVPFSG

SEQ ID NO: 5614 - protein, 389 aa, Glycine max
  misc_feature (100)..(100): Xaa can be any naturally occurring amino acid
  misc_feature (289)..(289): Xaa can be any naturally occurring amino acid
  misc_feature (304)..(304): Xaa can be any naturally occurring amino acid
  misc_feature (310)..(310): Xaa can be any naturally occurring amino acid
APPPPLAHRRKKGVGSRNRDSWKEYSIGLVPRISSISYPHCGYFPSSGGFIAKRRKRNSLLRLNDCSDNIRQHASILFVRLVSGVMLVMSVSLASTEPSXNLLFLEAWRTIDRAYIDKSFNGQSWFRYREDALRNEPMNNREETYKVIRKMLATLDDPFTRFLEPEKFRSLRSGTEGALTGVGLSIGYPTKAEMQPGGLVVISASPGGPAYRVGVLSGDVILAIDCTSTENMGLYDAAERLQREKVSLDPVKSRLCKLPASGNDSPTVGYIKLTSFNQKASSNFREPTXEKSKLLLFQLKPTKXIYVVFXYELYTCWKIQSVFELSDGSGIVVTVARYETAAHTDIDKVGVIPDHPLPTPFPKDEDAFCNCLQDPASSCYVNRIKLFSK

SEQ ID NO: 5615 - protein, 486 aa, Unknown
  Shewanella sp. ANA-3
MSQQYLTSQSGSPIADDQNSLSAGERGPLLLQDWHLIEKLAHFNRERIPERVVHAKGTGVYGTFTLTKDLSEYTIADHFNGVGKQTETFVRFSTVGGEMGSADAERDPRGFGLRFYTARGNHDIVGNNTPTFFLRDGIKFPDFIHTQKRNPLTNLKDPQAMWDFWSLNPEAMHQVTILMSDRGIPANYRQMHGYGSHTFSFWNAKGERFWVKFHFKSQQGVVNLTNEQADKLKGIDPDSSQRDMVVAVTDGNFPRWTVNVQIMPESDANTYHINPFDLTKVWPHGDYPLIEIGVLELNRLPQNYFAEVEQVALAPSNLVPGVGASPDKMLQARLFAYADAQRYRIGANYNQLPVNCPHATKANHHQRAGAMAGTQCPYHGSQTGGDATANYGPNSTAGALVELANFAEPPLRLDGEAARYSRYNQDDYTQAGNLYRIFSEAEKARLVETISGSLRQASLDVQQRMLAHFHKADADYGQRIQTALGL

SEQ ID NO: 5616 - protein, 311 aa, Kluyveromyces lactis
MDQQSVDVDDIIDRLLEVRGLKPGHQVDLEEHEIRYLCSKARSIFIKQPILLELEAPIKICGDIHGQYYDLLRLFEYGGFPPESNYLFLGDYVDRGKQSLETICLLLAYKIKYPENFFILRGNHECASINRIYGFYDECKRRYNIKLWKTFTDCFNCLPIAAIVDEKIFCMHGGLSPDLNTMEQIRRVMRPTDIPDVGLLCDLLWSDPDKDIVGWSENDRGVSFTFGPDVVSRFLQKQDMELICRAHQVVEDGYEFFSKRQLVTLFSAPNYCGEFDNAGAMMSVDESLLCSFQILKPASKLLERNVVRRKK

SEQ ID NO: 5617 - protein, 554 aa, Unknown
  Shewanella sp. ANA-3
MCSIFSILDIQSDAKELRQVALEMSKLMRHRGPDWSGIYASDKAILAHERLAIVDIEHGAQPLLTEDGSLILAVNGEIYNHKELKAQLGDKYSYQTNSDCEVILALYQEYGTEFLDKLNGIFAFVLYDKAKDAYLIGRDHMGIIPLYTGRDAAGNFYVASEMKALMPVCKTVAEFQPGQYLYSSIGEPVQYYTRDWQSFDAVKDNGASQEELRDALEAAVKRQLMSDVPYGVLLSGGLDSSVISAITQTFAKRRIEDDDQSGAWWPQLHSFAVGLKGAPDLAAAKKVADAIGTIHHEINFTFQEGLDAIKEVIYHLETYDVTTIRAATPMYLMARKIKAMGIKMVLSGEGADELFGGYLYFHKAPNAQAFHEELVRKLDKLHLFDCLRANKAMAAWGLEARVPFLDKEFMDVAMRINPEAKMSKDGRIEKHILRQAFEHKLPKEVAWRQKEQFSDGVGYSWIDGLKAHAAEQVDDLQLANAKFRFPYNTPETKEAYFYRCFFEEHYPLPSAAETVPGGKSVACSTPEALAWDESLRGIIDPSGRAVRSVHAASY

SEQ ID NO: 5618 - protein, 365 aa, Enterobacter cloacae
MSAEKLFTPLKVGAVTAPNRVFMAPLTRLRSIEPGDIPTPLMGEYYRQRASAGLIISEATQISAQAKGYAGAPGLHSPEQIAAWKKITAGVHAEDGRIAVQLWHTGRISHSSIQPGGQAPVSASALNANTRTSLRDENGNAIRVDTTTPRALELDEIPGIVNDFRQAVANAREAGFDLVELHSAHGYLLHQFLSPSSNQRTDQYGGSVENRARLVLEVVDAVCNEWSADRIGIRVSPIGTFQNVDNGPNEEADALYLIEELAKRGIAYLHMSETDLAGGKPYSEAFRQKVRERFHGVIIGAGAYTAEKAEDLIGKGLIDAVAFGRDYIANPDLVARLQKKAELNPQRPESFYGGGAEGYTDYPSL

SEQ ID NO: 5619 - protein, 487 aa, Carica papaya
MVLMLRNQELLSKIATSNGHGEDSPYFDGWKAYDSDPFHPTQNPEGVIQMGLAENQLCFNLIHEWLLKNPEASICTAQGAAEFRDIAIFQDYHGLAEFREAVAKFMGKVRRNRASFDPDRIVMSGGATGAHEMIAFCLADPGDAFLVPTPYYPGFDRDLRWRTGVKLIPVVCESSNDYQITIEALEAAYETAQEADIKVKGLLIPNPSNPLGTIITKDTLEALVTFTNHKNIHLVCDEIYAATVFSQPEFTSIAEIIEEDKICCNRDLIHIIYSLSKDMGFPGFRVGIVYSYNDAVVSCARKMSSFGLVSSQTQYLIASMLADDEFVDQFIVESRKRLAMRHSFFTQRLAQVGINCLKSNAGLFVWMDLRRLLKEQTFEAEMVLWRVIINEIKLNVSPGSSFHCSEPGWFRVCFANMDDKTMEIALSRIKTFMLQHKEAMVPKKKLCWQTSLRLSFSSRYEDIMETPGSFMSPHSPIPQSPLVRART

SEQ ID NO: 5620 - protein, 626 aa, Mycoplasma mobile
MKNISSKNLSLNLEPFYGGYETALYKFLGSHLTTKNGKSGVMFRTWAPNAKKIEVLIANGEKFLLAKINEAFWEVFIPNLKKGTAYKYLVTTIDNKLLTKADPFAFYSNQYPYFDSIVYDLNNFIWSDEAFLKSRKIKNAHNSPILIYEVHLGSWKKTPDNGFLNYKDYSKELVSYLKKMNYTHVEFLPLFEHPFLGSWGYQITGFFSPTSRYGTPEELKYLINELHQNGIAVIFDFVPVHFCKDDHGLREFDGTNLFSYENEVDRENYLWGTQNFNLTKNEVKSFFTSILYYWIEEFHIDGVRFDAVSNLIYYGGLEKRGINNSGVNFIKHIISIVKKDFPNILMIAEDSSYYKKVTGDNFNNSLGFDLKWNLGFSNDLFEFIKKPYWERLGNNFHKLTFSMAYYFDERFLLAFSHDEVVHLKKSLLNKSFGLRDKQFSQIRLMLFYLITHPGKKLIFMGHDFAQFDEWNENKSLDWHLLNEDSFNLENKRVNIFSKELFSFYVNNKSLFELDFSNETFKWVHLNEEQGIWVFSRHSKNKEDFSLIVLNFSIEYFENYIIKNVPTASYYKEMINTDDLKFAGTGAINSIGKIIEVKNSEVNVKIAPLSGFVLKPFFKVQRKAKNE

SEQ ID NO: 5621 - protein, 546 aa, Wolinella succinogenes
MASKEINFSDSARNKLYEGVRQLADAVKVTMGPRGRNVLIQKSFGAPSITKDGVSVAKEIELADAISNMGAQLVKEVASKTADAAGDGTTTATVLAHGIFKEGLRNITAGANPIEVKRGMDKATAAIIDELKKLSKKVNDKKEIAQVATISANSDENIGSLIAEAMEKVGKDGVITVEEAKGINDELNVVEGMQFDRGYLSPYFVTNSDKMEAVLENPYILLTDKKITSMKDILPLLEGTMKSGRPLLIVAEDIEGEALTTLVVNKLRGVLNVAAVKAPGFGDRRKEMLKDIATLTGGSVISEEIGKTLESATIADLGQAARVVIDKDNSTIVDGKGSKDEVNARVAQIRTQIEATTSDYDREKLQERLAKLSGGVAVIKVGAASEVEMKEKKDRVDDALSATKAAVEEGIVIGGGAALIRAAAKVKLELSGDEKIGYEIIKRAISAPLKQIAQNAGFDAGVVANNVEQNGNENFGFNAANGEYVDMFAEGIIDPLKVARIALQNAVSVSSLLLTTEATISEIKEDKPAMPDMSGMGGMGGMGGMM

SEQ ID NO: 5622 - protein, 188 aa, Arabidopsis thaliana
MANNDEITTSSHASPAVNHESISRAKQRIKDGLATRRSWRVMFDLHSTGLPHGVSDVFSRIKTNLAYFRSNYAIVILNVIFFSLIWHPTSLIVFTGLVFLWIFLYFLRDVPLKVFRFQIDDRAVLIGLSVITIVLLLLTNATFNIVAALMAGAVLVLIHAVIRKTDDLFLDEEAATTETSGLTSHPSS

SEQ ID NO: 5623 - protein, 293 aa, Solibacter usitatus
MFDRRSHLNCVTAGALALFHAGALAALFLFTWQALWVALALLWISGGWGIGMGYHRLLTHRGYETPRWLECILTICGTLALQGGPLFWVATHRLHHQNADKQGDPHSPQDGWWWAHAGWLLRGDPMRDSALAPYVPDLRRDPFHCWLEEWHVVPLLVLSVVLAVWGAVREGWFLAASLVAWGVFLRTVVELHGTWLVNSAAHTWGSRRFQTRDDSTNNWWVALLTFGEGWHNNHHAEPRRVRHGLAWYELDINWLCIRALGRIGLARNLCLGPAVRPATVQTAVPERQAPSNR

SEQ ID NO: 5624 - protein, 130 aa, Brassica napus
MCNPTKDGGSSPTGLVRNEKRAYFQRYWTWADVARALTVTIVHFWCLLAPLNYTWEALRFGLILVTVTNLLITFSYHRNLAHRSFKLPKWLEYPIAYAAVFALQGDPLDWVSIHRFHHQFTDSDRDPHSP

SEQ ID NO: 5625 - protein, 656 aa, Burkholderia cenocepacia
MCGIDGFLNSVAFDEETARGTLARMTASLAHRGPDGQGIWVDPEAGIALGHRRLAIVDLSVHGRQPMASACGRYVLVFNGEIYNHRELRAELERAGRAPAWRGHSDSEVLIAAIVAWGVEATLRRATGMFAFALWNRASRVLTLARDRIGEKPLYYGRIGDALVFASELKALRGYPGFDGTVDRDALCLYLRQSSVPAPYTIYRGIRKLPPGTYIQFEHARDTPRLRAYWTLEQVIEAGRAQPFEGTPDEAVGQLDAILRQAVARQMEADVPLGAFLSGGVDSSAIVALMQAQSATPVDTFTIGFHEAGYDEAGYAKAVARHLGTRHTELYVTADHALGVVPKLPSIYDEPFSDASQIPTFLVSELTRRHVKVSLSGDGGDELFGGYTRYFLTPRLWRKLHRVPGAVRARIAAALHALRPDHADQLAAVAQGAWGGGVEARESTSRIGDRLHKLGHVMTAESRIGLYRLLMSSVHHPERIALSGQEPPTPLDTVSAWPAHLSFAEQAMAIDTLTYLPTDILAKVDRAAMAVSLETRMPFLDHHVVEFAWRVPASVRLPEGQSKALLRRLLDRYVPSALIDRPKQGFCAPVDHWLRGALRDWAEALLRPSRLREEGFFDAAAVERLWRQHQTGRMNWQHQLWTVLMFQAWLEAQRAA

SEQ ID NO: 5626 - protein, 602 aa, Thiomicrospira crunogena
MCGICGEIYWDGQMASETKLVPMLAELEKRGPDDGGTWVQNHVGLGHRRLSIIDLSDGGHQPMLDDEISLVFNGCIYNYETLSAELIELGHEFRSHSDTEVILKAYRQWGMECVSRFEGMFAFAIWDDHQHQLLLARDRFGIKPLYYAPVEGGVRFASNTQALLASGGINTDIDPVGLHHQFTLHAVVPAPHTILKGIRKLEPGHWMIVNPDGQMYKKSYWHLEAKRPTADNAPQTEKEWIDAIHESLKQAVHKRLTAADVPVGVLLSGGLDSSLIVALLAEAGVEDIRTFSIGFEDVPEEKGSEFEYSDLVVEQYQTAHQKYLIPNETVLPRLTEAVDAMAEPMFGQDAIAFYLLSEKVSEDVKVVMSGQGADEVFAGYFWYPMMAKAAESLKDASRPVDAFAPYYFDRSHEEWLEMIEDEFHVYDVTSELINDRLSDKGADSYLDQVLRLDTTTLIVDDPVKRVDNMTMAWGLEARVPFLDHHLVELAMSAPTDLKLKDFKYILKKIARGIVPNEVIDRPKGYFPMPALKYVRGPFYEMMKSILTSPQAKARGIFKPAYIQKLLDHPEADESFTAIKGSKLWHAALLELWLQRHVDPYVQ

SEQ ID NO: 5627 - protein, 760 aa, Cryptococcus neoformans
MTSPSAQPMIPRSQPPRPSHTQSSPAINSTGIKPNGPPSVIRRAPSVPVNPSTAAASGSLSSLLKSENTAQAVSRSSPPTEPNDLPRPIEPTPMLPITGLPNSSSSSSNARHGSSSSISRGPSVTGTLTPATTALGAPIEPTPPQTGASKMAAAAKRGLDGSAGNNVKVYEEGHPLNEETLKQRGYQTLNILNHPFHLPDRWKLLRPLGQGAYGLVIQVQDAETEIPIAVKCVTRVFDKVILARRALREITLLRHFGEHDNLTGLVDMDNVWDGYNEIYLYMEPMEADLHQIIRSGQPLGNAHIQFFIYQLLRGMKYIHSANVIHRDLKPGNLLVNSGCELKICDFGLARGFNPVKGEEPQGEEGKLTEYVATRWYRAPEIMLSNRRYTTAIDVWSIGCILAELLGLKPVFKGKDYIEQMTLILETLGTPDEETMARVASEKALTFLKTLPTYEKKDLGSIFPDADPLAVDLTDKLLEFDPTRRIDVPSALTHAYVERYHDPEDEPSCDKIFDKWEEVESLSTIEELKEAITREIQGFREEVRMAAEEDDEDEEWAEGEYLDDENVFHDSPGPALASTLEKFTYPDHIAPTGSAPRTREHSPTTTFITSAEDYFTAQHGFGGPNGRASRRSSSHSTSGRRPASFLFSPFGAGMTQIVPTPNAYPRSHAQASPELTTAEKTPRDRRSSGLWRTRSRAQSQSGNLVLERLSSLEINDHKDGEKNRIDALHAVVGLGGDGEVPPMTVSPSDAPPSEVPKSFGY

SEQ ID NO: 5628 - protein, 1785 aa, Anabaena variabilis
MLWLRLQAEEEIKIQQLIKQQAIATQTELVTQLKTRILALKRIGKHWEMHGSIPQAQWELEARAYLEDYGGYQAIKLVDPSWQVLRSVSVAKNKAAENLEIMPKFPQCKGATAQPSHETTLTHTVNLNQGDRVFFACVPLWMGDKFGGAVLGIFQVKQFFESVLHIAPGYKIRVFDGQELIYGQDRQSSTLPSWQQSVNINFDGMTWQLQIYPTPELLKDLYSPLPTVVLVAGIFNAGAVTLLIYFAQATKLSNHQIGRINQELADRIEKQTQVEIALRASENRLRELLETVRVIPWEVDLKTQHFTYVGPQAETLLAYPIAQWYEENFWDNHLHPHDRDWAVRFCQEAANKGQNHELEYRMLAADGRVVWLRDVVNVVEVDGTPVMLRGFMFDITDLKRVEETLRLRERALAASSNGIVISDAKLPNYPVIYVNSAFEQITGYKATEIVGRNCRFLQGNDTTQPAIEELRSALKAGKNCKVILRNYRKDGSLFWNQLSVSPIYNDNGQLSHFIGIQTDISDRQQAEASLRRQALTFENIYDGVIITNLQGQILDWNPAAERMFGYSKDHICGQSISILHKVEEDAALNSAIIAEITKQGRWSGEINFVRQDGSQGICETTIVALQDDQGQTVATISVNRDITERKHAELLLRRSEERFQAFMNHSPTPAWITDIDGTIVYLSETYRRTFQLPTQELIGTNIFDIYPPELIQTFRETIQIVARTHQVMETVESVPCSDGTVRDFLVYKFPISSKPDECLIGGIAIDITERKQAEAALRKSEERWQLVIEGNQDAIWDWNIITNETFRSARWAELIKEQNYQPIADHADCISRIHPDDYERVMAVRQDCLSRKIPNYVVEYRLRCNDDSYKWVLVHATGQWDERGNPVRMVGSIKDITERIEAQEALQRQLHRTLLLEKITQKIRQSLDSKEIFETAATQIGQALAVDRCLIHSYISHHDPHIPLVAEYNNVLDYCSMQKWEFTTTGNRHILQMMSQDKAIASANVYTDPLLQTAVPSCCEIGVKSMLAVRTSYQGEPNGAICLHQCKYFRQWTPEEIELLEAVAAQLGIALAQAQLLEQETRQREELTIKNFALEQAKRAAEAANRAKSEFLAMMSHEIRTPMNAVIGMTGLLLDTELTSQQRDFVETVLTSGDALLSIINDILDFSKIESGKLELEEQPFEVRTCVEQVIDLLAAKAAQKDIELAYLIHPQVPMQIAGDLTRLRQILTNLLNNAIKFTPEGEVVVSVRSQPSPNQKTKNCCEIIFTIKDTGIGIAPETMDLLFQPFVQADASMTRKYGGTGLGLVISKRLGEMMGGYLWVESRGCVGGNPPPGWQRKNSISSASVATGSTFYFSMTVPVVAHADLETSITSPVQLSGKRLLIVDDNPTNRQILRLQAEPWQMETYTAPSGAEALALIDQGMAFDIAILDVQMPEMDGLTLARQIRQRPSYQHLPLVILTSWGQPDTDLSDIEFAACLNKPIKQSQLFDVLAASLGNQPIRASVVPDRSAQVNSCLAQQIPLRILLAEDIVVNQKVALLILKKLGYRADVVANGLEVLEALQRQSYDVVLMDVNMPEMDGLKASQIICQTWSPRSRPYIIAMTANAMRGDREACLAAGMDHYISKPLQLEELAKALGKCHPSTSSTEKALEKTSSQNQTFTDISDLKFATIDTKILQALRDMLGGDKVAFAELINCYLTESPKLIENLNVAINTEDTQGIWKTAHKFKSSSGSVGAVFLAQLCKLLEAKGRNNNLEGCIELGSQLCQEYELVKTALYREVNKETP

SEQ ID NO: 5629 - protein, 83 aa, Triticum aestivum
GTLPALELCYSMTQRLHLVDDDKDKPPLLQQQHEGAAAAPDASAPSPPVTNWKISSAGDSPDEVKARLKYWAQAVACTVRLCS

SEQ ID NO: 5630 - protein, 1038 aa, Glycine max
  misc_feature (606)..(606): Xaa can be any naturally occurring amino acid
  misc_feature (657)..(657): Xaa can be any naturally occurring amino acid
QISPPSQQPPQSSSATHQGGHHRHTSSGHHRSSGMTASSSRAPNRTRTGDDLHIGKYKLLKTIGKGNFAKVKLAKHVPTGVEVAIKIIDKTALNQSSLQKLFREVRIMKQLDHPNIVKLYQVIESETTLFLVMEYASGGELFDYLVAHGRMKEKEARAKFRQIVSAVQYLHSKNVIHRDLKAENLLLDADMNIKIADFGFSNTFSPGNKLDTFCGSPPYAAPELFQGKKYDGPEVDVWSLGVILYTLVSGSLPFDGQNLKELRERVLRGKYRVPFYMSTDCENLLKKFLVLNPIRRGTLEMIMRDKWMNMGYEEDELKPYTEPTKDVRDERRILKLQAFGYTLQQIHESLERERFDEIFGTYLLMKEAKKHDAQGQSLGGSGPNATAESPFNQSMGPTVPQSHGPTVSNAKNSRRSSSNAEQIQPQQHAITSHSVINQQSAAPIQQISATPQAIPSRQSQTAPGQVTFRTAQFTSRQPTLSVQPQAYIHPIQSANVRNITATSSASSGGRKGSAPAGRVPLPNLGLRHGINQPGVSYRYAPPVPGSGSSEKPNGGSSSARGAPPPTFFNQQLQTPIAPNPISAKLVAKATHQMNSNLISTSSVMQXSISHAPREPSIKEEPMGGDTAKDDDNGSDKFWSMATKTTSQHGEAPAIPTXPKKRTSIELCEATQIGHREELGQLVSPKPATDRTAPTADFIRMGLHQSPSMPPMVMKALAANDNDFTISSTASDEAATTTEGKLTKSATGAHISADPTLSHIVDIGAQTSTAVQNANFPRGSRNRQTFHGKTEHTKSATDDPESDHDEGITNAQNTIPPNAQRGSFLSKLTKLTKRTGMDPASPAAQSLSGSNSQQPPLKTHGVMRAGTIGSAAGTAFTQPQQQQQQHVQQLFQQQQPPSAFSAPNTPNQQQQNISQQQLTPAAAQLGTANSPCPLGIEEVKPRSLRFTWSMKTTSSLAPDEIMKEIRKVLDSNGCEYEQRERYLLLCAHGDPSKDSLIQWEMEVCKLPRLSLNGVRFKRISGSSIGFKNIASKIAQELNL

SEQ ID NO: 5631 - protein, 1224 aa, Ustilago maydis
MAVVDVGFSGYFWLAIKSFAARVICLLSDSGLRSAVSDRMPTKSRKSAPSKFAFFLDQQETFSLHISIFEPLGAVGVAPFQTDNRISLHRVFDRLPDTALQGGHGRATRSQRNFLSTDKSTKSFGSPIDIRFGPLRIDWAERAQDKEMSQASQYRNASSSSTSVGPATVTASASELTKASRRRNVFHAKQPQVALPVASFEKTDSFQGDVSGSKEAESRLASCTEMFQGMTIGATEVAFGIVHLFRDKQDATSNATPTRRAASTTGQTALENQIPEQDIGAVVAVLAVPAYLTASHFLSYIEPAVEAITHLRMLRDMHPNRCMVLIRFRDAKDAEDFHKMYNGQPFNAMDPQEICQVVYITSLTVSKHSSLPFSYPTLTNSDPWPLRPPANAVNQPAYELPTCPVCLERMDSSVTGLMTISCQHTFHCSCLSKWGESRCPVCRYSQTGQPSMHQRRRTPRSSMDPSTPVRQANQVGGSDADESDAESDLDEPSCCAVCETQQDLWVCLVCASVGCGRYKHGHAHRHFSETGHLYSLELETQRVWDYAGDGYVHRLIQNKADGKLVELPSASSATATPEHSSTLPASASYASAMSMSGTKHSGPPAIHSRGDNTRPPYDAQERRRQQQQQQRDQNYAIRDQDSCRSADDQLEAIGMEYSYLLTSQLESQRHFYEDKLDQFQAQLASLTGDLEMLSRKSQLIDELSARTAELERTNEQLRRDKDKSDKKADKAIELARTLERDLHSERSMNKGLMDRLEKTKESEVGLKAQVTDLQEQVSDLMFFVQARDKLDQEGSEAQGGDVEKLDSTFGNAFVISGRNARCGTGGSSTHPPITSLKLESKLIWPVLEKKTLRVMQHGGGKSTKHNPQSTKHEAIVNLCNVLYSYHLPARQTKPREYYIMSLNKTFTLNDGNKIPLIGLGTWLSKPGEVENAVEIAVKAGYRHLDLAKIYQNQDEVGAALKKVIPSVVKREELFITSKLWNTSHQPDKVEAAYNETLKELGLDYLDLYLIHWPVAFQPGSDLVPKTEDGKFTALDLETSLVDTWKALIALQKAGKVKSIGVSNFTIAHLDAIINATGVVPAVNQIEAHPLLPQDDLVAYAQQKNIHLTAYSPLGNNLTGKTKIVDYPQVSEVAKKYNADPAQVLIAWGVKRGYSVIPKSVTETRIKSNFEQLELKDDDYETVTSLYKQLGKVRFNVPFTYSPQWDINVFGEDAEKEAKNEVKTE

SEQ ID NO: 5632 - protein, 196 aa, Glycine max
MVLSKTTSESDVSVHSTFASRYVRTSLPRFKMPEESIPKEAAYQIINDELMLDGNPRLNLASFVTTWMEPECDKLIMAAINKNYVDMDEYPVTTELQNRCVNMIAHLFNAPLEETEAAVGVGTVGSSEAIMLAGLAFKRKWQNRRKQEGKPFDKPNIVTGANVQVCWEKFARYFEVELKEVKLRDDYYVMNVCYFG

SEQ ID NO: 5633 - protein, 466 aa, Streptococcus suis
MTKDKVFYQFPTNFLWGSSTSGPQSEGIEPGDGKGQNNWDYWYSIEPERFHNKIGPSQTSTFYKHYEKDIDLLVETGHTVFRTSIQWSRLIPTGTGEINQEAVSFYRSVFSLVRAKGIQLFVNLYHFDLPYCLQEKGGWENKEIVRAYEAYARTCFELFDDLVDRWITFNEPIVPVECGYLGNYHYPCKVDAKAAVAVAYHTQLASSLAVKACHEVNPHKKIAIVLNLTPAYPRSEQAEDIKAARIAELFQTKSFLDPSVLGEYPDELVELIDAYGLMPEVSDEELAIIKENRVDFLGVNYYQPLRVQAPTNSWKEGEPLTPEHFFAPYDMPGKKMNPHRGWEIYEKGIYDIAINIKENYHNIEWFVTENGMGVEGEGAFKDNGLIQDDYRIEFIEDHLIELHRAIQEGANCKGYMLWTFIDCWSWLNAYKNRYGLVELDLDTQERIVKKSGKWFKKLSDANGFHR

SEQ ID NO: 5634 - protein, 307 aa, Capsicum annuum
MIKGIVGNQQLGLPAGFRFHPTDEELVQHYLCRKCAGQSISVSIIAEIDLYKFDPWQLPEKALYGEKEWYFFSQEDRKYPNGSRPNRAAGTGYWKATGADKPVGKPKTLGIKKALVFYAGKAPRGIKTNWIMHEYRLANVDRSAGKSNNLRLDDWVLCRIYNKKGHTLRSITMWASKRGESFGEFEDEIKPKIFPTQLAPAPGQWPPRPQSTPASDYFNFETSESMTTTRMHTTNSSSGSEHVLSSCDKEVQSAPKWDDLGTAALDFQINYLDGLLNDPFEIQMQQQNCNIDQFNTFQDMFLYMQKP

SEQ ID NO: 5635 - protein, 444 aa, Zea mays
MGKRSGGRKLPFFTRSSSSSSKRNRSARRLPSLPKQDNATRALLASPSAASPSATPGSAAAGQTAQLPPPLSVTAGGGVAVSGKVNKKKAGTRLWMRLDRWSASEIVELDKASIIRRAGLPPRDLRILGPVFSRSSSILAREKAMVINLEFIRAIVTAEEVLLLDPLMHEVLPFVDQLRQHLPLRSRVGENGECAPDGNGEKQKGSLNEATGAEHELPFEFHVLEVALEVVCSSLDLSVSDLERHATPVLDELTKNVRDEIEHLLDDNEDMEHLYLTRKQVQNQQVEALMSSAASNSIVLAGTGVPRLNSSFRRSLSIATSMHLDNDVEDLEMLLEAYFMQLDGIRNRILSVREYIDDTEDYVNIQLDNQRNELIQLQLTLTIASFGIAANTFIAGAFAMNIPGSLFNTDGSLFWPFVGSTSSGCFVITVLLLGYAWWKKLLGP

SEQ ID NO: 5636 - protein, 349 aa, Thermus thermophilus
MGLLFTPLELRGLRLKNRLAMSPMCQYSATEGGEVTDWHLLHYPTRALGGVGLVIVEATAVLPEGRISPFDLGIWSEDHLPGLRELARRIREAGAVPGIQLAHAGRKAGTARPWEGGRPLGWKVVGPSPIPFAEGYPVPEALDEAGMARVLEAFVEGAKRALRAGFLVVELHMAHGYLLSSFLSPLANRREDAYGGSRENRMRFPLEVARAVREAIPPELPLFVRVSATDWAEGGWGLEDTLAFAERLKALGVDLLDLSSGGVVPGVRVPVAPGFQVPFADAVRKRVGMPTGAVGLLTTPEQAETVLQAGSADLVLLGRVLLRDPYFPLKAAKALGAEAPVPPQYQRAF

SEQ ID NO: 5637 - protein, 933 aa, Yersinia pestis
MTKYSLRARMMILILAPTLLLGLLLSTSFMVNRYNELQNQIVSAGTNIIEPLAVASEYGMSFRNRDTVRQLINLLHRRHSNIVRSISVFDVDNKLFVTSNYNYNSSQLRLPPGEPVPDSLMLSYRGDSLILRMPIVSESNLSSEQASGQGESDQILGYIAIDLDLQSVRLKQYKEIFISTLLLLFCMCVAILFAYRLMRDVTGPIRNMVNTVDRIRRGQLDSRVEGHMLGELDILKNGINSMAMSLAAYHEEMQQNIDQATSDLRETLEQMEIQNVELGLAKKRAQEASRIKSEFLANMSHELRTPLNGVIGFTRQTLKTSLTPTQTDYLQTIQRSANNLLCIINDVLDFSKLEADKLILEHIPFSLRETLDEVIILLAHTAHEKGLELTLHINNDVPDQVLGDAMRLQQIVTNLLGNAIKFTEEGNIDILVVVKAIASQQVTLMVEIHDTGIGISESQQAQLFQAFRQADASTSRRHGGTGLGLVITERLVKEMGGNISFQSQMSCGSIFRFHLTLELNESIPYRQPDMAHLEGKQLAYIERNSTAARATINILNTTPLQVTHRQSLAQLPEQHYDFLLVGVPIPFRNNMAIHQDKLLTALKIADHVILALPSQSQVEAEQLKQIGAKDCLLKPISSIRLIPLLLAEDTHSKVPSEEQPRKQPKLPFRVMAVDDNPANLKLIGTLLEEQIEETVLCDSGAMAITYAREHTLDIILMDIQMPEIDGIRASEIIHQIPHHQETPIIAVTAHAVKGQQEQLLRLGMADYLAKPIDEARLLQVLSRYQSDNPPLSTASTASTASTASTASTAESLPLPVPKGAGVIDWAQAVRQAANKEDLARDLLTMLLEFMPQITARVQAILAGADDGDILNLVHKFHGSCACSGVPRLRQLCMTIELQLRQQVNLQDLEPEWLELLDEIENVSEAAKTYLRTE

SEQ ID NO: 5638 - protein, 437 aa, Arabidopsis thaliana
  misc_feature (14)..(14): Xaa can be any naturally occurring amino acid
MGSTLKHLLLLLLXLIRHVDSAAIVKSLPGLEGRLPFELETGYIGIGEEEDIQLFYYFIKSENNPKEDPLLLWLDGGPGCSSLGGLLFENGPVALKSAVYNGSNPSLFSTTYSWTKMANIIYLDQPVGSGFSYSRTPIGKSSDTSEVKRIHEFLQKWLSKHPQFFSNPFYVTGDSYSGMIVPALVQEISKGNYICCKHLINLQGYVLGNPITYAEHEKNYRIPFSHGMSLISDELYESLKRNCKGNYENVDPRNTKCVRLVEEYHKCTDKINTQHILIPDCDKKGHGITSPDCYYYLYFLIECWANNERVREALHVTKGTKGQWQRCNWTIPYDNNIISSVPYHMDNSINGYRSLIYSGDHDITMPFQATQAWIKSLNYSIVDDWRPWMINDQIAGYTRTYSNKMTFATVKGGGHTAEYLPNESSIMFQRWISGQPL

SEQ ID NO: 5639 - protein, 613 aa, Arabidopsis thaliana
MESCDCFETHVNQDDLLVKYQYISDALIALAYFSIPLELIYFVQKSAFFPYKWVLMQFGAFIILCGATHFINLWMFFMHSKAVAIVMTIAKVSCAVVSCATALMLVHIIPDLLSVKNRELFLKKKADELDREMGLILTQEETGRHVRMLTHGIRRTLDRHTILRTTLVELGKTLCLEECALWMPSQSGLYLQLSHTLSHKIQVGSSVPINLPIINELFNSAQAMHIPHSCPLAKIGPPVGRYSPPEVVSVRVPLLHLSNFQGSDWSDLSGKGYAIMVLILPTDGARKWRDHELELVENVADQVAVALSHAAILEESMHARDQLMEQNFALDKARQEAEMAVHARNDFLAVMNHEMRTPMHAIISLSSLLLETELSPEQRVMIETILKSSNLVATLISDVLDLSRLEDGSLLLENEPFSLQAIFEEVISLIKPIASVKKLSTNLILSADLPTYAIGDEKRLMQTILNIMGNAVKFTKEGYISIIASIMKPESLQELPSPEFFPVLSDSHFYLCVQVKDTGCGIHTQDIPLLFTKFVQPRTGTQRNHSGGGLGLALCKRFVGLMGGYMWIESEGLEKGCTASFIIRLGICNGPSSSSGSMALHLAAKSQTRPWNW

SEQ ID NO: 5640 - protein, 333 aa, Pasteurella multocida
MKTLGQFIVEKQAEYPNAKGELSGILSSIRLVAKVIHRDINKAGLTNNIIGTSGAENVQGETQMKLDLFAHNTMKQALISREEVAGFASEEEENFVAFDTERGRNAKYVILTDPLDGSSNIDVNVAVGTIFSIYRRVSPIGTPVTLADFMQPGNRQVAAGYIVYGSSTMLVYTTGNGVNGFTYDPSLGVFCLSHENIQIPANGKIYSINEGQYLKFPQGVKKYIKYCQEEDKATHRPYTSRYIGSLVSDFHRNMLKGGIYIYPSATNYPNGKLRLLYEGNPMAFLAEQAGGMASDGYQRILDIQPTELHQRVPLFLGSKEMVEKAQDFMKTFG

SEQ ID NO: 5641 - protein, 71 aa, Zea mays
  misc_feature (35)..(35): Xaa can be any naturally occurring amino acid
MNRPFTVQELVRFAVYEHNLKANALLGFEKLVKAXKTQVGAGTMYYLSLEVKDGEAKKLYEVNVWEKPWEN

SEQ ID NO: 5642 - protein, 485 aa, Candida dubliniensis
MAPTFTNSNGQPIPEPFATQRVGQHGPLLLQDFNLIDSLAHFDRERIPERVVHAKGSGAYGVFEVTDDITDVCAAKFLDTVGKKTRVFTRFSTVGGELGSADTARDPRGFATKFYTEEGNLDLVYNNTPVFFIRDPSKFPHFIHTQKRNPETHLKDANMFWDYLTSNEESIHQVMILFSDRGTPASYREMNGYSGHTYKWSNKKGEWFYVQVHFISDQGIKTLTNEEAGALAGSNPDYAQEDLFKNIAAGNYPSWTAYIQTMTEAEAKEADFSVFDLTKVWPHKKYPLRRFGKFTLNENPKNYFAEVEQAAFSPAHTVPYMEPSADPVLQSRLFSYADTHRHRLGTNYTQIPVNCPVTGAVFNPHMRDGAMTVNGNLGSHPNYLASDKPVEFKQFSLQEDQEVWNGAATPFHWKATPADFKQAQELWKVLKRYPNQQEHLAHNIAVHAAGADAAIQDRVFAYFGKVSQDLANAIKKEVLELSPRK

SEQ ID NO: 5643 - protein, 543 aa, Clostridium tetani
MEMAKSIMFGEDARRSMQKGVDILADTVKVTMGPKGRNVVLDKKFGAPLITNDGVTIAREIELEDAYENMGAQLVKEVATKTNDVAGDGTTTATLLAQAIIREGLKNVTGGANPMLVRRGIQMAVEEAVKGIKEISKPVEGKEDIARVAAISADDKEIGKLIADAMEKVGNEGVITVEESNTMGTELDVVEGMQFDRGYVSPYMVTDTEKMEASLDDAYILITDKKITNIQEILPVLEQIVQQGKRLLIISEDIEGEALATLVVNKLRGTFTCVAVKAPGFGDRRKEMLEDIATLTGGQVISEEIGRDLKDVTVDMLGRAESVKITKETTTIVNGKGNKKEIEDRVNQIKAQIEETTSEFDREKLQERLAKLAGGVAVIKVGAATETELKERKLRIEDALAATKAAVEEGIIPGGGTAYAMVIKEVEKLNSETHDIKLGIDIVKKSLEEPVRQIACNAGVEGSIVIEKVKHSEAGIGYDALNNEYVNMIKAGIVDPTKVSRSALQNAASVASTFLTTEAAIADIPEKNDTPMPGAPGMMDGMY

SEQ ID NO: 5644 - protein, 539 aa, Rhodopirellula baltica
MPKIIAFDQEAREAIRRGVSKLARTVKVTLGPKGRNVILQKSFGSPTVTKDGVTVAKEIELEDPYENMGASMVREVASKTSDVAGDGTTTATVMAEAIFNEGLKAVVAGVNPIQMKSGIETAVSDITEQLHSMAVKVKDQEAMANVATIASNNDREIGTLLADAMSKVGKDGVITVDEGKSLQTEQEWVEGMQFDRGYLSPYFVTDSTSMEVVLEDAYVLVFEKKISNIKDMVPLLEKVVQQGKPLLIIAEDVDGEALATLVINRLRGTFTVCAVKAPGYGDRRKAMMEDIAILTGGQAIFEALGVKLESVDLPQLGRAKKIIVDKDNTTVIEGGGKSADIKARIDQIRREIELSTSDYDREKLEERLAKLAGGVAKVNVGAATESEMKEKKARVEDALHATRAAVEEGILPGGGVALLRASGKVKAADTLTDDQLVGYNIVLRACRAPLTMISENAGQDGGIVCEKVLAMKGNEGYNALTDVYEDLVKSGVIDPTKVTRTALGNAASVATLLLTSDALVAEKPEKSGKAGHGGDHDMY

SEQ ID NO: 5645 - protein, 485 aa, Candida tropicalis
MAPTFTNSNGQPIPEPFATQRVGQHGPLLLQDFNLIDSLAHFDRERIPERVVHAKGSGAYGVFEVTDDITDICAAKFLDTVGKKTRIFTRFSTVGGEAGSADTARDPRGFATKFYTEEGNLDLVYNNTPVFFIRDPSKFPHFIHTQKRNSETHLKDANMFWDYLTSNEESNHQVMILFSDRGTPASYREMNGYSGHTYKWSNKKGEWHYVQVHFITDQGNKTLTNEEAGSLAGSNPDYAQEDLFKNMLAGNYPSWTCYIQTMTEAQAKEADFSVFDLTKVWPHGKYPLRRFGKFTLNENPKNYFAEVEQAAFSPAHTVPYMEPSADPVLQSRLFSYSDTHRHRLGTNYTQIPVNCPVTGAVFNPHMRDGAMNVNGNLGSHPNYLASDKPIEFKQFSLQEDQEVWHGAATPFHWKATPADFKQSQELWKVLKRYPNQQEHLAHNVAVHASAADAPIQDKVIAYFAKVSPELSNLIKKEILELSPRK

SEQ ID NO: 5646 - protein, 434 aa, Oryza sativa
MESRGKILMERYELGRLLGKGTFGKVHYARNLESNQSVAIKMMDKQQILKVGLSEQIRREITTMRLVAHKNIVQLHEVMATRNKIYFVMEYVKGGELFEKVAKRGKLTEVVAHKYFQQLISAVDYCHSRGVYHRDLKPENLLLDENENLKVSDFGLSALSESKRQDGLLHTTCGTPAYVAPEVISKIGYDGAKSDIWSCGVILFVLVAGYLPFQGPNLMEMYRKIQHGEFRCPGWFSRKLQKLLYKIMDPNPSTRISIQKIKESTWFRKGPEENRILKERTLNENTTKNVAPVLGVRRKKNAHEDVKPMSVTNLNAFEIISFSKGFDLSGMFIVKEWRNEARFTSDKSASTIISKLEDVAKALNLRVRKKDNGVVKMQGRKEGRNGVLQFDIEIFEVTTSYHIIEMKQTSGDSLEYRQLLEEGIRPALKDIVLA

SEQ ID NO: 5647 - protein, 362 aa, Cryptococcus neoformans
MAPQTVPCQYKTGKTLGSGTYAVVKECVHITTGEYYACKVLNKKFLMGREHMVRNEIAVLKRVSAGHKNIVQLHDFFETTHNLYLVFDLCTGGELFDRICAKGSYFEKDAANIVRTVTSAVKYLHDQGIVHRDLKPENILFKSKAEDADLMLADFGLSKVLDDDKFAILTTTCGTPGYMAPEIFKKAGHGKPVDIWAIGVITYFLLCGYTPFDRDSQYEEMQAICKGDYRFEPVEYWGGVSETARQFVRDCLTVDPTNRPTVDELLNHPWLRDVEASKDEPAEAKGVDLLPNVKAAFDAKKTFRKAVLGMMAVHRLQDHSATIHGQTEAEQEKLKKEVEAFKEEAAQEDVKDVIQPGAPASI

SEQ ID NO: 5648 - protein, 616 aa, Bacillus clausii
MCGITGWVDWQRNLRTETKQMKNMANTLNRRGPDALETWTSDHAAFGHARLVVVDPEGGKQPMTRTAKGNTCTIVYNGELYNTEELRKELLAHGHTFAGHSDTEVLLKAYMEWGAACLEKLNGIFAFAVWDEQEQTLFMARDRLGVKPLFYTEKDGMLLFGSELKALLAHSQIEAVVDRSGLADVMGLSPSRTPGHGIFKGIVELRPAHYLQFSKNGSAVKRYWQLQSNIHTETAHETAAHIRELLEDIVERQLFADVPVGMFLSGGVDSSALTAIAARIYEKQGNAPIFSYSIDYEENEKYFKASTFQPNADADWVEKVAAHCGTNHKNCIIGNDVLANLLKESVLVRDTPGMADVDSSLLWFCKQIKNDVTVGLSGECADEIFGGYPWFHKAEVMAIDGFPWMRSLDERIQLLQPDWQKRLNLQEYVYDRYKETIQETPRFDGDSPEEARRREISYLNMIWFMTNLLDRKDRMSMGASLEVRVPFSDHRLVEYVWNIPWEMKTYGGREKGILRKALQGLLPDDVLFRKKSPYPKTHHPLYTAAVTKAIQEVVRQKDAPLFTFINRDRLKEIADKGGFDTGKPYFGQLMAGPQLLAHFVQIDYWMKAYNIQIDES

SEQ ID NO: 5649 - protein, 403 aa, Arabidopsis thaliana
MATENLTDKNVVFRKLKSKSENKVCFDCSAKNPTWASVPYGIFLCIYCSAVHRSLGVHISFVRSTNLDSWSPEQLRTMMFGGNNRAQVFFKQHGWNDGGKIEAKYTSRAADMYRQTLAKEVAKAMAEETVLPSLSSVATSQPVESSENGFTSESPKESSLVKQEAAVVSSPKASQKVVASTFKKPLVSRKSGKTGGLGARKLTTKSKDNLYEQKPEEPVPVIPAASPTNDTSAAGSSFASRFEYFDDEQSGGQSGTRVLSHVAPPKSSNFFNEFGMDSAFPKKSSSSSSKAQVEETDEARKKFSNAKSISSAQFFGNQNRDADLDSKATLQKFSGSAAISSSDLFGHGPDDSNIDITASDLINRISFQAQQDMSSIANLAEETKNKLGTFASSIFSDLQDRML

SEQ ID NO: 5650 - protein, 661 aa, Bacillus cereus
MEQLKHHVTDNQRKHALTTNQGVKIAEDEFSLKMGLRGPTLMEDFHFREKMTHFDHERIPERIVHARGVGVHGYFQLYESLEAYTKADFLTNPSKKTPVFVRFSTVQGSKGSNDTVRDVRGFATKFYTDEGNYDLVGNNMPVFFIQDAIKFPDFVHAVKPEPHNDIPQGASAHDTFWDFVAHNPESTHMVMWQMSDRAIPRSLRMMEGFGVHTFRLINTAGKAHFVKFHWKPTLGVHSLVWDEAQRIAGKNPDFHRQDLYEAIEKGDYPEWELGLQLIPEEDEHKFDFDILDPTKLWPEEEVPVKLVGKMTLNKNVDNFFAETEQVAFHPGHVVPGIDFSNDPLLQGRLFSYTDTQLSRLGGPNFHQIPINQPVCPFHNNQRDGMHQMQIHRGQTSYHPNGLNNNQPATVQAEQGGYEHYQEKIDGHKIRGRSKSFLNFYSQAKLFYNSMSPIEKQHIKEAFCFEVGKCKSDMVKANVIALLNHVDRQLAQEVANIVGAPLPKENHEVNSDAKSPALSMSNTIFKSDSKNVAILLNGDPSVSLLSEWIQAFAQHRMNYSIIDNKIYHFNDSIKVTDTYTTTDSSLFDAVLVFSSESVIHPPVLEFTETTFKHFKPIAHVLSNPHALDNSKIKLDGAGVYNLTNTSIESFIEGIAQGRFWNR

SEQ ID NO: 5651 - protein, 153 aa, Bacillus anthracis
MSEEKKDSSRPPVRNYLKQIDDFFEQTPLRNVIADLNHFFQKGNRLLTFPVDLYEVGEELVVTAELPGIQKEQIQIEIQSEYLKVSVKEEILEEEEQTSHNYYRRERSISEASRLIKLPYSINKKAAKASYQNGVLEIRAPKLPQQHDILSID

SEQ ID NO: 5652 - protein, 633 aa, Bacillus anthracis
MCGFVGCLCENPREFSETEKHQFENMNTMIFHRGPDDEGYFRDEHVQFGFRRLSIIDLEAGHQPLTYENDRYVIIFNGEIYNYVELREMLLEKGATFATQSDTEVIIALYAHMKEKCVDYLRGMFAFMIWDREEKKLFGARDHFGIKPLYIAQQGDTTFFASEKKSIMHVMEDKGVNPTSLQHYFTYQYGPEPETLTIDVNKIEPGHYFVKEIGKEMEIHRYWKPYFNASSATKEEHIQAIRDVLYDSVKVHMRSDVPVGSFLSGGIDSSIIASIAREMNPNLLTFSVGFEQRGFSEVDVAKETAEKLGVKNHNVFISAKEFMDEFPKIIWHMDDPLADPAAVPLYFVAKEARKHVTVVLSGEGADELFGGYNIYREPNSLKMFSYIPSPGKSVLKALSGALKEGFKGKSFLERGCTPIEERYYGNAKIFREEEKAELMKYYNESVNYMDITKPLYNEIKDYDDVSKMQYIDMFTWLRGDILLKADKMTMANSLELRVPFLDKEVFDVASKIPTEFKIANGTTKAILREAARGIVPDHVLDRKKLGFPVPIRHWLKDEMHDWAINIINESKTEHLIDKQYVLNLLEAHCADKGDYSRKIWTVLAFMVWHQIYVEHKYDTNKFHEETKRAYSLV

SEQ ID NO: 5653 - protein, 715 aa, Vibrio vulnificus
MFEKLSQAACSEPFAFLGPFIDPTQGALRVWMPGATGVALVLEGQPRIALEREKESAFILKADLNLHLTHYQLAIDWNGVEQLVDDPYQYHGIYAEYDDLHTPKTMYQHMGSQFMTLERDGKSISGIRFLVYAPHATAVSLVGSFNDWDGRRHPMQRLDYGIWGLFIPDLAEGVSYKFEMKGPKGEGLPHKADPWGFYAEQYPSFASVTYDHARYQWQDAQWQTRPVTEKRKEALSFYELHAGSWKRNEQGEFLNYRELAAELVPYLVDMGYTHVELMPVSEHPFYGSWGYQPVGLFAPTSRYGSPDDFKFFVDACHQAGIGVVLDWVPAHFPSDDHGLANFDGTPLFHDPDPRRGWHQDWNSFIYDLGREQVRRFLVSNALYWFEQFHIDGIRVDAVASMLYLDYSRSHGQWIPNMDGGNENYDAIATLKWMNEEVYKYFPNAMTIAEESTAFPGVSAPTFMGGLGFGFKWNMGWMHDSLSYIKEEPVHRKYHHNTLTFPLVYAHSENYVLSLSHDEVVYGKGSIHNKMPGDEWQQTANLRAYFGYMYGQPGKKLNFMGAEIGQTAEWNHDDQLQWFLLDFPRHQGVQALTRDLNHLYRNQAALHDQDCIPAGFEWRLQDAAEQSIIAHERISEAGERILVVSNFTPVPRDEFRLGVPNKGRYQLLLNTDDSKYAGSGYEVVVDAKSEAVVSEDLAQSIVLRLPPLSTLFYKLV

SEQ ID NO: 5654 - protein, 255 aa, Xanthomonas oryzae
MRLIALPAFDDNYIWALVAADGRAIIVDPGQAAPVIATAEREGLVPSAILLTHHHGDHIDGVAELQQRWPGLELFSPADERIPTTAHHVSHGERLSLLAVDFQVIEVPGHTRTHIAFVTDRHLFSGDTLFSLGCGRMFEGTAPQMFDSLQRLACLPGETLVCCGHEYTLANAAFALHVDSTNAALQRRQQEAQAMRHAARPTLPISLKSELATNPFLRTNRPEIRAVVAARAAGALSSEVDVFAELRRWKDEFCL

SEQ ID NO: 5655 - protein, 731 aa, Bordetella parapertussis
MMRDSPSIQGTLDAATQHALLAGRHADPFSVLGPHQAGAHTVVRVLAPGARTVMAVLPGGQRTPLLPMQPGLFENTVPGLQPGAPAAYRLCIEWEGGIQHTADPYAFGPVLDTAQLDHCAAGGWRYLAGLLGAHAASVDGCAGTRFALWAPNARRVAVVGDFNGWDGRRHAMRLRYPAGVWELFLPDVGPGARYKFQVLGADGHTVLKADPLARQAEAPPATASIVPDERPFAWTDEAWMEQRAARQRCDAPISIYEVHAGSWFDDAGAPRWQSLAARLPEYARSLGFTHIELLPVMAHPFGGSWGYQPLGLFAPAAAHGAPADFAHFVDRCHEAGLGVILDWVPAHFPDDAHGLARLDGTPLYEHADPHEGRHPDWNTLIYNYGRREVRAFLIASAIHWLRHYHVDGLRVDAVASMLYRDYSRPAGQWIPNRHGGRENLEAIDFLRELNAAVGVQCPGAITVAEESTAWPGVTAPVANGGLGFDYKWNMGWMHDTLRYMRRDPIHRRHHHHDLSFGMVYAYAERFVLPLSHDEVVHGKGSLLGKMPGERAAQLAQLRLYYAFMWAHPGKKLLFMGGEFGQQGEWNHDAMLQWSLLDDPAHRGLQRLVADLNHVYATLPELHCRDADPSGFAWIVGDDADNSVLAFARVDASHCLVAVCNFTPVPRPGYRFGVPHAGDWRVRVDTGATRYGGAGGGPPICLRSEPIPAHGHPQSLVLDLPGFTALYLRHSE

SEQ ID NO: 5656 - protein, 643 aa, Mycobacterium avium
MCGLLAFVAARAGAVGADDAIARASHLMRHRGPDEPGTWAGADGSVVFGFNRLSIIDIAHSHQPLRWGPPETPDRYELVFNGEIYNYLELRDELAARHGAVFATDGDGEAIVAGFHHWGTDVLTRLRGMFAFALWDTVTRELFCARDPFGIKPLFVATGTGGTAVASEKKCLLELAELIGFDTAIDERAVQHYTVLQYVPEPETLHRGVRRLESGCYARIRPGAAPDVTRYFVPRFAAVPITRDTEQARYDEITAVLEDSVAKHMRADVTVGAFLSGGIDSTAIAALAIRHNPRLITFTTGFEREGFSEIDVAVASAEAIGARHIAKVVHPDEFVAALPEIVWYLDEPVADPALVPLFFVAREARKHVKVVLSGEGADELFGGYTIYREPLSLRPFDYLPRPVRRSMGKVSRPLPDGMRGKSLLHRGSLTLEERYYGNARSFSDTQLRDVLPGFRAEWTHTDVTAALYAQSIGWDPVARMQHIDLFTWLRGDILVKADKMTMANSLELRVPFLDPEVFAVASRLPVEAKITRTTTKYALRRALEPIVPAHVLHRPKLGFPVPIRHWLRAGELQDWAYSMVASSQAGHLVDLGAVRRMLDEHRNGVSDHSRRLWTVLIFMLWHAIFVEHSVVPQISEPVYPVQL

SEQ ID NO: 5657 - protein, 367 aa, Rhodospirillum rubrum
MATSQLFQPITLDGLTLPNRIIIAPMCQYSAKDGRTTGWHTIHLGQLALSGAGMLIIEATAVEPAGRISPADLGLWSDETEHALAETLAQVRAYSTMPIALQIAHAGRKASTAVPWEGGAQIAPDAGGWQTRAPSALPFDPSENPPVALTVADLTELREAFADTARRAARAGIDAIEIHAAHGYLLHEFLSPLSNRRSDAYGGSLENRLRFPLEVFDAVRAAFPAGKPVGVRVSATDWVEGGWSLEETIALAEALKARGCAFIHVSSGALSLDQKIPVGPGYQVPLARAIKAATGLPTIAVGLITEPEQAETILVSGDADMIGLARGILYDPRWPWHAAARLGQKIEAAPQYLRAAPHQAADLFKVV

SEQ ID NO: 5658 - protein, 584 aa, Astragalus sinicus
MCGILAVLGCADASRAKRVRVLELSRRLKHRGPDWSGLHQHGDCYLAHQRLAIVDPASGDQPLFNEDKSVIVTVNGEIYNHEDLRKQLPNHTFRTGSDCDVIAHLYEEYGEDFVDMLDGIFSFVLLDTRDNSYIVARDAIGVTSLYIGWGLDGSVWISSEMKGLNDDCEHFECFPPGHLYSSKNGGFRRWYNPLWYSEAIPSAPYDPIVLRQAFEKAVIKRLMTDVPFGVLLSGGLDSSLVASITSRYLATTKAAEQWGSKLHSFCVGLEGSPDLKAGKEVADYLGTVHHEFTFTVQDGIDAIEDVIYHVETYDVTTIRASTPMFLMSRKIKSLGVKWVISGEGSDEIFGGYLYFHKAPNKEEFHRETCRKIKALYQYDCLRANKSTFAWGLEARVPFLDKEFINVAMNIDPANKMINLDEGRIEKYILRKAFDDEEHPYLPKHILFRQKEQFSDGVGYSWIDGLKAHAAKHVTDKMMRNAANIYPHNTPSTKEGYYYRMIFERFFPQNSARLTVPGGPTVACSTAKAVEWDAAWSKNLDPSGRAALGVHASAYENQNNSVNKSIEFEKIIPLEASSVGVAIQT

SEQ ID NO: 5659 - protein, 423 aa, Xanthomonas oryzae
MSTAPQKPLAIRERLSEVRYEIRGELARRARELEAQGRKLIKLNIGNPGAFGFRAPEHLQRAIADDMGRTDPYTHQQGLLEAREAVAKAYARRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRALLERIVAIATKHNLLLLVDEIYDQVLYDGAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLSLVAPAGALYAFPAVVGAAARNFDDHAFALDLMNKEGVLVVPGSSFNVPYRHHFRVTLMPEASVMRDVFARIDRALARRAEAVTKVVPLKSRSVA

SEQ ID NO: 5660 - protein, 469 aa, Zea mays
GRVGGTFAKVYHARHVDTGDNVAIKVLDKEKAVKSGLVPHIKREIAVLRRVRHPNIVHLFEVMATKTKIYFVMELVRGGELFSRVSKGRLREDTARRYFQQLVSAVGFCHARGVFHRDLKPENLLVDEQGNLKVSDFGLSAVAEQFRPDGLLHTFCGTPAYVAPEVLGRRGYDGAKADVWSCGVILFVLMAGYLPFHDKNIMAMYKKIYKGEFRCARWFSKDLTSLLMRILHTNPNTRITLPEIMESRWFKKGFKPVKFYIEDDQLHNVIDDEDGLLDMGPAGPVPPPLPPPPPPLPPPKVDGDESGSDSDSSISSCPASMLSDESQRPRGSLPRPASLNAFDIISFSRGFNLSGLFEEKGDEVRFISAEPMSDIITKLEDIAKLKSFKLRRKDWRICLEGTREGVKGPLTIGAEIFELTPPLVMVEVKKKAGDNEEYENFCDKELKPGMQHLVHHMVRAPSMLLTDAK

SEQ ID NO: 5661 - protein, 698 aa, Sinorhizobium meliloti
MNLTFSELDFMKPELGAEYTGQGTHFAVFSAHAEKIELCLFSEDGREETARMPLPKREGDIWSGYIEGIGPGTLYGYRAHGPYDPHNGHRFNPNKLLLDPYAKLVAGDLIWDDALFGYTIGSPEGDLSFDERDSAPFMVKGVVQDPTFDWAGEEAIRRPWTETIIYESHVRGMTMTHPGVPDELRGTFLGMASDPIIEHLTKLGVSAIELMPVQYFLDDRYLVERNLRNYWGYQTLGFFAPHDRYLKGDRFTEFKTMVKRFHSVGIEVLMDVVYNHTAEGSERGPTLSFRGLDNFSYYRQSPDKPRHTYDTTGTGNTLNVAHPLVLRMVLDSLRYWVGVMHIDGFRFDLASTLGREYMEFDREGGFFDAIRQDPILAGVKLIAEPWDVGEGGYQLGGFPPPFREWNDRFRDDVRRFWKGDGGMVPVLAERILGSPVQFRHSDRAATSSINLVSAHDGFTLMDTVSYGEKHNEANGEENRDGHSDNHSDNMGAEGPTDNREIIEARKRRRAAMLATLMISQGVPMVLGGDELGNSQQGNNNAYCQDNEIGWLDWSGADDGFVDFCRKLLAFRKDRPVLRQERFLDGEPDENGRVEIAWYKADGSPMDEDAWHDAELRLICAYICRAGQGEAPPAGEIVLVLNAGGDCEIALPHGNGSRRWLRVLDTAADEPFGMRASADRDTIPAQSVVAFVPQEGSNG

SEQ ID NO: 5662 - protein, 432 aa, Oryza sativa
MAAAFSSTVGAPASTPTNFLGKKLKKQVTSAVNYHGKSSNINRFKVMAKELDEGKQTDQDRWKGLAYDISDDQQDITRGKGFVDSLFQAPTGDGTHEAVLSSYEYLSQGLRTYDFDNTMGGFYIAPSFMDKLVVHISKNFMTLPNIKVPLILGIWGGKGQGKSFQCELVFAKMGINPIMMSAGELESGNGEPAKLIRQRYREAADIIKKGKMCCLFINDLDAGAGRMGGTTQYTVNNQMVNATLMNIADNPTNVQLPGMYNKEDNPRVPIIVTGNDFSTLYAPLIRDGRMEKFYWAPTRDDRVGVCKGIFRTDNVPDEDIVKIVDSFPGQSIDFFGALRARVYDDEVRKWVSDTGVENIGKRLVNSREGPPEFEQPKMTIEKLIEYGYMLVKEQENVKRVQLAEQYLSEAALGDANSDAMKTGSFYGSAPSS

SEQ ID NO: 5663 - protein, 155 aa, Glycine max
MASDGAVATPAKVTPKKANLLDPHSIKHLLDETVAEVVKGKGYVENTRLGNWKLLIGTAVIAIALLAQFYPKKFPQNREFLLGCIALYVVMNVVLLILSYTKEKDAIIFTHSPAGSFNNTGLVISSKLPRFSDMYNLSIASADPESISAHKPVHF

SEQ ID NO: 5664 - protein, 415 aa, Oryza sativa
MATSEAAAISNPFAPLTNHQQEHPPPPPPPAKKKRNLPGTPDPEAEVIALSPRTLMATNRFVCEICGKGFQRDQNLQLHRRGHNLPWKLRQRSGKEPRKRVYVCPEKSCVHHNPSRALGDLTGIKKHFCRKHGEKKWKCDKCSKRYAVQSDWKAHSKTCGTREYRCDCGTLFSRRDSFITHRAFCDALAEETARLNAASGAAAAAAAATATSLCGQSYLFAGSGGPGMAGMRPNMMMPPQFDAAQLSWLYGNGKLSSSNASELTSATAAAKEAESVPSVFSNQQHAKPAAPTDMSATALLQKAAQIGAVTSTAAMPLVSPFEPTKPGGATASPADECGKFDGAALFAAASHHNANLGGAMSELTGAAGNVPYDVLSAVRHHAGLKDAGGVGREETRDFLGVGVQALCSSSIHGWI

SEQ ID NO: 5665 - protein, 404 aa, Haemophilus influenzae
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEDANWFPTIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIHSDEKMVLDLLRQEKVLLVHGKGFNWHSPDHFRIVTLPYVNQLEEAITKLARFLSDYRQ

SEQ ID NO: 5666 - protein, 601 aa, Sinorhizobium meliloti
MPASSTRAHFRDSWGANFIDSDTCRFRLWAPDEREVDLVLGGAVHKMQSLDGGWFEITLAAKAGERYCFRLADGTEVADPASSAQEREASGTSIVVDHAAYEWQTSSWRGRPWEEAVISELHVGCFTPEGTFRAAIERLPHLAGAGITAIEIMPVAQFPGVRGWGYDGVLHYAPHNAYGKPDDLKALVDAAHSLGLTVLLDVVYNHFGPEGNYLSRYASRFFNKDRPTPWGASIAFEEEAVRRYFIENALYWLGHFRFDGLRLDATEQIRDTTKPHFLVALEHEVREAFAERQIHLVLEDAHRRRSLLQRDASGARMLFDAAWNDDLHNALHVVATGETKGHYRLFADEPWGKIRSALAEGFAVPAKEDNFSPEGSRARVPPQGRVNFLQNHDQIGNRAFGERLASLLQEDSLRVLAAMHMLTPQIPLLFMGEEYGETQPFYFFSDYQGEIAAAIRLGRRDEAENFGGLPEGKTMDDLPDPLDPDVFAGSKLRWNRATSPAGERHLAYVRDLAVIRQRHIVPLIAGTAVPDGRAYETKDGIIAVDWQFGEACLELRVNLLHETHAVPAIRGQPIFTSETSSVETVYGSELAGPGIVVAIAR

SEQ ID NO: 5667 - protein, 198 aa, Trillium camschatcense
QVTFSKRRNGLLKKAFELSVLCDAEVGVIVFSPRDKLYEFSSTSMQSTIDRYRMHTKCVNTNMPTEHNTQQWKYEAVSMANKIELLEASKRKLMGESLEPCTVDELQELESQIERSLSNIRGRKDYLLEQQIEELKEKERRLLEDNELLRHKSEEETELQLATPKGVQYDHGSQQMELETELHIGWPPKVATQCISHA

SEQ ID NO: 5668 - protein, 550 aa, Legionella pneumophila
MIMAKELRFGDDARLQMLAGVNALADAVQVTMGPRGRNVVLEKSYGAPTVTKDGVSVAKEIEFEHRFMNMGAQMVKEVASKTSDTAGDGTTTATVLARSILVEGHKAVAAGMNPMDLKRGIDKAVLAVTKKLQAMSKPCKDSKAIAQVGTISANSDEAIGAIIAEAMEKVGKEGVITVEDGNGLENELSVVEGMQFDRGYISPYFINNQQNMSCELEHPFILLVDKKVSSIREMLSVLEGVAKSGRPLLIIAEDVEGEALATLVVNNMRGIVKVCAVKAPGFGDRRKAMLQDIAILTKGQVISEEIGKSLEGATLEDLGSAKRIVVTKENTTIIDGEGKATEINARITQIRAQMEETTSDYDREKLQERVAKLAGGVAVIKVGAATEVEMKEKKARVEDALHATRAAVEEGIVAGGGVALIRAQKALDSLKGDNDDQNMGINILRRAIESPMRQIVTNAGYEASVVVNKVAEHKDNYGFNAATGEYGDMVEMGILDPTKVTRMALQNAASVASLMLTTECMVADLPKKEEGVGAGDMGGMGGMGGMGGMM

SEQ ID NO: 5669 - protein, 576 aa, Schizosaccharomyces pombe
MQPQEVDLMENSTMRNGARVLPPEAISKRHIGPYIIRETLGEGSFGKVKLATHYKTQQKVALKFISRQLLKKSDMHMRVEREISYLKLLRHPHIIKLYDVITTPTDIVMVIEYAGGELFDYIVEKKRMTEDEGRRFFQQIICAIEYCHRHKIVHRDLKPENLLLDDNLNVKIADFGLSNIMTDGNFLKTSCGSPNYAAPEVINGKLYAGPEVDVWSCGIVLYVMLVGRLPFDDEFIPNLFKKVNSCVYVMPDFLSPGAQSLIRRMIVADPMQRITIQEIRRDPWFNVNLPDYLRPMEEVQGSYADSRIVSKLGEAMGFSEDYIVEALRSDENNEVKEAYNLLHENQVIQEKSHLSKSKRVDSFLSVSPPAFSEYTSELQKKSKQELIDPTLEGPRWTVSDPPTYAKQTIDSNICVLVPTAEKNKLEMRTLADAASAVDTSQSTRKKSRRNKWHFGVRCRGDAPEILLAVYRALQRAGAQFTVPKPVNGKYRSDMYTIKSRWEIPHCKREGKNTYAYIELQLYEVMPGCFMLDVKSNGYKDIYSHPERTADHGMDDLKSSFPFLDLCAMLVCKLFSA

SEQ ID NO: 5670 - protein, 469 aa, Streptococcus pyogenes
MVSVMWFRRDLRIDDQKALAHVIASQSPTLCVFQFNKEQLNLLHSRNQSSFITSVLAFRKLLKCEGIDLYLMYGDLMTCFEQLLTQLKDWTDVYFNYDESGYGRLRDQKAAQFFKKNGIAVHTYQDHYLHGSQEIINQSGQPYKVFTPYYRIWQNYPKETPIKVELSQGRWLNLETPDDVLRTVESFKDEKYQDVATFDEASKQLNRFIQDQLAAYHANRDFPAQLGTSRLSPFLRIGAIGIRTVYHAVRQAPNSLGQATFLKELAWRDFYNMVYVAYPDQKTQPIQKAFSQIEWVNNPDWFQLWKEGKTGYPIVDAAMLQLQKTGWMHNRLRMIVASFLTKDLLCDWRLGEQYFQQQLIDYDAASNIGGWQWAASTGTDAVPYFRIFNPVTQGKRFDPKGEFIKAYLPQLEHVPEKYLHEPWKMPKNLQESVSCIIGTDYPQPIVDHAKQREQAIAKYEWAKEKAKIE

SEQ ID NO: 5671 - protein, 195 aa, Thellungiella halophila
MTKMGFKPDSNPSPNPNESNAKEIRYRGVRKRPWGRYAAEIRDPGKKTRVWLGTFDTAQQAARAYDAAAREFRGAKAKTNFPTFLELNAAKDGGFARSPSQSSTVDSVSPTSARLVTPPQLELSLGGGGGGACYQIPVARRPVYFYNMTTFPAAAAATCGVQSESDSSSVVDFECGAEKKYRPLDLDLNLAPPAE

SEQ ID NO: 5672 - protein, 212 aa, Vibrio vulnificus
MRKVLLTGFEPFGGESINPSLELVKQMASRALPQVEIIGCEVPVVRYQAIETVLQAVETHQPDLVLMIGQASGRCAITPERVAINLDDYRIEDNAGHQPVDEPIIATGPAAYFSTLPVKAITHALQQAGIPCQLSHSAGTFVCNHLFYGVQHHLHTRAIRSGFIHIPLLPEQASASNQPSMSLETLVHGLEMMMMTCLETEQDTKHTGGTIC

SEQ ID NO: 5673 - protein, 316 aa, Colletotrichum gloeosporioides
MPAPFSARPCLAPFPPKQLFGVSQVLLQIRHPGCRGPGRLWTGLIRTHRISPGPATRILMASMSSAIRIHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYIRNLPFMPKKPFPQLFAQANPDALDLLDRMLAFDPSSRFSVEQALEHPYLHIWHNASDEPDCPTTFNFDFEVVEDVGDMRKMILEEVYRFRQLVRPSRQHPTGAQAAGQAGAGQVPFLWKPRLDSSDPD

SEQ ID NO: 5674 - protein, 586 aa, Astragalus sinicus
MCGILAVLGCSDDSQAKRVRILELSRRLKHRGPDWSGLHQHGDNYLAHQRLAIVDPASGDQPLFNQEKSIIVTVNGEIYNHEELRKQLPNHKFRTDCDCDVIAHLYEEYGENFVDMLDGIFSFVVLDTRDNSFLVARDAIGVTSLYIGWGLDGSVWIASELKGLNDECEHFEVFPPGHLYSSKEREFRRWYNPKWFSETVPSSPYDPLVLRHAFEKAVIKRLMSDVPFGVLLSGGLDSSLVASVTARYLEDTKAAKQWGAKLHTFCVGLKGAPDLKAGREVADYLGTVHHEFEFTIQDGIDAIEDVIYHTETFDVTTIRASTPMFLMSRKIKSLGVKMVLSGEGSDEIFGGYLYFHKAPNKKEFHEETCRKIKALYKYDCLRANKSTYAWGLEARVPFLDKDFINVAMDIDPEEKMIKRDEGRIEKWVLRKAFDDENKPYLPRHILYRQKEQFSDGVGYGWIDGIKDHAAKHVTAKMMLNASHIFPDNTPTSKEGYYYRMIFERFFPQNSARLTVPGGASIACSTEKAIEWDASWSNNLDPSGRAALGVHVSAYENQVNSSVGKGVEPEKIIPKMKVSPLGVAILG

SEQ ID NO: 5675 - protein, 549 aa, Erwinia carotovora
MAAKDVKFGNDARVKMLRGVNVLADAVKVTLGPKGRNVVLDKSFGAPTITKDGVSVAREIELEDKFENMGAQMVKEVASKANDAAGDGTTTATVLAQSIITEGLKAVAAGMNPMDLKRGIDKAVIAAVEELKKQSVPCSDFKAIAQVGTISANSDETVGKLIAEAMEKVGKEGVITVEEGTGLQDELDVVEGMQFDRGYLSPYFINKPETGSIELESPFILLADKKISNIREMLPVLEAVAKAGKPLLIIAEDVEGEALATLVVNTMRGIVKVAAVKAPGFGDRRKAMLQDIATLTAGTVISEEIGLELEKATLEDLGQAKRVVINKDTTIIIDGVGDEVAIQGRVTQIRQQIEDATSDYDKEKLQERVAKLAGGVAVIKVGAATEVEMKEKKARVEDALHATRAAVEEGVVAGGGVALIRAAASISVSGLKGDNEDQNVGIKVALRAMESPLRQIVINAGEEASVIANTVKAGEGSYGYNAYTEEYGDMIAMGILDPTKVTRSALQYAASIAGLMITTECMVTDLPKGDAPDLGAGGMGGMGGMGGMM

SEQ ID NO: 5676 - protein, 391 aa, Oryza sativa
  misc_feature (212)..(212): Xaa can be any naturally occurring amino acid
  misc_feature (229)..(229): Xaa can be any naturally occurring amino acid
  misc_feature (336)..(337): Xaa can be any naturally occurring amino acid
  misc_feature (346)..(346): Xaa can be any naturally occurring amino acid
  misc_feature (373)..(373): Xaa can be any naturally occurring amino acid
MSTTKVKRRVGKYELGRTIGEGTFAKVKFARDTETGDPVAIKILDKEKVLKHKMVEQIKREISTMKLIKHPNVVRIYEVMGSKTNIYIVLEYVTGGELFDTIVNHGRMREDEARRYFQQLINAVDYCHSRGVYHRDLKPENLLLDSYGNLKVSDFGLSALSQQIKDGGLLHTTCGTPNYVAPEVLEDQGYDGAMADLWSCGVILFVLLAGYXNAEFTFPPWTSFPAKRXVTIPEILEDEWFKKGYKRPEFDEKYDTTLDDVDAVFNDSEEHHVTEKKEEPEALNAFELISMSAGLNLGNLFDSEQEFKRETRFTSKCPPKEIVRKIEEAAKPLGLXXQKKNYKLRXEKVKAGRKGNLNVATEILQVAPSLHMXEVRKAKGDTLEFHKDHAN

SEQ ID NO: 5677 - protein, 738 aa, Arabidopsis thaliana
MEVCNCIEPQWPADELLMKYQYISDFFIAIAYFSIPLELIYFVKKSAVFPYRWVLVQFGAFIVLCGATHLINLWTFTTHSRTVALVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCMPGVENYQIALRIHEKFTKQRHQRPLLVALSGNTDKSTKEKCMSFGLDGVLLKPVSLDNIRDVLSDLLEPRVLYEGM

SEQ ID NO: 5678 - protein, 483 aa, Caulobacter crescentus
MQVRNDSGDSKANLDAVIVWFRKDLRIADNPALRHAAQSGRPVIPLYILDETPGIRPMGGASLWWLDKSLKSLAASLETLGTKLVLRKGVAAEVLDQLIAQSGARSVVWNRLYDKPSTDRDAAIKAALRDRGVDCQSFNAGLLNEPWTVKNGSDQPYKVFTPYWRAAREHLTDVAVTAAPGHLVAPARFPASESLASWNLHPTKPDWSKGFDLWTPGEAGAHARLDAFLKGPIKGYGDQRDIPGVEATSKLSPHLHFGEIGPRQVWLATRSAADQGDIPLAEADKFLSEIGWREFNHSILYNWPHMPSANFKPEFDGFPWVKDEGALEAWKRGQTGYPIVDAGMRELWTTGFMHNRVRMIVASFLIKHLMIDWREGEAWFWDTLLDADLANNVGNWQWTAGSGADAAPYFRIFNPIAQGEKFDPKGDYVRRWVPELRNVSDDVIHKPWTKPLHLPAGAKRLYSRPIVDHAMARARALEAYHGL

SEQ ID NO: 5679 - protein, 94 aa, Bacillus anthracis
  misc_feature (11)..(11): Xaa can be any naturally occurring amino acid
MKADLPGFQKXNIQVEFEQDVLTIQATNHNEVEEKNENGTYIRKERSIGSVTRRFSFKQVEEENVRANYKDGVLTIELPKLKEEKNSKTTINIE

SEQ ID NO: 5680 - protein, 255 aa, Mesorhizobium loti
MAVEIEQFMCRSDNFGVLVHDPKSGQTAIIDAPEEAPILAAIKRTGWTPTMILTTHHHMDHVEANLALKERFKLRIVGPEAEKAKIPGIDETVEEGSVLHLGDERIEVIATPGHTAGHVSYHLPASKVAFTADTLFALGCGRLFECKPPVMYESLRKLAALPAATTIYCGHEYTLANARFALTVDPTNSALKERATRIEALRVDNKPTLPTTIGEELSTNPFLRWHDPAIRKHLGMEKAGDAEVFAEIRKRKDNF

SEQ ID NO: 5681 - protein, 223 aa, Magnaporthe grisea
MTEEEIQQAIRDYATAAENAIEAGFDGVEIHAANGYLIDQFLQDTCNERTDAWGGSVEKRARFALEVTRAVVQAVGADRTGIRLSPYGTFQGMGMADPAPTFGYVVDQLRPLKLAFVHFVESEDGDHRSVDWLVKKVGGPVLVANGFTPESAKAAVDEKYKDSDVVVAFGRLFIPNPDLVFRIQNGVPVEPIDPTGDFYEAKTPKRFLDFPFSSEYQASIKAN

SEQ ID NO: 5682 - protein, 461 aa, Streptococcus dysgalactiae
NVVLEKAFGSPLITNDGVTIAKEIELEDHFENMGAKLVSEVASKTNDIAGDGTTTATVLTQAIVREGLKNVTAGANPIGIRRGIETATATAVEALKAIAQPVSGKEAIAQVAAVSSRSEKVGEYISEAMERVGNDGVITIEESRGMETELEVVEGMQFDRGYLSQYMVTDNEKMVADLENPFILITDKKVSNIQDILPLLEEVLKTNRPLLIIADDVDGEALPTLVLNKIRGTFNVVAVKAPGFGDRRKAMLEDIAILTGGTVITEDLGLELKDATMPALGQAAKVTVDKDSTVIVEGAGSSEAIANRVGLIKSQLETTTSDFDREKLQERLAKLAGGVAVIKVGAATETALKEMKLRIEDALNATRAAVEEGIVAGGGTALITAIEKVAALELDGDDATGRNIVLRALEEPVRQIAFNAGYEGSVVIDKLKNSPVGTGFNAATGEWVDMIAAGIIDPVKV

SEQ ID NO: 5683 - protein, 473 aa, Streptococcus dysgalactiae
VTLGPKGRNVVLEKAFGSPLITNDGVTIAKEIELEDHFENMGAKLVSEVASKTNDIAGDGTTTATVLTQAIVREGLKNVTAGANPIGIRRGIETATATAVEALKAIAQPVSGKEAIAQVAAVSSRSEKVGEYISEAMERVGNDGVITIEESRGMETELEVVEGMQFDRGYLSQYMVTDNEKMVADLENPFILITDKKVSNIQDILPLLEEVLKTNRPLLIIADDVDGEALPTLVLNKIRGTFNVVAVKAPGFGDRRKAMLEDIAILTGGTVITEDLGLELKDATMPALGQAAKVTVDKDSTVIVEGAGSSEAIANRVGLIKSQLETTTSDFDREKLQERLAKLAGGVAVIKVGAATETALKEMKLRIEDALNATRAAVEEGIVAGGGTALITVIEKVAALELDGDDATGRNIVLRALEEPVRQIAFNAGYEGSVVIDKLKNSPVGTGFNAATGEWVDMIAAGIIDPVKVTRSA

SEQ ID NO: 5684 - protein, 537 aa, Unknown
  Dehalococcoides sp. CBDB1
MAKQIIFGEKVRVSLKKGVDTLANTVRVTLGPKGHPVALERKWGAPTVIDDGVTIARDIELPDAFENMGAQLVKEAATRTSDAAGDGTTTSIVLAQAIINEAFKNIAAGAEPINLKRGIEKAVAALKAQLRKNSTPVKGKQQIVQVATITGKDPEIGNLIADVMDKVGKDGVITIEESRGLRYETSYVEGMQFDRGYISAYFVTDPGRMESVMEDATILMTDRKIETVAELLPALEKILQISKNLVIVAENVEAEALATLVVNKLRGNLNILAVKAPGYGDRQKAMLEDMAILTGGHVISKEAGRKLDSVTEADLGHARRIVSNKDKTTIIDGEGSAEAIKDRIKQIKAQIEETESAFDREKLQERQAALVGGVAVIAVGAATETEMKERKARVEDALAATRAAIEEGILPGGGTGLLNALPCLDALKLEGDEATGVNIVRKALIEPVRWIATNAGKDGNVIVDKVKNSPVGHGYNAENDVFGDMAEMGIIDPTMVVRSALENAASIANMVLITDSLVADIQEKAPAAPGPEAAGMY

SEQ ID NO: 5685 - protein, 458 aa, Bacillus cereus
MDENYDKQRQSLLGKDFNDNEERNEQAILHSQTVGSRGPVLEQDSVLHEALQQFIHEKILERPVHVKGFGAFGYFQTIYPMSEHTKLSFLQHSNEKVPVMVRFSLAVSTKGTPDTSRNVRGFSTKFYTKEGIFDLLCNHIPVFSVRDPMRFPETIQALSPSPKNNLIDPNRFWSFVARAPESIHFVVRLYSDNGTAKSLRHIPGHSVNTYVWRNAEGNRKYVKYHWYPFEGVQFITSEEANKLAAENPDYSGKDLYDAIANGKPVEYGLYVQLMDPKDEAHLSYDPLDDTKIWDEKAYPLIPVGKMVLNKNPENFMEQIEKVAFSPSNLLDGAELSDDKMLQGRANIYSDSQRKRIGPEFRKLTINQQQNWTPANQITSGDGRYVDGKLERTSISKQDDFTQAGEFYATLKPIEKEHLAENLAGDLKVISDDIRKVVLEYFHNVSVDLVKRIETEIKK

SEQ ID NO: 5686 - protein, 636 aa, Vibrio cholerae
MCGVAGFISKRLSPVDCLTSMVGSIMHRGPNDSGLWVDDDFGVCLAHARLSIQDLSSAGHQPMHSKSERYVMIFNGEIYNHLTLREELIEIVPSYWNGHSDTETLLAGFEVWGIEQTIQKCVGMFAIVLWDKVLKQLILIRDRFGEKPLYYGWQRDTFLFASELKALKAHPSFEGSINRQALSHFFRLNYIPTPLSIYEGIFKLEPGVIAVFSHEGQLLSKQTFWDASHAVSLQNFSDHDAVDKLDDLIKQSIQDQALSDVPLGAFLSGGVDSSTVVGILQSLSTRPVKTFTIGFDHADFNEASEASDVAKHLGTDHVELIVSAEDALAIINQLPVMYDEPFADASQVPTFLVSKLAKKEVTVCLSGDGGDELFCGYNRYHYTAKVWSYLEKIPFPIRKMLSVFLLTLSPSSWDVLSKTLGLNTRLPNLGNKIQKGAQALKARDIEDLYTRVVSNWDLDEPLVKNTAVEKLPFLSDLTELSHLNDLEKMMLWDKQSYLMDDVLVKTDRATMACSLEGRVPLLDHRIAEFAASLPIHLKYRGGKGKWLLREVLYRYVPKKLIERPKKGFSLPIAEWLRGPLKDWANVLLDSDRIDKEGFLSSELVQKKWREHLAGKRDWSSQLWSVLMFQLWLEKNK

SEQ ID NO: 5687 - protein, 462 aa, Agrobacterium tumefaciens
MVCRLIPNHGGPQKIPEGRTMIRKVSLLLIGGLMGATAMSVIYSASMPAQAAGPSTYKELSIFGDVFERVRAQYVTPPDDEKLVENAINGMLSSLDPHSSFMNAKDANDMRTQTKGEFGGLGIEVTMENELVKVISPMDDTPASRAGILAGDYISEIDGTPVRGLKLEQAVEKMRGAVKTPIKLTVIRKGADKPLEFTVVRDVIAVRAVKSRVEGDNVGYLRVISFTEKTYDDLEKAIKKIKADVPADKLKGYVLDLRLNPGGLLDQAINVSDAFLERGEVVSTRGRNPDETRRFNATAGDLTDGKPVIVLVNGGSASASEIVAGALQDLRRATVVGTRSFGKGSVQTIIPLGEAGALRLTTALYYTPSGKSIQGTGIEPDIKVEQPLPAELQGRVTAEGESSLSGHIKGQSETDEGSGSSAYVPPEAKDDIQLNYALDLLRGAKTDPSFPPNPDKAVVNKQ

SEQ ID NO: 5688 - protein, 301 aa, Arabidopsis thaliana
  misc_feature (269)..(269): Xaa can be any naturally occurring amino acid
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWEXFFIQTMDPQARSWSHQVGQSQTYPHLQDPWSG

SEQ ID NO: 5689 - protein, 456 aa, Coxiella burnetii
MSLKRKIIAIVVAAFISPGLTTVFAFSPPFLPKTLISTPAEDKNDELSRKDVERFVTAIALVHQYYIKNMSNKKLLDSAISGMMANLDPHSSYLDNNDLKELKTTVSGEFVGVGIELTVSKDGLLKVISPLEDSPAARAGIQPNDYIVKIDDQLVQNMSLPEAVSRIKGKKETTVKLTVLRKSANKPLIFSIQREPIHLVSVKSKTLEPGYGYVRITFFQGPVENQLRDAIDKLKKESQGPLKGLVLDLRNNPGGLLDVSAQVADSFLDASKMHRYNDLIVYTKGRVPGADIQIKATPGDLIPHTPMVVLINGGSASASEIVAGALQDYKRAIIMGTPSFGKGSVQTVLPIGKEDAIKLTTALYYTPAGREIQAKGIIPNVAVPEFSITPPKSQLSLDEADFQNHLPNDGAASTKANPTTAEEEKNLLQIQLQLAKTDYQLYQALMMLQGLQVVKH

SEQ ID NO: 5690 - protein, 190 aa, Arabidopsis thaliana
MEEKKTESATKNVKKVNLLDHIAIKHLLDESVSDIVTSRGYKEDVRLSNVKFLLGGIIIVVALVAQFYNKKCGICLLLDFGKYVVLTAVMQLILYIKEKNAILFTYPLEGSFTSTGLVVSSKLPRFSDQYTLTIDSADPQSISAGKSVQFTKSVTQWLTKDGVLVEGLFWKDVEALVKEYTEAGEPKKKR

SEQ ID NO: 5691 - protein, 735 aa, Brassica oleracea
MEVCNCIEPQWPADELLMKYQYISDFFIAVAYFSIPLELIYFVKKSAVFPYRWVLVQFGAFIVLCGATHLINLWTFTTHSRTVALVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQHPVEYTVPIQLPVINQVFGTSRAVKISPNSPVARLRPVSGKYLLGEVVAVRVPLLHLSNFQINDWPELSTKRYALMVLMLPSDSARQWHVHELELVEVVADQVAVALSHAAILEESMRARDLLMEQNVALDIARREAETAIRARNDFLAVMNHEMRTPMHAIIALSSLLQETELTPEQRLMVETVLKSSSLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDNRAPPDFFVVPTGSHFYLRVKVKDLGAGINPQDIPKLFTKFAQTQSLATRSSGGSGLGLAISKRFVNLMEGNIWIESEGVGKGCTAIFDVKLAISNESKQSGIPKVPANPQHVNFAGLKVLVMDENGVSRMVTKGLLVHLGCEVTTVSSNEECLRVVSHEHRVVFMDVCTPGVENYQIALRIHEKFTKRHQRPLLVALTGNTDKSTKEKCMSFGLDGVLLKPVSLDNMRNVLSDRLEHRVLYEAM

SEQ ID NO: 5692 - protein, 493 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEPRLTHEIRGIWISYWSQVRTKKHSVKFLRPFYQVSAN

SEQ ID NO: 5693 - protein, 544 aa, Treponema pallidum
MAKQLLFNEEARKKLLSGVEQISSAVKVTLGPKGRNVLLEKGYGAPTVTKDGVSVAKEVELEDPFENMGAQLLKEVATKTNDVAGDGTTTATVLAYSMVREGLKAVAAGMTPLELKRGMDKAVAIAVDDIKQNSKGIKSNEEVAHVASVSANNDKEIGRILASAIEKVGNDGVIDVDEAQTMETVTEFVEGMQFDRGYISSYFVTDRDRMETVYENPYILIYDKSISTMKDLLPLLEKIAQTGRPLLIIAEDVEGEALATLVVNSLRGTLKTCAVKAPGFGDRRKEMLEDIAILSGGQVISEDLGLKLESADIALLGQAKSVKVDKENTTIIDGSGKSKDIKDRIEQIKKQIEASTSDYDSEKLKERLAKLSGGVAVIKIGAVTEVEMKEKKHRVEDALNATRAAIEEGIVAGGGLALIQAAAALEKADLSGLTPDEAVGFKIVRRALEEPIRQISENAGIDGAVVAEKAKEKRGIGFDASKMEWVDMIKVGIIDPAKVTRSALQNAASVSGLLLTTECAIAAIPEKSSSTPPAPDMGGMGGMY

SEQ ID NO: 5694 - protein, 592 aa, Cryptococcus neoformans
MCGIFCCFNRAGDISQYRARAIACSKRQRHRGPDWSGCYMTNNTVLVHERLAIVGVDTGAQPLTNEDESLVLAVNGEIYNHVALRKSLKNKDAVFKTHSDCEVIMHLYKEHDTGLCNMLDGMFSFVLVDKSVSPPRLIAARDPIGITTLYMGWNSQSPDTLYFASELKCIHEECDNLQAFPPGHFYDSKEKKLTRYFNPSWWDSDKGVVPHNDIDYKLLRETLEAAVKKRLMSEVPYGVLLSGGLDSSLIASIAARETDKLAEEQEKLRQERKQAIASGKWVGDEQPLASWPQLHSFAIGLPGAPDLIAARKAADFLGTIHHEYNFTVQEGLDAIPEVIHHLETYDVTTVRASTPMYLLSRKIKAMGVKMVLSGEGSDEIFGGYLYFHAAPTAKDFHEECVKRVKNLHTADCLRANKSTMAWGLEARVPFLDKTFLEVSMNVDAKYKMFSKGTHQEVDEDGRPKMEKYILRKAFDCSPEGKAYLPDSILWRQKEQFSDGVGYSWIDGMKDHAAAIVSDEKFANRATRWPLDTPDTKEAYWIREIFEHHFPTEAAAKTAVRWVPKQEWGVSSDPSGRAVSIHTAAYADGEAKA

SEQ ID NO: 5695 - protein, 582 aa, Oryza sativa
MLHFLSSSSPLNPQFLLLPRQSARLRVLLSIPVSAMSSSSSSSSRGALAAAAVPSLSADEAGAAADEAFLRYTSPSMRRSGGGGVAIVWFRNDLRVLDNEAVVRAWAASDAVLPVYCVDPRISAGSTHYFGFPKTGALRAQFLIECLEDLKRNLTKQGLDLLIRHGKPEDILPSIAKAVTAHTVYAHKETCSEELLVEHLVRKGLEQVVIPQGGASNQKKPRNPKLQLIWGATLYHVDDLPFSVNNLPDVYTQFRKAVESKSSVRNCSKLPPSLGPPPGSGLDEIGGWGTVPTLESLGLSMTKAEKGMHFVGGESAALGRVHEYFWKKDQLKVYKETRNGMLGPDYSTKFSPWLASGSLSPRYICEEVKRYEKQRIANDSTYWVLFELIWRDYFRFISAKYGNSIFHLGGPRNVESKWSQDQALFESWRDGRTGYPLIDANMKELLATGFMSNRGRQIVCSFLVRDMGIDWRMGAEWFETCLLDYDPASNYGNWTYGAGVGNDPREDRYFSIPKQAKTYDPDGEYVAYWLPELRSIAKERRNFPGASYIKQVVPLKFDGGHQKRDQQFNRQRRPGHMYRRQK

SEQ ID NO: 5696 - protein, 464 aa, Listeria monocytogenes
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVCYKLKNDANVKWTLYDLADRLQMRGWQVPAYPLPKSLENIIIQRYVCRADLGFNMAEEFIQDFQASIQELNNAHILFHNTQQSGVHGFTH

SEQ ID NO: 5697 - protein, 323 aa, Unknown
  Acinetobacter sp. ADP1
MSNLTLAQYLQQKNGNLTPELAQVIETIANSCKKIDHAIQKGALADLLGSAGNENVQGETQKKLDVLSNDFLIDALKVHPHVGGLASEELDEFTPGQQDGKYLVLFDPLDGSSNIDINMCVGTIFSILPAKNSITQTQDFMQAGTEQVAAGYVLYGPSTMMALTCGEGVAFFTFDPESQTFILTSDAIQLDADTQEFAINASNQRHWEEPVKRYIDELLAGKTSVRGKDFNMRWVACMVADIHRILCRSGIFMYPYDLKDPSKAGRLRLMYEANPMSFLIEQAGGSATTGRVRIMDIQPNDLHQRVPVIIGSKNEVDLVTSYH

SEQ ID NO: 5698 - protein, 473 aa, Streptococcus dysgalactiae
TVKVTLGPKGRNVVLEKAFGSPLITNDGVTIAKEIELEDHFENMGAKLVSEVASKTNDIAGDGTTTATVLTQAIVREGLKNVTAGANPIGIRRGIETATATAVEALKAIAQPVSGKEAIAQVAAVSSRSEKVGEYISEAMERVGNDGVITIEESRGMETELEVVEGMQFDRGYLSQYMVTDNEKMVADLENPFILITDKKVSNIQDILPLLEEVLKTNRPLLIIADDVDGEALPTLVLNKIRGTFNVVAVKAPGFGDRRKAMLEDIAILTGGTVITEDLGLELKDATMPALGQAAKVTVDKDSTVIVEGAGSSEAIANRVGLIKSQLETTTSDFDREKLQERLAKLAGGVAVIKVGAATETALKEMKLRIEDALNATRAAVEEGIVAGGGTALITVIEKVAALELDGDDATGRNIVLRALEEPVRQIAFNAGYEGSVVIDKLKNSPVGTGFNAATGEWADMIAAGIIDPVKVT

SEQ ID NO: 5699 - protein, 397 aa, Lycopersicon esculentum
MGRGKVELKRIENKINRQVTFAKRRNGLLKKAYELSILCDAEIALIIFSSRGKLYEFCSNSSMSKTLERYHRYNYGTLEGTQTSSDSQNNYQEYLKLKTRVEMLQQSQRHLLGEDLGQLGTKDLEQLERQLDSSLRQIRSTKTQHILDQLAELQQKEQSLTEMNKSLRIKLEELGVTFQTSWHCGEQSVQYRHEQPSHHEGFFQHVNCNNTLPISMEQILERYERYSYAERRLLANNSESPVQENWSLEYTKLKARIDLLQRNHKHYMGEDLDSMSLKDLQNLEQQLDSALKLIRSRKNQLMHESISELQKKERAILEENNMLTKKIKEKDKIVEQQGEWHQQTNQVSTSTSFLLQPHQCLNMGGNYQDEVAEARRNNELDLNLDSLYPLYNMNKHL

SEQ ID NO: 5700 - protein, 266 aa, Bordetella pertussis
MQTAPPLSAVVPLPAFSDNYIWALAHEGQAAVVDPGDAAPVLRWLRATGATLRAILLTHHHPDHVGGVLELVQATGATVYGPAGETLPHCDVRLAEGDRVTLPELALALEVLDVPGHTAGHIAYTGRAAGVERVLFCGDTLFAGGCGRLFEGTPAQMLDSLEKLSALPADTQVCCAHEYTLANLRWALAVEPANRTLQQWYQRAQELRNEGTPTLPSTIGQERETNPFLRTPHAAVAHAAAVWSGRSLATPVEVFAALRQWKNNFK

SEQ ID NO: 5701 - protein, 580 aa, Brassica rapa
MCGILAVLGCVDNSQATRSRIIKLSRRLRHRGPDWSGLHCYEDCYLAHERLAIIDPISGDQPLYSEDKTVVVTVNGEIYNHKALRESESLKSHKYHTGSDCEVLAHLYEEHGEEFINMLDGMFAFVLLDTKDKSYIAVRDAIGVIPLYIGWGLDGSVWFASEMKALSDDCEQFMAFPPGHIYSSKQGGLRRWYNPPWFSELVPSTPYDPLVLRDTFEKAVIKRLMTDVPFGVLLSGGLDSSLVASVAIRHLEKSDARQWGSKLHTFCIGLKGSPDLKAGKEVADYLGTRHHELHFTVQEGIDAIEEVIYHVETYDVTTIRASTPMFLMSRKIKSLGVKMVLSGEGSDEIFGGYLYFHKAPNKKELHEETCRKIKALYQYDCLRANKSTSAWGVEARVPFLDKAFLDVAMGIDPEWKMIRPDLGRIEKWVLRNAFDDEKNPYLPKHILYRQKEQFSDGVGYSWIDGLKDHANKHVSDAMLTNANFVFPENTPLTKEAYYYRAIFEKFFPKSAARATVPGGPSVACSTAKAVEWDAAWKGNLDPSGRAALGVHVAAYEGDKAEAPRPEKVQKLAEKTAEAIV

SEQ ID NO: 5702 - protein, 474 aa, Streptococcus dysgalactiae
KVTLGPKGRNVVLEKAFGSPLITNDGVTIAKEIELEDHFENMGAKLVSEVASKTNDIAGDGTTTATVLTQAIVREGLKNVTAGANPIGIRRGIETATATAVEALKAIAQPVSGKEAIAQVAAVSSRSEKVGEYISEAMERVGNDGVITIEESRGMETELEVVEGMQFDRGYLSQYMVTDNEKMVADLENPFILITDKKVSNIQDILPLLEEVLKTNRPLLIIADDVDGEALPTLVLNKIRGTFNVVAVKAPGFGDRRKAMLEDIAILTGGTVITEDLGLELKDATMPALGQAAKVTVDKDSTVIVEGAGSSEAIANRVGLIKSQLETTTSDFDREKLHERLAKLAGGVAVIKVGAATETALKEMKLRIEDALNATRAAVEEGIVAGGGTALITVIEKVAALELDGDDATGRNIVLRALEEPVRQIAFNAGYEGSVVIDKLKNSPVGTGFNAATGEWVDMIAAGIIDPVKVTRSA

SEQ ID NO: 5703 - protein, 547 aa, Rickettsia sibirica
MATKLIKHGSKAREQMLEGIDILADAVKVTLGPKGRNVLIEQSFGSPKITKDGVTVAKSIELKDKIRNAGAQLLKSAATKAAEVAGDGTTTATVLARALAREGNKLVAAGYNPMDLKRGMDLAVNAVVEEIKKSSKKINSQEEIAQVGTISSNGDKEIGEKIAKAMEEVGKEGVITVEEAKNFSFDVEVVKGMMFDRGYLSPYFVTNSEKMVAELENPFILIFEKKLSNLQPMLPILEAVVQSQRPLLIIAEDVEGEALATLVVNRLRGGLKVAAVKAPGFGDRRKAMMEDIAILTKGELITEDLGMKLENVSIKSLGTAKRVTISKENTVIVDGNGDKKNIEDRVLQIKSQIAETTSDYDKEKLQERLAKLSGGVAVLKVGGATEVEVKERKDRVEDALAATRAAVEEGVVAGGGVTLLHASQPLTKLKVENKDQQAGIEIVIEALKDPLKQIVENAGENGGVVVGKLLEHKDKNYGFNAQDMQYVDMIKAGIIDPAKVVRTALQDAASVASLIITTETLIVDEPSDKAEPMPMRGGMGGMGGMDF

SEQ ID NO: 5704 - protein, 471 aa, Streptococcus dysgalactiae
LGPKGRNVVLEKAFGSPLITNDGVTIAKEIELEDHFENMGAKLVSEVASKTNDIAGDGTTTATVLTQAIVREGLKNVTAGANPIGIRRGIETATATAVEALKAIAQPVSGKEAIAQVAAVSSRSEKVGEYISEAMERVGNDGVITIEESRGMETELEVVEGMQFDRGYLSQYMVTDNEKMVADLENPFILITDKKVSNIQDILPLLEEVLKTNRPLLIIADDVDGEALPTLVLNKIRGTFNVVAVKAPGFGDRRKAMLEDIAILTGGTVITEDLGLELKDATMPALGQAAKVTVDKDSTVIVEGAGSSEAIANRVGLIKSQLETTTSDFDREKLQERLAKLAGGVAVIKVGAATETALKEMKLRIEDALNATRAAVEEGIVAGGGTALITVIEKVAALELDGDDATGRNIVLRALEEPVRQIAFNAGYEGSVVIDKLKNSPVGTGFNAATGEWVDMIAAGIIDPVKVTRSA

SEQ ID NO: 5705 - protein, 415 aa, Tradescantia virginiana
TTPISIEDVRREVKILKALSGHKHLVKFYDACEESLNVYLIMELCEGGELLDRILSRGGKYTEEDAKAIVMQILNVVAYCHLQGVVHRDLKPENFLFINRDENAPMKLIDFGLSDFTRPDERLNDIVGSAYYVAPEVLHRSYSMEADIWSIGVITYILLCGSRPFWARTESGIFRSVLRADPNFDDSPWPTASPEAKDFVKRLLNKDYRKRMTAAQALSHPWLRDKEPQIPLDILIYKQTKLYLRATPLKRAALKALSKALTEDELVYLRLQFKLLEPNNDGRVSLENFHTALAQNATEAMKESRVLDILNSLESLAYRRMDFEEFCAAAISCYQLEALEHWEQIASTAFEYFEQDGNRVVSVEELAQDLNLPQNAYAILKDWIRQSDKKLSFLGYTRYTRYLHGVTPRPNTRQH

SEQ ID NO: 5706 - protein, 230 aa, Zea mays
  misc_feature (226)..(226): Xaa can be any naturally occurring amino acid
RKMARKPLDYEELNENVKRVQYAVRGELYLRASELQKEGKKIIFTNVGNPHALGQKPLTFPRQVVALCQAPFLLDDPHVGLMFPADAIARAKHYLAMAPGGLGAYSDSRGIPGIRKEVADFIHKRDGYPSDPELIYLTDGASKGVMQILNTIIRNEMDGILVPVPQYPLYSAIISLYGGSLVPYYLEEEANWNLDFSNIRQAVAEARSKGISVRATVIINPGNPTXQFLS

SEQ ID NO: 5707 - protein, 449 aa, Arabidopsis thaliana
MASWIFKLLLLLQCVLVLIQHADSSSIIRYLPGFEGPLPFELETGYIGVGQKEEDQLFYYFIKSENNPEEDPLLVWLTGGPGCSSFSGLVYENGPLAFKVETYNGSVPTLVSTTYSWTKVANIIYLDQPVGTGFSYSRNPFADIPSDTGSVKRVNEFVRKWLAKHPEYFSNPFYVTGNSYSGKVIPAIVQEISNGNYICCKPQINLQGYVIGNPVAYYDHDKDFRIPFAHGVALISDELFESLKASCGGSYSVVDPLNTECLKLIEDYDKCVSGIYEELILKSKCEHTSPDCYTYRYLLSEYWADNETVRRALKVVKGSKGTWERCDYRVLSNQDIKSSIPFHINNSIRGYRSLVISGDHDMTIPFLGTQAWIRSLNYSITEKWRPWMILDQVAGYTKTYANKMTLATVKVCSFIHIYMSNKNAKLVYTSLLIGLWVWFIIGRWAHIGI

SEQ ID NO: 5708 - protein, 465 aa, Deschampsia antarctica
  misc_feature (272)..(272): Xaa can be any naturally occurring amino acid
MAAAFSSTVGAPASTPTSFLGNKLKKQVTSAVNYHGKSFKANRFTVMAKDIDEGKQTDGDKWKGLAYDISDDQQDITRGKGIVDSLFQAPMGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNAGEPAKLIRQRYREAADMIKKGKMCCLFINDLDAGAGRMGGTTQYTVNNQMVNATLMNIADAPTNVQLPGMYNKEENPRVPIXVTGNDFSTLYAPLIPDGRMEKFYWAPTREDRIGVCKGIFQTDNVSDESVVKIVDTFPGQSIDFFGALRARVYDDEVRKWVSSTGIENIGKRLVNSRDGPVTFEQPKMTVEKLLEYGHMLVQEQDNVKRVQLADTYMSQAALGDANKDAMKTGSFYGKGAQQGTLPVPEGCTDRDAKNFDPTARSDDGSCLYTF

SEQ ID NO: 5709 - protein, 124 aa, Glycine max
MAAISLRKGNTRLPPEVNRVLYVRNLPFNITSEEMYDIFGKYGAIRQIRIGTNKDTRGTAFIVYEDIYDAKTAVDHLSGFNVANRYLIVLYYQQAKMSKKFDQKKKEDEIARMQEKYGVSTKDK

SEQ ID NO: 5710 - protein, 175 aa, Capsicum annuum
MGRGKVELKRIDNKINRQVTFAKRRNGLLKKAYELSVLCDAEIALIIFSSRGKLYEFCSSSSMSKTLERYHKHNYGALEGTQPSADSQNNYQEYLKLKTRVEVLQQSQRHMLGEDLGELNTKDLEQLERQLDSSLRQIRSTKTQHMFDQLAELHQKEQSLTEMNKSLKTKVSISP

SEQ ID NO: 5711 - protein, 476 aa, Larrea tridentata
MAAAYSTVGAVNRAPLSLNGSGARASLVPSTAFFGSSLKKSAAKFPKASSGNFKIVAQEISEDQQTDKDKWKGLAYDISDDQQDITRGKGMVDTLFQAPMQSGTHYAVMSSYDYISQGLRQYNLDNNMDGFYIAPAFMDKLVVHITKNFLSLPNIKIPLILGIWGGKGQGKSFQCELVFAKMGINPIMMSAGELESGNAGEPAKLIRQRYREAADIIKKGKMCCLFINDLDAGAGRMGGTTQYTVNNQMVNATLMNIADNPTNVQLPGMYNKEENPRVPIIVTGNDFSTLYAPLIRDGRMEKFYWAPTREDRIGVCKGIFRTDNVADDDIVKLVDTFPGQSIDFFGALRARVYHDEVRKWVSEVGVDTIGKKLVNSKEGPPSFEQPKMTIDKLLGYGGMLVQEQENVKRVQLADKYMSEAALGDANNDAIKRGTFYGGQAAQQVGNVPVPEGCTDPQATNYDPTARSDDGSCVYKF

SEQ ID NO: 5712 - protein, 468 aa, Oryza sativa
MPTAASERDGGGRAALGKAAAGLAAAAVVSLTGLAAEPLSPPPPARAESLTVAFPVSKAREVNRVQRTLVEAWGLIRETFVDPTFNHQDWDMRLQQTMVEMFPLKSEDAAYGKISGMLSTLGDPFTKIISPKEYQSFRIGSDGSVQGVGVFINKEPSSGRLLVMDCIEGGPADRAGLHGGDELVEIDGKSVSGLDGEAAAQRLRGRVGTTVKVKVLDGTENERNGRIRQKEVQLSREVINLSPLSTAIISHRSDDGRECKTGYVRLAAFSQTAAAEMESAIKKMEDEGVQSYILDLRNNPGGLVKAGLDVAQMWLDGNETLVNTVDREGNVLPINMARGHSLTHDPLVVLVNEGSASASEILAGALHDNGRAILVGHRTFGKGKIQSVTELDDGSALFITVAKYLSPALHEIDQVGIQPDIQCTPEMLSLPRAPSLKEDDKATNLEMDSCIMVAEQALEIEKSKGSAS

SEQ ID NO: 5713 - protein, 613 aa, Brassica oleracea
MEPCDCFETNANQDDLLVKYQYISDALIALAYFSIPLELIYFVNKSAFFPYKWVLMQFGAFIILCGATHFINLWMFFNHSKVVAIVMTLAKVSCAAVSCATALMLVHIIPDLLSVKNRELFLKKKADELDREMGLILTQEETGRHVRMLTHEIRSTLDRHTILRTTLVELGKTLCLEECALWMPSQSGLYLQLSHTLSHKIQVGSSVPINLPIINQLFNSAQAMHIPHTCPLAKIGPPVGRYAPPEVVSVRVPLLHLSNFQGSDWSDLSGKGYAIMVLILPTDGARKWRDHELELVEVVADQVAVALSHAAILEESMHARDQLMEQNFALDKARQEAEMAVHARNDFLAVMNHEMRTPMHAIISLSSLLLETELSPEQRVMIETILKSSNLVATLISDVLDLSRLEDGSLLLENEPFSLQAIFEEVISLIKPIASVKKLSTNLILSADLPAYAIGDEKRLMQTILNIMGNAVKFTKEGHVSIIASIMKPESLRELPSPDFYPVPSDNHFYLCVQVKDTGCGIHTQDIPFLFTKFVQPRTGAQRNHSGAGLGLALCKRFVGLMGGCIWIESEGIEKGCTASFIIRLGICNGPGSSSGSMALRLAAKSQTRPWNW

SEQ ID NO: 5714 - protein, 435 aa, Larrea tridentata
MAAAYSTVGAVNRAPLSLNGSGARASLVPSTAFFGSSLKKSAAKFPKASSGNFKIVAQEISEDQQTDKDKWKGLAYDISDDQQDITRGKGMVDTLFQAPMQSGTHYAVMSSYDYISQGLRQYNLDNNMDGFYIAPAFMDKLVVHITKNFLSLPNIKIPLILGIWGGKGQGKSFQCELVFAKMGINPIMMSAGELESGNAGEPAKLIRQRYREAADIIKKGKMCCLFINDLDAGAGRMGGTTQYTVNNQMVNATLMNIADNPTNVQLPGMYNKEENPRVPIIVTGNDFSTLYAPLIRDGRMEKFYWAPTREDRIGVCKGIFRTDNVPEEDIVKVVDQFPGQSIDFFGALRARVYDDEVRKWVSEVGVDTIGKKLVNSKEGPPTFEQPKMTIDKLLQYGNMLVEEQENVKRVQLADKYMSEAALGDANQDAIKRGTF

SEQ ID NO: 5715 - protein, 491 aa, Staphylococcus epidermidis
MNDHQKNHATSQDDNTKSTPSKNSKHIKIKLWHFILVILGIILLTSIITVVSTILISHQKSGLNKEQRANLKKIEYVYQTLNKDYYKKQSSDKLTQSAIDGMVKELKDPYSEYMTAEETKQFNEGVSGDFVGIGAEMQKKNEQISVTSPMKDSPAEKAGIQPKDIVTQVNHHSVVGKPLDQVVKMVRGKKGTYVTLTIKRGSQEKDIKIKRDTIHVKSVEYEKKGNVGVLTINKFQSNTSGELKSAIIKAHKQGIRHIILDLRNNPGGLLDEAVKMANIFIDKGNTVVQLEKGKDKEELKTSNQALKQAKDMKVSILVNEGSASASEVFTGAMKDYHKAKVYGSKTFGKGIVQTIREFSDGSLIKYTEMKWLTPDGHYIHGKGIRPDVSISTPKYQSLNVIPDNKTYHQGEKDKNVKTMKIGLKALGYPIDNETNIFDEQLESAIKTFQQDNNLKVNGNFDKKTNDKFTEKLVEKANKKDTVLNDLLNKLK

SEQ ID NO: 5716 - protein, 486 aa, Unknown
  Shewanella sp. MR-7
MSQQYLTSQSGSPIADDQNSLSAGERGPLLLQDWHLIEKLAHFNRERIPERVVHAKGTGVYGTFTLTKDLSEYTIADHFNGVGKQTETFVRFSTVGGEMGSADAERDPRGFGLRFYTARGNHDIVGNNTPTFFLRDGIKFPDFIHTQKRNPLTNLKDPQAMWDFWSLNPEAMHQVTILMSDRGIPANYRQMHGYGSHTFSFWNAKGERFWVKFHFKSQQGVVNLTNEQADKLKGIDPDSSQRDMVVAVTDGNFPRWTVNVQIMPEADANTYHINPFDLTKVWPHGDYPLIEIGVLELNRLPQNYFAEVEQVALAPSNLVPGVGASPDKMLQARLFAYADAQRYRIGANYNQLPVNCPHATKANHHQRAGAMAGTQCPYHGSQTGGDAAANYGPNSTVGALVEPANFAEPPLRLDGEAARYSRYNQDDYTQAGNLYRIFSEAEKARLVETISGSLRQASVEVQQRMLAHFHKADADYGQRIQTALGL

SEQ ID NO: 5717 - protein, 833 aa, Triticum aestivum
MLCLTASSSPSPSPSLPPRPSRPAADRPGPGISGGGNVRLSAVPAPSSLRWSWPRKAKSKFSVPVSAPREYTMATAEDGFGDLPIYDLDPKFAGFKDHFSYRMKKYLEQKHSIEKYEGGLEEFSKGYLKFGINTENDATVYREWAPAAKDAQLIGDFNNWNGSGHRMTKDNFGVWSIRISHVNGKPAIPHNSKVKFRFHRGDGLWVDRVPAWIRYATFDASKFGAPYDGVHWDPPTGERYVFKHPRPRKPDAPRIYEAHVGMSGEKPEVSTYREFADNVLPRIKANNYNTVQLMAIMEHSYYASFGYHVTNFFAVSSRSGTPEDLKYLVDKAHSLGLRVLMDVVHSHASSNMTDGLNGYDVGQNTQESYFHTGERGYHKLWDSRLFNYANWEVLRYLLSNLRYWMDEFMFDGFRFDGVTSMLYNHHGINMSFAGNYKEYFGLDTDVDAVVYIMLANHLMHKILPEATVVAEDVSGMPVLCRSVDEGGVGFDYRLAMAIPDRWIDYLKNKDDLEWSMSAIAHTLTNRRYTEKCIAYAESHDQSIVGDKTMAFLLMDKEMYTGMSDLQPASPTIDRGIALQKMIHFITMALGGDGYLNFMGNEFGHPEWIDFPREGNNWSYDKCRRQWSLSDIDHLRYKYMNAFDQAMNALDDKFSFLSSSKQIVSDMNEEKKIIVFERGDLVFVFNFHPSKTYDGYKVGCDLPGKYKVALDSDALMFGGHGRVAHDNDHFTSPEGVPGVPETNFNNRPNSFKVLSPPRTCVAYYRVEEKAEKPKDEGAASWGKAAPGYIDVEATRVKDAADGEATSGSKKASTGGDSSKKGINFVFGSPDKDNK

SEQ ID NO: 5718 - protein, 156 aa, Arabidopsis thaliana
MSLVPSFFGGRRTNVFDPFSLDVWDPFEGFLTPGLTNAPAKDVAAFTNAKVDWRETPEAHVFKADVPGLKKEEVKVEVEDGNILQISGERSSENEEKSDTWHRVERSSGKFMRRFRLPENAKVEEVKASMENGVLSVTVPKVQESKPEVKSVDISG

SEQ ID NO: 5719 - protein, 621 aa, Solibacter usitatus
MLGRQSIGAEPLPGGGVSFRVWAPKRTRVEVVLDSGDSMNMERRAGGYFACVAPHAGHGTRYRYRLDEGDAFPDPASRFQPEGPHGPSQVVDATRFHWTDAAWGGAGIHRQVVYEMHTGTFTREGTWDAARRELQELAETGITIIELMPVSEFPGRFGWGYDGVSWFAPFHHYGEPDDLRRFVDHAHRLGLGVVLDVVYNHLGPDGNYLKQFSDAYFTDRYENEWGEALNFDGPDSAPVRDFVCANAAYWADEFHLDGLRLDATQQIFDASPENIMAALATAFRAAAGARKTFIVGENEPQHTRLARPLEQGGYGLDGLWNDDFHHAARVAATGHNEAYYSDYRGSPQELISALKYGYLFQGQRYEWQGKTRGTPAWGMHPAQFVIYIQNHDQLANSAAGARLHEIASPGRYRALTALLLLAPATPMLFQGQEFGASNPFLFFADFDSELRKLVAAGRRKFLSQFRSVADPEITSRLPDPADPSTFERCKLDFRERQTHEPLYRLHKDLLRMRKQDPVFSDPRPGGLDGAVLSEGAFVLRFFEGPAGSGGHDRLLLVNLGRDLILNNGSEPLLAPPQDMCWRLHWSSEDPRYGGSGTVPFDESAPWRVPGEAAVAMIPCRK

SEQ ID NO: 5720 - protein, 465 aa, Arabidopsis thaliana
MRNLSFIVLFLLTLFFIHHLVDASLLVKSLPGFEGPLPFELETGYVSIGESGDVELFYYFVKSERNPENDPLMIWLTGGPGCSSICGLLFANGPLAFKGDEYNGTVPPLELTSFSWTKVANILYLEAPAGSGYSYAKTRRAFESSDTKQMHQIDQFLRSWFVKHPEFISNPFYVGGDSYSGKIVPGAVQQISLGNEKGLTPLINIQGYVLGNPVTDKNIETNYRVPFAHGMGLISDELFESLERSCGGKFFNVDPSNARCSNNLQAYDHCMSEIYSEHILLRNCKVDYVLADTPNIRTDRRRVMKEFSVNDSSSLPPPSCFTYRYFLSAFWANDENVRRALGVKKEVGKWNRCNSQNIPYTFEIFNAVPYHVNNSLKGFRSLIYSGDHDSMVPFSSTQAWIRALNYSIVDDWRPWMMSSNQVAGYTRTYANKMTFATIKGGGHTAEYTPDQCSLMFRRWIDGEPL

SEQ ID NO: 5721 - protein, 477 aa, Unknown
  Synechococcus sp. CC9605
MPTSRVLFWHRRDLRLADNLGLVVAAQISPAVTGVYVLDPAVINPPPELPPMAPARLWFLIESLVELQQRWREAGSRLLVVEGDPVAVLPQVAQQISAEAVVWNRDVEPYARKRDRQVAKTLQADGRRVVADWDQLLIAPELLKTGAGDPYRVYGPFLRNWRGQVLAQKPATVAAPTGLVDLPPELMPAGDPLPALRESHGFQGSEICPCRPGEAAALEQLTTFCNGPLLGYEPDRNFPGTAGTSYLSAALSVGTLSPRQAWCAAQDSREQARSEEQLQAIAVWEQELGWREFYQQALFYFPELADGPYREQWRRFPWENNEDWFDFWKEGQTGMPIIDAAMRQLNQTGWMHNRCRMIVASYLVKDLICDWRWGERAFMELEVDGDLAANNGGWQWSASSGMDTKPLRIFNPATQASKFDSAGDYIRRWVPELRHVNTKDLLSGEIGALERRDYPEPLVDHKNQQARFKALYATIRS

SEQ ID NO: 5722 - protein, 252 aa, Triticum aestivum
MGRGRVELKRIENKINRQVTFAKRRNGLLKKAYELSVLCDAEVALIIFSNRGKLYEFCSGQSMPKTLERYQKCSYGGPDTAIQNKENELVQSSRNEYLKLKARVENLQRTQRNLLGEDLGSLGIKDLEQLEKQLDSSLRHIRSTRTQHMLDQLTDLQRKEQMLCEANKCLRRKLEESSQQMQGQMWEQHAANLLGYDQLRQSPHQQQAPHHGGNGFFHPLDPTTEPTLQIGYTQEQINNACVAASFMPTWLP

SEQ ID NO: 5723 - protein, 707 aa, Zea mays
MSASQSSMSGAGEPGARAVVWFRRDLRVEDNPALAAAARAAGEVVPAYVWAPEEDGAYYPGRVSRWWLSQSLKHLDASLRRLGAARLVTRRSNDAVAALLDLVRCTGATHLLFDHLYDPLSLVRDYRVKEQLAAEGIDVQSFNADLLYEPWEVLDEDRRPFTMFAPFWNRCLCMPDPAAPLLPPKRINSGDLSRCPWDELVFEDESERGSNALLARAWSPGWQNADKALTAFLNGPLVDYSVNHKKADSASTSLLSPYLHFGELSVRKVFHLVRMKQLMWSNDGDRAGEESCTLFLRAIGLREYSRYLTFNHPCSLEKPLLSHLRFFPWVVDEVHFKVWRQGRTGYPLVDAGMRELWATGWVHDRIRVVVSSFFVKVLQLPWRWGMKYFWDTLLDADLESDALGWQYISGSLPDGRELDRIDNPQFEGYKFDPHGEYVRRWLPELARLPTEWIHHPWDAPESVLQAAGVELGSNYPRPIVELDAANSRLQGALSEMWELEAASRAAIENGMEEGLGDSTDEPPIDFPQELRMEVDRQPAQPAIIHTPVVAGWRREDQRVPSMTSSLIRAETELTADFGNTSEDSRPEVPSNIHLQARPEREETVDGGTGNAVRVHGNHHQQNLQNNMHRVLGIAPSISEASSSWTGRDGGVVPVWSPPAASGHSDPYAADEADISSRGYLDRHPQSHTMMNWSQLSQSLTTGWEVDN

SEQ ID NO: 5724 - protein, 427 aa, Cryptococcus neoformans
MPIAEATDILFSPITLGAMKLQHRVALAPMTRNRAVPSNLNPGTYVPCPLMAEYYTQRTTEGGLVISEALPISLQAADARAVPGIFTEEQIEAWKPIVDAVHQAGGIFVAQLWHQGRTRMVENEYAIISSSAVPIVKSFTGLPGLKPRPMTLEDIERVKKEYAQAAVNCIKAGFDGVEIHGANGYLPEQFLHSNINRRDDKYGGSPENRNRFVLEICQAVTRVIGPDRFGLRLSPYGFFNEARGDNRVEQWTMLCRDIKGLGWAYVHFMEPRYDEIRSGADKLAELGENNEDVTLDPFVNALENCIPVIVAGGYDADNVRKSRVLEDKKADVVAFGRYFTSNPDLVYRLKHDKPFVQYIRPRFYGPFPDPEVGYTDFPFCHELSGTPERKALLSSGTAKVLKVAEPGWQLSKSGIQLGGLFAAVTQD

SEQ ID NO: 5725 - protein, 220 aa, Oryza sativa
MTAALQALLDPTALSLGLPTPAINKEEYLAICLAALACTRAGKALVGVGGQQQVQACNKWLCPAPAAPEELRFRCTVCGKAFASYQALGGHKSSHRKPPSPGDHYGAAAAAQQLASAGDSKEDSASSAAGSTGPHRCTICRRSFATGQALGGHKRCHYWDGTSVSVSVSASASAASSAVRNFDLNLMPLPESTAAAGIKRWAEEEEVQSPLPVKKLRMSN

SEQ ID NO: 5726 - protein, 486 aa, Candida glabrata
MDDGEVFVEDSVRQQVFTKLGSRLENRVCFDCGNKNPTWTSVPFGVLLCIQCSAVHRNLGVHITFVKSSTLDKWTVNNLRRFKYGGNHKAKEYFMKNNGKQYLNSSNVNAQAKYTSLVAKKYKAHLDSKVEKDMQQYPGELVLTEMDNQGDETSSDSNSVASTPKEGSVDDFFSNWEKPKVDNGSVTPTLSPRPTGGLNANSSNNNSSTSLGRKTGSSILNSRRKTSTPQATQGAKKHSILSSSRKPTRLGAKKVDKSKAEDLFDQFEKEAEEEKELELHNSSTTSSFPNKYQAPSFGSTEKDDEDSFAKKEDVFNGEEESFVDPAPVEDLKPKFAKLGFGMTNNEANELAQQHKEAKRAASGPKYTGSIAAKYGGQKAISSDMMFGRGTYDEAASREAREKLKTFDNATSISSSSYFGEEQSEEDLLEGGNGAYNPQRNYGGAAGSNGAFIDFNSSTDDELQMLKDMVETGAEKLGNYLRDYLRK

SEQ ID NO: 5727 - protein, 208 aa, Pyrococcus furiosus
MKVLVTGFEPFGGEKINPTERIAKDLDGIKIGDAQVFGRVLPVVFGKAKEVLEKTLEEIKPDIAIHVGLAPGRSAISIERIAVNAIDARIPDNEGKKIEDEPIVPGAPTAYFSTLPIKKIMKKLHERGIPAYISNSAGLYLCNYVMYLSLHHSATKGYPKMSGFIHVPYIPEQIIDKIGKGQVPPSMCYEMELEAVKVAIEVALEELL

SEQ ID NO: 5728 - protein, 138 aa, Glycine max
  misc_feature (110)..(110): Xaa can be any naturally occurring amino acid
  misc_feature (112)..(113): Xaa can be any naturally occurring amino acid
  misc_feature (117)..(117): Xaa can be any naturally occurring amino acid
MVSFEMNDQKKIGLGLTGFGIFFSFLGIIFFFDKGLLVMGNILFVSGVSITIGLKSTMQFFVKRSNFKGTISFGVGFFILIMGWPILGMIVEAYGFIVLFSGFWPTLAVXLXXIPVXGWLFQQPFIRSLFDRYGRMPV

SEQ ID NO: 5729 - protein, 228 aa, Pyrococcus furiosus
MVPIIIKPDILMLKGEYLDSNIYFLKSGKELLIVDSGTGVFWNRYLSIAQQEGWFKNISRVVIFNTHEHFDHVGGNHIFMKFFKEKGIEVEFASHKDTARTLEEGDDSIILSYHYGRKYEPHPVDIKLKDGDLLSIGDVNLTVIHTPGHTQGSACLYYEDERIMFSGDTVFLNAYGRTDLPTGDEEELIRSLERLARYEVRLGLPGHGKLIDDWKSNIYRILDHLEGL

SEQ ID NO: 5730 - protein, 487 aa, Unknown
  Malus x domestica
MGFTLSNQQQLLSKIATGNGHGENSPYFDGWKAYDSDPFHPTKNPNGVIQMGLAENQMCFDLIQEWILNNPEASICTAAGVNEFKDIAIFQDYHGLPEFRNAVANFMGKVRGNRVTFDADRIVMSGGATGAHEMIAFCLADPGDAFLVPVPYYPGFDRDLGWRTGVQLIPVACDSSNNFKVTRAALEAAYEKAQKANIRVKGLLITNPSNPLGTVLDRDTLISLVTFINEKKIHLVCDEIYAATVFSQPSFISIAEIIEENIGCNRNLIHIVYSLSKDMGFPGFRVGIVYSYNDAVVNCARKMSSFGLVSTQTQHLIASMLSDNEFVKRFIAQSAKRLKTRHMRFTMGLAQVSTNCLKSNGGLFVWMDLRRLLKEQTFEAEMVLWRTIIHEVKLNVSPGSSFHCPEPGWFRVCFANMDDKTMEVALTRIRTFVLQNKEAIVPRKSNRLWHSNLRLSFQSRRMDDTMMSPCMMSPHTPIPQSPLVRAT

SEQ ID NO: 5731 - protein, 250 aa, Oryza sativa
MAVEAVLEASRSSSEEEAEVIVTHGGGGGGGGGGGQVEGWGKRKRSRRRRPQLPPSEEEYLALCLLMLARGRRDGDDVAASASAAAAAVEHRCSVCGKAFASYQALGGHKASHRKPPPPPPPAMVDDDEVVVETKPAAIATPSSSASGVSGGGGGRAHECNVCGKAFPTGQALGGHKRCHYDGTIGSAAGAGASKPAAKTTVAVAASRGFDLNLPALPDVAAAADQRCAAEDDEVLSPLAFKKPRLMIPA

SEQ ID NO: 5732 - protein, 275 aa, Lycopersicon esculentum
FQDYHGLPEFRKAIAKFMEKTRGGRVRFDPERVVMAGGATGANETIIFCLADPGDAFLVPSPYYPVFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEITYCNKDLVHIVYSLSKDMGLPGFRVGIIYSFNDDVVNCARKMSSFGLVSTQTQYFLAAMLSDEKFVDNFLRESAMRLGKRHKGLEVVGIKCLKNNAGLFCW

SEQ ID NO: 5733 - protein, 365 aa, Salmonella typhimurium
MSSAKLFTPLKVGAITATNRVFMAPLTRLRSIEPGDIPTPLMAEYYRQRASAGLIISEATQISAQAKGYAGAPGLHSDEQIAAWKKITQGVHAQGGHMAVQLWHTGRISHASLQPGGQAPVAPSAINAGTRTSLRDENGQAIRVETSTPRALDTHEIPGIVNDFRQAIANAREAGFDLVELHSAHGYLLHQFLSPSSNHRTDRYGGGVENRARLVLEVVDAGIKEWGADRIGIRLSPVGTFQNVDNGPNEEADALYLIEALGKRGIAYLHMSEPDWAGGEPYSDAFREKVRARFHGPIIGAGAYTPEKAEDLIEKGLIDAVAFGRDYIANPDLVARLQRKAELNPQRPESFYGGGAEGYTDYPTL

SEQ ID NO: 5734 - protein, 680 aa, Shigella flexneri
MFFRLTALAGLLAIAGQTFAVEDITRADQIPVLKEETQHATVSERVTSRFTRSHYRQFDLDQAFSAKIFDRYLNLLDYSHNVLLASDVEQFAKKKTELGDELRSGKLDVFYDLYNLAQKRRFERYQYALSVLEKPMDFTGNDTYNLDRSKAPWPKNEAELNAQWDSKVKFDELSLKLTGKTDKEIRETLTRRYKFAIRRLAQTNSEDVFSLAMTAFAREIDPHTNYLSPRNTEQFNTEMSLSLEGIGAVLQMDDDYTVINSMVAGGPAAKSKAISVGDKIVGVGQTGKPMVDVIGWRLDDVVALIKGPKGSKVRLEILPAGKGTKTRTVTLTRERIRLEDRAVKMSVKTVGKEKVGVLDIPGFYVGLTDDVKVQLQKLEKQNVSSVIIDLRSNGGGALTEAVSLSGLFIPAGPIVQVRDNNGKVREDSDTDGQVFYKGPLVVLVDRFSASASEIFAAAMQDYGRALVVGEPTFGKGTVQQYRSLNRIYDQMLRPEWPALGSVQYTIQKFYRVNGGSTQRKGVTPDIIMPTGNEETETGEKFEDNALPWDSIDAATYVKSGDLTAFEPELLKEHNARIAKDPEFQNIMKDIARFNAMKDKRNIVSLNYAVREKENNEDDATRLARLNERFKREGKPELKKLDDLSKDYQEPDPYLDETVNIALDLAKLEKARPAEQPAPVK

SEQ ID NO: 5735 - protein, 754 aa, Lycopersicon esculentum
MGSLLRMNRLLSSIVESCNCIIDPQLPADDLLMKYQYISDFFIALAYFSIPVELIYFVKKSAVFPYRWVLVQFGAFIVLCGATHLINLWTFNMHTRNVAIVMTTAKALTALVSCITALMLVHIIPDLLSVKTRELFLKKKAAQLDREMGIIRTQEETGRHVRMLTHEIRSTLDRHTILKTTLVELGRTLALEECALWMPTRTGLELQLSYTLRHQNPVGLTVPIQLPVINQVFGTNHVVKISPNSPVARLRPAGKYMPGEVVAVRVPLLHLSNFQINDWPELSTKRYALMVLMLPSDSARQWHVHELELVEVVADQVAVALSHAAILEESMRARDLLMEQNVALDLARREAEMAVRARNDFLAVMNHEMRTPMHAIIALSSLLQETDLTPEQRLMVETILKSSNLLATLINDVLDLSRLEDGSLQLDIGTFNLHALFREVHSLIKPIASVKKLFVTLSLSSDLPEYVIGDEKRLMQILLNVVGNAVKFSKEGNVSISAFVAKSDSLRDPRAPEFFAVPSENHFYLRVQIKDTGIGITPQDIPNLFSKFTQSQALATTNSGGTGLGLAICKRFVNLMEGHIWIESEGLGKGSTAIFIIKLGIPGRANESKLPFVTKLPANHTQMSFQGLKVLVMDENGVSRMVTKGLLTHLGCDVTTVGSRDECLRVVTHEHKVVIMDVSMQGIDCYEVAVVIHERFGKRHGRPLIVALTGNTDRVTKENCMRVGMDGVILKPVSVYKMRSVLSELLEHGVVLES

SEQ ID NO: 5736 - protein, 492 aa, Oryza sativa
MVLSKAVSESDMSVHSTFASRYVRASLPRYRMPENSIPKEAAYQIINDELMLDGNPRLNLASFVTTWMEPECDKLIMAAINKNYVDMDEYPVTTELQNRCVNMIAHLFHAPLGEDETAVGVGTVGSSEAIMLAGLAFKRRWQNKRKAEGKPFDKPNIITGANVQVCWEKFARYFEVELKEVKLRDGYYVMDPEKAVDMVNENTICVAAILGSTLNGEFEDVKLLNDLLDKKNKETGWETPIHVDAASGGFIAPFLYPELEWDFRLPWVKSINVSGHKYGLVYAGIGWCIWRNKEDLPEELIFHINYLGTDQPTFTLNFSKGSSQVIAQYYQLIRHGFEGYRNIMENCHENAMVLKEGLVKTGRFDIVSKDEGVPLVAFSLKDRSRHDEFEISDMLRRFGWIVPAYTMPPDAQHVTVLRVVIREEFSRTLAERLVLDIEKVMYQLDALPSRLMPPVPPAPLLVVAKKSELETQRSVTEAWKKFVLAKRTNGVC

SEQ ID NO: 5737 - protein, 651 aa, Oryza sativa
MAGSERTVVWFRRDLRIDDNPALAAAARDGVVLPVFIWCPADEGQFYPGRCSRWWLKQSLPHLSQSLESLGCPLVLIRAESTLEALLRCIDSVGATRLVYNHLYDPVSLVRDDKIKKELSALGISIQSFNGDLLYEPWEIYDDSGLAFTTFNMYWEKCMELPIDISPSLAPWKLVPAPGLESVRSCSVDDLGLESSKDEESSNALLRRAWSPGWRNAEKMLEEFVSHGLLEYSKHGMKVEGATTSLLSPYLHFGEVSVRKVYQLVRMQQIKWENEGTSEAEESIHFFMRSIGLREYSRYLCFNFPFTREKSLLGNLKHYPWKVDEERFKSWRQGMTGYPLVDAGMRELWATGWTHNRIRVIISSFAVKFLLIPWTWGMKYFWDVLLDADLESDILGWQYISGSLPDGHELSRLDNPEVQGQKYDPDGVYVRTWIPELARMPTEWIHHPWDAPSCILEVAGVELGFNYPKPIVDLHIARECLDDSISTMWQLDTAEKLAELDGEVVEDNLSNIKTFDIPKVVLRETSPCALPIDQRVPHASSKDHNLKSKVLKASNRSSICVDMIRSSKMEATSSVANSPVSRKRSFCETAFHVPSYSSSAEVHSHIQDHGGSLVGPSRYLLQEAGRNCVDEVEDSSTADSGSSISRQRKAA

SEQ ID NO: 5738 - protein, 736 aa, Lycopersicon esculentum
MDCNCFDPLLPADELLMKYQYISDFFIAVAYFSIPIELVYFVQKSAVFPYRWVLVQFGAFIVLCGATHLINLWTSTPHTRTVAMVMTTAKFSTAAVSCATAVMLVHIIPDLLSVKTRELFLKNKAAELDREMGLIRTQEETGRYVRMLTHEIRSTLDRHTILKTTLVELGRALQLEECALWMPTRTGVELQLSYTLHHQNPVGFTVPIQLPVINQVFSANCAVKISPNSAVARLRPTRKYIPGEVVAVRVPLLHLSNFQTNDWPELSPKSYALMVLMLPSNSARQWHVHELELVDVVADQVAVALSHAAILEESMRARDLLIEQNVALDLARREAETAVRARNDFLGVMNHEMRTPMHAVVALSSLLQESELIPEQRLMVETILKSSNLLATLINDVLDLSRLEDGSLQLDVGTFNLHALFREVLNLIKPVAAVKKLFVTLSLSSDFPEVAIGDEKRLMQILLNVVGNAVKFSKEGSVSVSAVNAKSESLIDPRAPEFFPVQSENHFYLRVQVKDTGSGINPQDFPKLFCKFAQNQEPATKNSAGTGLGLAICKRFVNLMEGHIWIESEGVGKGSTAIFIVKLGIPGRLNESKLPFTAGLPANHMQMTFQGLKVLVMDDNGFSRMVTKSLLVHLGCDVTTIGSGDECLRILTREHKVLIMDASITGMNCYDVAVSVHEKFGKRLERPLIVALTGNTDQVTKENCLRVGMDGVILKPVSIDKMRSVLSGLLEHGTVL

SEQ ID NO: 5739 - protein, 217 aa, Arabidopsis thaliana
  misc_feature (150)..(150): Xaa can be any naturally occurring amino acid
  misc_feature (160)..(160): Xaa can be any naturally occurring amino acid
  misc_feature (172)..(172): Xaa can be any naturally occurring amino acid
  misc_feature (182)..(183): Xaa can be any naturally occurring amino acid
  misc_feature (186)..(186): Xaa can be any naturally occurring amino acid
MAQQSLIYSFVARGTVILVEFTDFKGNFTSIAAQCLQKLPSSNNKFTYNCDGHTFNYLVEDGFTYCVVAVDSAGRQIPMSFLERVKEDFNKRYGGGKAATAQANSLNKEFGSKLKEHMQYCMDHPDEISKLAKVKAQVSEVKGVMMENIXKVLARGVICXMLGSSKSQPQAXYIKRTQMKRXXWFXNMKIKLIVLAIIIALILIIILSVCGGFNCGK

SEQ ID NO: 5740 - protein, 513 aa, Arabidopsis thaliana
MMNKDMLLHQHQQPQQDENMSNLTSASGDQASVSSGNITEASGSNYFPHHQQQQEQQQQQLVVPDSQTQKKRRNQPGNPDPESEVIALSPKTLMATNRFVCEICNKGFQRDQNLQLHRRGHNLPWKLKQRSNKEVIRKKVYVCPEASCVHHDPSRALGDLTGIKKHFCRKHGEKKWKCDKCSKKYAVQSDCKAHSKTCGTKEYRCDCGTLFSRRDSFITHRAFCEALAEETAREVVIPQNQNNNQPNPLLIHQSASHPHHHHQTQPTINVSSSSSSSHNHNIINSLHFDTNNGNTNNSNNSNNHLHTFPMKKEQQSNDHIMNYHHSIIPPWLAPQPHALTSSNPNPSNGGGGGGSLFSLASPAMSATALLQKAAQMGSTKTPPLPPTTAYERSTHNNNLTTTMAAMMTSPSGFISSNNNNHVLFQDYNASGFDNHGREEAFDDTFGGFLRTNEVTAAAGSEKSTKSGGGEGLTRDFLGLRPLMSHNEILSFAGLGSCINSSASDQLHPKPWQG

SEQ ID NO: 5741 - protein, 303 aa, Unknown
  Synechococcus sp. CC9605
MPSAASPPINGDLPRQFASREALNTLLAQEFPGAEGELSPIRGGRVPAEEKLRRIDARRYAKSRNHLRGAVTGLSPYIRHGVLTLAEVRDSVFERIRNRDEGGKLINELGWRDFWQRMWLDLGDGIHDDQEPFKTGHDAGAYAQELPADVRAGTTGLACMDGFRDQLVSTGWLHNHARMWMAAWLVHWRRVHWKAGADWFLEHLLDGDPASNHLSWQWVASTFSHKPYFFNRGNLERYSEGQYCNSCPSANSCPFEGSYDQLENQLFAPMPAIRETGNNRNQQRNRQRRSSGGASAALARPKR

SEQ ID NO: 5742 - protein, 603 aa, Yarrowia lipolytica
MMDVERVEHMPPKPMYSLMTQPVVLKEEPVAPSPPTTQAAQQQQQQAPTQTQTPAQPPQAQQPTHNQTHTQPPQQQPTSAQQPTSSNATASNSTDNKKPGTTPKVSQAAFIHKLYSMLEDSSIEHLISWSASNDSFIVSPGEEFSKVLRQYFKHTNVSSFVRQLNMYGFHKVNDTFTFHTGDSSQWEFKHGGGSFKRGDVESLRGIKRRASRQSASQRDSVPLRPVGLVSDYGVAPSGGAPPGMNGSVDVGTAAAAAAAQHGHMMLHPSQHPHHPHPADDAAAAAATAATWHLHDSVSRMAATQAALIDAVRSLQSDVISLLDVLPRITEGRAAVESAHTECQRVAHAMGHRNAFLASLDGRRESQPQPQQQQPYFYQQSAAASAASATAPGGSQWRQPEPQYPVPPTDPFHRGSRGRAVSVYFDPLAKEPAAGPDGQAPPTHTSAPPPPPQQQQQQQQQPPHSQGAAPPPPFGSSPGPTGPPGGVPRSQRPGSFPLLHRQDKTEFVGGGFAEALKYRTDAPARRHTASGAETMPLPQYTAPTSTPHPHEPSTPPPHSSPHTPYRSPHPSGGSTRSNSSSSTRGASVAALLNPEGGDKKRKIE

SEQ ID NO: 5743 - protein, 443 aa, Geobacter sulfurreducens
MFKTIKGKRVALLLASLCVVAVLGAGAVQKRCAAEGGNDYESIELFTDVLAIVKKSYVEEVDTKKLIYGAINGMLASLDPHSSFMPPDMYKEMKIDTKGSFGGLGIEITIKDGLLTVISPIEDTPAFKAGIKAGDQILKIEDRFTKDMTIMDAVKRMRGPKGTKVTLTIMREGFDKPKEFTLVRDTIQVKSVRFKSMDQGYGYIRIAQFQEKTDDDLVKALKALKEENGGDLRGLVLDLRNDPGGLLDQAVKVADHFVEDGLIVYTEGREKESRMQFTARKSGTEPNYPMVVLINSGSASASEIVAGALQDHKRAVVMGTQSFGKGSVQTIIPLSDESGLRLTTARYFTPSGRSIQAKGITPDIVVERAEIQSTEKMEGHIREKDLENHFDSDSKDGSDNKQKGTDKGASAASKVDEQLKSDYQVMRALDLLKGWEILKTISK

SEQ ID NO: 5744 - protein, 485 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEPRLTHEIRGIWISYWSQKLASRLNVRPSI

SEQ ID NO: 5745 - protein, 1124 aa, Nicotiana tabacum
MSSSRPSQSSTTSARSKHSARIIAQTTIDAKLHADFEESGDSFDYSSSVRVTSVAGDERKPKSDRVTTAYLNQIQKGKFIQPFGCLLALDEKTFKVIAFSENAPEMLTMVSHAVPSVGELPALGIGTDIRTIFTGPSAAALQKALGFGEVSLLNPVLVHCKTSGKPYYAIVHRVTGSLIIDFEPVKPYEVPMTAAGALQSYKLAAKAITRLQALPSGSMERLCDTMVQEVFELTGYDRVMTYKFHDDDHGEVVAEITKPGLDPYLGLHYPATDIPQAARFLFMKNKVRMICDCRAKHVKVVQDEKLPFDLTLCGSTLRAPHYCHLQYMENMSSIASLVMAVVVNDGDEEGESSDSTQSQKRKRLWGLVVCHNTTPRFVPFPLRYACEFLAQVFAIHVNKELELESQILEKNILRTQTLLCDMLMRVAPLGIVSQSPNIMDLVKCDGAALLYKNKIHRLGMTPSDFQLHDIVSWLSEYHTDSTGLSTDSLYDAGFPGALALGDVVCGMAAVRISDKGWLFWYRSHTAAEVRWGGAKHEPGEKDDGRKMHPRSSFKAFLEVVKTRSVPWKDYEMDAIHSLQLILRNASKDADAMDSNTNIIHTKLNDLKIDGLQELEAVTAEMVRLIETASVPIFAVDVDGQLNGWNTKIAELTGLPVDEAIGNHLLTLVEDSSVDTVSKMLELALQGKEERNVEFEIKTHGPSGDSSPISLIVNACASRDVGDSVVGVCFIAQDITGQKNIMDKFTRIEGDYRAIIQNPHPLIPPIFGTDQFGWCSEWNSAMTKLTGWRRDDVIDKMLLGEVFGTQAACCRLKNQEAFVNFGVVLNNAMTGQECAKISFGFFARNGKYVECLLCVSKRLDREGAVTGLFCFLQLASHELQQALHIQRLSEQTALKRLKVLAYIRRQIRNPLSGIIFSRKMLEGTNLGEEQKNILRTSSQCQRQLNKILDDTDLDSIIDGYLDLEMLEFKLHEVLVASISQIMMKSNGKNIMIVNDMVEDLLNETLYGDSPRLQQVLANFLLVCVNSTPSGGQLSISGTLTKDRIGESVQLALLEVRISHTGGGVPEELLSQMFGTEAEASEEGISLLISRKLVKLMNGEVQYLREAGRSTFIISVELAVATKSSC

SEQ ID NO: 5746 - protein, 449 aa, Vibrio vulnificus
MNKYQLPQDSQLRQADFLFGVATSSYQIEGGAQLGGRTPSIWDTFCNQPGAVDNMDNGDVACDHFHLWQQDIALIQGLGVDAYRLSMAWPRILPKDGQVNQQGLEFYERIIDECHARGLKVFVTLYHWDLPQYLEDKGGWLNRETAYKFAEYAKVVSGYFGNKIDSYATLNEPFCSAYLGYRWGIHAPGKKGEREGFLSAHHLMLAHGLAMPIMRKNAPQSMHGCVFNATPAYPYREQDVAAAEYSDAEGFHWFIDPVLKGEYPQSVLERQAHNMPMILDGDLDIIRGDLDFIGINFYTRCVVRFDANGDLESMPQPDAEHTYIGWEIYPQALTDLLLRLKQRYPNLPPVYITENGAAGEDACINGEVNDEQRVRYFQSHLLALDEAIRAGVNVQGYFAWSLMDNFEWAYGYKQRFGIVHVDYATQKRTLKQSAIAYRNTLLARAEEKQ

SEQ ID NO: 5747 - protein, 480 aa, Listeria monocytogenes
MKELLTFPKDFWWGSAWSAEQAEGRGDTGKAKTVWEHWFETEPNRFYEGVGSEITTDHFNRYKEDVQWMKKTGQNSFRISISWARMFPNDGVGEVNQKAIAFYRDLLTEMNENGVKPFANLYHFDMPVALQDAGGWESREVVDAYVHFADTCFKEFGDLVYHWFTFNEPLGPILGGYLEDFHYPNQIDFKRGAQAGFNTILAHALAIKAFKKLNLSSKIGVILNLSPTYPRSQNEYDLEAAEICDAFYTRSFLDPMVKGSFPEKLVEIMREYDQMPEYTEEDLTIIKENTAQILGLNYYEPRRVKARLTAINEKSPFLPDWFFEPHNMPGKRMNIYRGWEIYERGIYDLCIDIRDNYGNIESFISENGMGVANEERFLNEEGQIQDDYRIQFVKDHLAYVHQAIAEGCDIKGYHLWTFIDCWSWINAYKNRYGLVSLDVETGKRTMKKSGEFYKKMSDMNGFEYETSKLVGTKREETTNG

SEQ ID NO: 5748 - protein, 368 aa, Pseudomonas aeruginosa
MSLLFEPLSLRQITLPNRIAVSPMCQYSAQEGLANDWHLVHLGSRAVGGAGLVIVEATAVLPEGRITADDLGIWSDAHVEPLHRITRFIESQGAVAGVQLAHAGRKASTWRPWLGKHGSVPIGDGGWIPVAPSAIPFDPQHTTPEALSEAQIEALVQAFVRAAERSLAAGFKVAEVHAAHGYLLHQFLSPLSNQRRDQYGGCFENRIRLLLQVTAAVRKAWPQELPLFVRLSATDWVEDGWNPDETVELARHLKDLGVDLIDVSSGGTAANAEIPVGPGYQTEFAERVKKEAGIASGTVGMITEPVQAEHILRTGQADLILLARELLRDPYWPLHAADELRNEQMPWPPQYLRAAHRSTPPRKSLEMQ

SEQ ID NO: 5749 - protein, 250 aa, Arabidopsis thaliana
MGRGRVELKRIENKINRQVTFAKRRNGLLKKAYELSVLCDAEVALIIFSNRGKLYEFCSSSSMLRTLERYQKCNYGAPEPNVPSREALAELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 5750 - protein, 285 aa, Zea mays
MREKRVYVPDSVRGQDLTEPSYAPVRGDRLTHDIPTVDVLQFYPLTHAWSTALGPSTPALQSVYAAFYQGGLVTENLHSRKMVQPKKFRGVRQRHWGSWVSEIRHPLLKRRVWLGTFETAEEAARAYDEAAVLMSGRNAKTNFPIQRSSTGEPTPAAGRDARSNFSSGSSTTNLSQILSAKLRKCCKAPSPSLTCLRLDPEKSHIGVWQKRAGARADSNWVMTVELNKDAASTDAASQSTSATTAPPATPMDEEERIALQMIEELLSSSSPASPSNGDDQGRFII

SEQ ID NO: 5751 - protein, 467 aa, Erwinia carotovora
MRRNTMKAFPDGFLWGGSVAANQVEGAWNEDGKGVSTSDLQLKGVHGPVTERDESISCIKDRAIDFYHQYPQDIQLFAEMGFKVLRTSIAWTRIYPEGNEAEPCEAGLAFYDHLFDEMAKHHIQPLITLSHYEMPYGLVKKLGGWGNRAVIDHFEKYARTVFSRYKDKVKHWLTFNEINMALHSPFTGIGLSGEPSKQDIYQAIHHQLVASARVVKACHDIIPDAKIGNMLLGAVRYPMTCHPKDVLEAQNKNREWLFFGDVQVRGTYPAWIQRYFRENDVELTITAQDKDDLSHTVDFVSFSYYMSGCATFEPEKYQSSRGNIIRLIPNPHLEASEWGWQIDPEGLRFLLNELYDRYQKPLFIVENGLGARDVVEEDGSIHDSYRIDYLRRHLIQVREAIDDGVELLGYTSWGPIDLVSAGTAQMSKRYGFIHVDRDDEGKGTLERRRKDSFYWYQDVISSNGKSL

SEQ ID NO: 5752 - protein, 636 aa, Vibrio cholerae
MCGVAGFISKRLSPVDCLTSMVESIMHRGPNDSGLWVDDDFGVCLAHARLSIQDLSSAGHQPMHSKSERYVMIFNGEIYNHLTLREELIEIVPSYWNGHSDTETLLAGFEVWGIEQTIQKCVGMFAIVLWDKVLKQLILIRDRFGEKPLYYGWQRDTFLFASELKALKAHPSFEGSINRQALSHFFRLNYIPTPLSIYEGIFKLEPGVIAVFSHEGQLLSKQTFWDASHAVSLQNFSDHDAVDKLDDLIKQSIQDQALSDVPLGAFLSGGVDSSTVVGILQSLSTRPVKTFTIGFDHADFNEASEASDVAKHLGTDHVELIVSAEDALAIINQLPVMYDEPFADASQVPTFLVSKLAKKEVTVCLSGDGGDELFCGYNRYHYTAKVWSYLEKIPFPIRKMLSVFLLTLSPSSWDVLSKTLGLNTRLPNLGNKTQKGAQALKARDIEDLYTRVVSNWDLDEPLVKNTAVEKLPFLSDLTELSHLNDLEKMMLWDKQSYLMDDVLVKTDRATMACSLEGRVPLLDHRIAEFAASLPIHLKYRGGKGKWLLREVLYRYVPKKLIERPKKGFSLPIAEWLRGPLKDWANVLLDSDRFDKEGFLSSELVQKKWGEHLAGKRDWSSQLWSVLMFQLWLEKNK

SEQ ID NO: 5753 - protein, 388 aa, Candida glabrata
MGVSVKGAPNLDYFTPEQPILGKFIKYKEDEDGSSERDPPKLFKPLKIRALEIPNRIGVSPMCTYSTNNYMPTDFHLMHYGSLATRGPGIIIVECSAVSEGTAVTVNDMGIWNKEQASEHFSKIVKFAHSQNVIVGCQLGQFMRKVVQNVDEDNKAHNVEVGKEAHDLSTEEIKTIVEQWGTAAKLAVEVAKYDFIEIQAGKGHITNEFFSRLTNKRKDEYGGSFENRIRILLEIIDNVRKNIPEDTPLFIRLKACDNLDHPDAWSTDETIKLSFELAKHGVDVLDIAGRGLRIGPKSEKENKIIFLQQLKEAHKGKTNLLIASSGVISTADYASELLDKEAQDIILVGRPFLKNPNLVSFWADDVNITVTNAVQYSWGFYPTKSHLS

SEQ ID NO: 5754 - protein, 1103 aa, Candida glabrata
MSAISSNTVSVIKNNQIGPWKLGETLGSGSTGKVLLASNETTKQQAAVKVISKAVFEAMNNSESNGDATNALPYNIEQEIIIMKLLNHPNVLRLFDVWETNSDLYLVLEYAEKGELFNMLVERGPLPENEAVRAFRQIIIGISYCHSLGVVHRDLKPENLLLDNKLNIKIADFGMAALESEDKLLETSCGSPHYAAPEIISGLPYEGFSSDVWSCGVILFALLTGRLPFDEEDGNIRNLLLKVQKGEFEMPDDDEITKEAQDLLARLLTVDPSKRITIREILKHPLLQKYPSIKDSRSIRNLPREDTYLSPLADTNSKIDDAILQNLVILWHGKDAREIAAKLREPGANTEKTLYALLYRFKCDTQREANRARRQSKIVQRNSTIRSTAPESPSKKKTYTPQKKNKRASIIASSSKRPVSVTKTATNITVNSSITGTPKSAKRMSMNNSARKRMSALYGTRDSPTKTSRSRRSSIITKDFLGNRPRDSVISMSHNKRASKSSKRISLVPNLKRQSVTTKLMATYAKLSEDDDWEYIERETKRTSSDFATLIDEIFEYEKYEQIRKEKAELERKVRETKEREERERKERQEKELQERLERERIEKQKEDIARQMDEEISNLKKELVGDQDNEDKFRSVSEPLESKSKKIEDIEEDIDGILRNRKYSLQTRPVSRLDPGIGFIDKPRQSEQHVPETVNLEPELEETEQKILETIRRSKFLGSSFDIKKELENVKRHRQTSQPIEKEMAPPALPETLPKAVEKKNVSMDPSLRKISDIKVPQFTRKSRHFSTSNRRLSVLSMYSTKESYSNLADILKNGPGEKEMIQTAPTPKSADDSDQLFDTIDEADTPASVSREERLYEVAEESENELANKKIDIADLLNSEGSNLKSVEEQEDSMKLPKLPPLFEDGSTKETKEQSKSMIPENMQSSESQKQIEKNNSDEGGSLNPFMTKHRDVSDKGVTKEKPTVTMKTTSEQVSADKKRNMSFLRKLSKGSSSSKDNVDVTLSTSVSSKQLFSGLVNLLKGWTKYGLKGIAIDSTSQTITGKLANDNILSFRSTAFSILIFSQEKGSAVTFRKVSGSGKAVRRLSDEVKKVLSKEGVLRD

SEQ ID NO: 5755 - protein, 545 aa, Unknown
  Shewanella sp. ANA-3
MAAKEVVFGNDARVKMLAGVNILANAVKVTLGPKGRNVVLDKSFGSPLITKDGVSVAKEIELEDKFENMGAQMVKEVASKANDAAGDGTTTATVLAQAIVTEGLKAVAAGMNPMDLKRGIDKAVAAAVIELKNLSQDCADSKAIAQVGTISANSDESIGQIIATAMEKVGKEGVITVEEGQALENELDVVEGMQFDRGYLSPYFINKPETGSVELDHPFVLLVDKKISNIRELLPILEGLAKTGKPLLIVAEDVEGEALATLVVNNMRGIVKVAAVKAPGFGDRRKAMLQDVAILTGGTVIAEEIGLELEKATLEDLGTAKRVVITKDNTTIIDGNGEQAQIEARVSQIKQQIEESTSDYDKEKLQERMAKLAGGVAVIKVGAATEVEMKEKKARVEDALHATRAAVEEGVVPGGGVALVRVASKIADVEVANEDQKHGVVIALRAMEAPLRQIATNAGEEASVVANTVKNGSGNYGYNAGNDTYGDMLEMGILDPTKVTRSALQFAASIAGLMITTEAMVAELPKADAPDMGGMGGMGGMGGMM

SEQ ID NO: 5756 - protein, 159 aa, Capsicum frutescens
MSMIPSFFGGRRSNIFDPVSLDLWDPFEGFPISSTIANTPSSARETSAFPNARIDWKETPQAHIFKVDVPGIKREEVKVQVEEGRILQITGERSREQEEKNDQWHRMERSSGKFLRRFRLPENTKMGEIKAAMENGVLTVTVPKEEEKRSEVKAIDISG

SEQ ID NO: 5757 - protein, 489 aa, Unknown
  Halobacterium sp. NRC-1
MPAAQPPGMQLFWHRRDLRTTDNRGLAAAAPGVTAVDGGHDQGPVAAVFCFDDEVLAHAAPPRVAFMLDALAALRERYRDLGSDLIVRHGDPAAVLPAVANDLDATRVVWNHDYSGLATDRDAGVRDALDAAGVAHAQFHDAVHHRPGEIRTNAGDPYSVYTYFWRKWQDREKNPPAPEPEPADLAADTALADTSPLPSVQELGFAEPEAAVPDAGTAAARSLLDAFRESGDIYRYEDRRDYPHEEPTSRLSPHLKFGTIGIRTVYEAARAAKSDADTDDERENVAAFIGQLAWREFYAQVLYFNQNVVSENFKAYEHPIEWRDDPAALQAWKDGETGYPIVDAGMRQLRAEAYMHNRVRMIVAAFLTKDLLVDWRAGYDWFREKLADHDTANDNGGWQWAASTGTDAQPYFRVFNPMTQGERYDPDADYITEFVPELRDVPADAIHSWHELSLSERRRHAPEYPDPIVDHSQRREDAIAMFERARGDE

SEQ ID NO: 5758 - protein, 192 aa, Ephedra foeminea
DDHGEVISEIRRSDLEPYLGLHYPATDVPQASRFLFMKNRVRMICDCYSPPVRVIHDKRLKKELSFCGSTLRAPHGCHAQYMANMGSVASLVMAVIVNEKEDEEAENEGQSQPKGRKLWGLVVCHHTSPRFVPFPLRYACEFMMQVFSIQLNKEVELACQMREKQILRTQTLLCDMLLRDTPLGIISQKPSI

SEQ ID NO: 5759 - protein, 491 aa, Streptococcus sinensis
RGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIEAAVATAVSALKETAIPVSNKEAIAQVAAVSSRSEKVGEYISEAMEKVGNDGVITIEESKGMETELDVVEGMQFDRGYLSQYMVTDSEKMVADLDNPYILITDKKISNIQEILPLLESILKTNRPLLIIADDVDGEALPTLVLNKIRGTFNVVAVKAPGFGDRRKAMLEDIAILTGGTVITEDLGLELKDATIEALGQASKVTVDKDSTVIVEGSGNPEAIANRVVVIKSQIESTTSEFDKEKLQERLAKLSGGVAVIKVGAATETELKEMKLRIEDALNATRAAVEEGIVSGGGTAFVSVLGAVAALELTGDEATGRNIVLRALEEPVRQIALNAGFEGSIVIDRLKNSEAGTGFNAATGEWVNMIEAGIIDPVKVTRSALQNAASV

SEQ ID NO: 5760 - protein, 459 aa, Citrus sinensis
MGILSKIATNNGHGEDSAYFDGWKAFDRNPFHPTQNPGGVIQLGLAENQLCFDLIKDWITKNPYASICTAEGVEVFKDIAIFQDYHGLPEFRQAVAKFMGKGRGGRVTFDPDRIVMGGGATGANELIMFCLANPGDAFLVPSPYYAAFDRDLSWRTGVQIVPVHCDISNNFKITREALEAAYERAQEASINIKGLIITNPSNPLGTTLDRDTLKSLVSFINDKNIHLVCDEIYAATVFSSPKFTSVAEVIQEMDCNRDLIHIIYSLSKDMGLPGFRVGIVYSFNDTVVNCGRKMSSFGLVSSQTQYLLASMLSDDEFVDNFLVETSKRLAKRHHNFTKGLEQVGINCLKSNAGLFFWMDLRHLLKEKTLEGEIALWRTIVNDVKLNVSPGSSFQCTEPGWFRVCFANMDDDTLQVALNRIAAFVQQDKESEKPTKKRCSRIFASASHRGSTNKVSCRRT

SEQ ID NO: 5761 - protein, 137 aa, Kluyveromyces lactis
MCLCCICCTVSDLILYIVAIIFPPIAVGLRSGLCSSDLLLNVLLTMFGFLPGMIHAFYYITVTSPLRTDTETRYYYEQGWNDGQRYGSPSAVTTVSHQPTGVEDPLLPRTQIPLRYEPNNYAQDVPKGSPPPYTESV

SEQ ID NO: 5762 - protein, 515 aa, Edwardsiella tarda
MHIVNGINGLIAKKNVLFFLTSLAISPSVLADTLTRDNGAPVGDNQNSQTAGPIGPVMLQDVQLLQKLQRFDRERVPERVVHARGTGAHGVFTPTADISDLTVAKVFTPGSTTPVFVRFSSVVHGTHSPETLRDPRGFATKFYTAEGNWDLVGNNFPTFFIRDAIKFPDMVHAFKPDPRTNLDNDARRFDFFSHLPESTRTLTLLYSNEGTPLSYRNMDGNSVHAYKLINDKGEVHYVKFHWKTRQGIKNLDPQQVEQIQGKDYSHMTQDLVTAINRGDYPKWDLYIQVLKPADLKNFDFDPLDATKVWPDVPERKIGEMVLNKNPDNVFQETEQVAMAPSNLIPGIEPSEDKLLQGRLFAYADTQFYRIGANGLSLPINKPHSAVNNGNQDGQLNSGHTLDKGVNYQPSRIYPREELVSSRYSQTPLSGTTQQSKIQREQNFKQAGELYRSYSKKEQNDLINSLGTSLASADTVSKNIMLSYFYKADKDYGTRLTSVANGDLPTVKNLADKLQD

SEQ ID NO: 5763 - protein, 587 aa, Magnetospirillum magnetotacticum
MEGAVALGMRRLSVIDLAGGNQPIHNENGSISVVFNGEIYNFRELRRELEEEGHIFSSHTDTEVLVHLYESHGRGMLDRLNGMFAFCLLDRRAGRLFLARDRVGKKPLYYAHGDGAFAFASEIKSLLCHPAVRREADPAAAALYFTHGYVPAPFTPFMGIRKLPAGHWLELDLASGEIQVGRYWDLDYSQVDEDLCEEEAVAGLESALLAAVERRLISDVPLGVFLSGGVDSSLVVAMMARFREGRDIHAFSIGFHEKAFDESGYAESVARAWGVDHHVTRFSDAEMFSVIDEILPRMDEPLSDPSLIPTYLLSKVTQDSGIVVALSGDGADEMFGGYPKYYIHRYAAWLDRLPGILGRDVPAWLFSQVPLKAENNIFNYKVERFVSGLRLAPRHRNQFWVAPFMPDELTRLLPEQEVPRAVWEVTDQYDSRFNGRGVVDRMMYFDAKMMLQDMYLAKVDRASMAVSLEVRSPFLDLEVMDAAVHLPWQLKVRGRETKYLLKKLASRYLPHDVVYRFKRGFGLPLAVWMRTLAPRISETLTQGDCGGIDAAYVQSLLREHLDGTRDHAVKLWAVYAYLTWLRNWGGS

SEQ ID NO: 5764 - protein, 633 aa, Rhodopirellula baltica
MSFAMVDSLRRTVAQRLIVIEGREMEQTALLDGMEENATEQSSVTKSGMGAIVHDDGVAFRVWAPNADSVSVLGTFNQWKEDATPLKREEHGTWYVDVADAKAGDEYKYRIIRGDKSYDRIDPYAREVTNSIGNAVVYADTFDWKHPTFDRPAQNELVIYEMHIGTFHRDDPDQPGTFSDAVAKFKHLKELGVNAIQIMPVAEFAGDLSWGYNPAHIFAVEQAYGGPDALKAFVDAAHEAGFAVIIDVVYNHFGPSDLDLWQFDGWSENDKGGIYFYQDHRSNTPWGDTRPDYGRGEVRQFIHDNAMMWMREYHADGLRYDMTAYIRTISGIGDDDIAEGWGLMQWINRDLRNEFPGCYLIAEDLQTNNWLTKTEDQGGAGFTTQWDAAFVHPIRSAVQEIDDAHRDMWAVRDALCHRYNGDAFQRVIYSESHDEVANGKSRVPSEIDAEDPESRFAKKRTILAAALALTAPGVPMLFQGQEMLEDDWFEDTDPLEWERTRRLKGIKRLFRDLIHLRLNNDGLSKGLTGQHIVMHHVNENDKVVAFVRRAEDPQDDVVVLANFANRSWDQYEIGFPDSGDWQLKLNTDWSGYDQDFDDHPVEHVDATEQPYDGLAARAEVSFGAYAVLVYTRK

SEQ ID NO: 5765 - protein, 394 aa, Pseudomonas fluorescens
MWYEGFLGLSAWSLVAVTLVMTHVTIVAVTVYLHRYSAHRSLELNAGLKHFFRFWLWLTTAQNTREWTAIHRKHHAKCETEDDPHSPVVKGLSTVLCKGAELYREEAQNPETLRIYGKNCPEDWIERNLYSRYRLLGVAIMAVVDLLLFGTIGITIWAIQMMWIPVWAAGVVNGLGHAVGYRNFECRDAATNLVPWGILIGGEELHNNHHTYPNSAKLSVKKWEFDLGWAWIQVFSFLRLAKVQRVAPIAHRVEGKGSLDMDTAMAILNNRFQIMAQYRKLVIGPLVKQELAKVDHSVRHQFHRAKRLLSRETSLLEDRHHARIQSMLEHSQALKVIYEKRLALQQIWVKTSANGHDMLAAIKEWVHEAEASGIQSLREFADQLKTYSLRPAAV

SEQ ID NO: 5766 - protein, 146 aa, Clostridium tetani
MFDMIPFKRNNSMKRDSYFDEFFDNFFNNDFLVPIKFPKNNFRADLKETNNEYIIEADLPGISKDAVKVNYSNNNLVISAKREDIIENKDENYIRRERSYGEFKRAFYVDNVDENNIKASFKNGVLRINLTKLEDTTKARKQIEIE

SEQ ID NO: 5767 - protein, 529 aa, Pleurotus sajor-caju
MPTQEVFDKKDGAVYTTSNGAPVAEPYAAQRAGLHGPLLLQDFHHIDLLAHFDRERIPERVVHANAAGAHGYFEVTHSCADITSNKLLCSVGKKVRLTARFSTVGGESGSADTARDPRGFALKLRTEEGNWDWVFNNTPIFFIRDPAKFSHFIHTQKRDPQTHLKDADMFWDYLGQNPESIHQMMILFSDRGTPDGVHQMHGYSGHTFKWLKDDGSFTYVQVHCRADSGFKTLDGETAHRLTADNPDYSTEMLFRTIEAGKFPSWTVYIQTMTPEQAENFRYNILDLTKVWPHKEFPLRPIGRFVLDENPKNYFAEIEQAAFAPSHLVPYIEPSADPVLQSRLFSYLDTHRHRLGANYHQIPVNAPIVPVANFQRDGPMTVNNNQGNRPNYQSSIQPLTYISNKETLEAGCRNQERMARHENFIGGAYRDLGEITELDFEQPRALWQKVWNDQQREAYVKNVAGHFGGVKSPVVRDRQLSVWAAVDQDLSDRIAKAVGAKPVAPLKVKPAAEALRFRCNIGGPPGPSRL

SEQ ID NO: 5768 - protein, 165 aa, Glycine max
MENRTSSVLPPGFRFHPTDEELIVYYLCNQASSRPCPASIIPEVDIYKFDPWELPDKTDFGEKEWYFFSPRERKYPNGVRPNRATVSGYWKATGTDKAIYSGSKHVGVKKALVFYKGKPPKGLKTDWIMHEYRLIGSRRQANRQVGSMRVSLCLINCYILLAYSS

SEQ ID NO: 5769 - protein, 510 aa, Pseudomonas syringae
MPLLNWSRHMVCLTAVGLVTVPTAYAADTLTRDNGAVVGDNQNSQTAGAQGPVLLQDVQLLQKLQRFDRERIPERVVHARGTGVKGEFTASADISDLSKATVFKSGEKTPVFVRFSSVVHGNHSPEALRDPHGFATKFYTADGNWDLVGNNFPTFFIRDAIKFPDMVHAFKPDPRTNLDNDSRRFDFFSHVPEATRTLTLLYSNEGTPAGYRFMDGNGVHAYKLVNAKGEVHYVKFHWKTLQGIKNLDPKEVAQVQSKDYSHLTNDLVGAIKKGDFPKWDLYVQVLKPEELSKFDFDPLDATKIWPDVPEKKIGQMVLNKNVDNFFQETEQVAMAPANLVPGIEPSEDRLLQGRVFSYADTQMYRLGANGLSLPVNQPKVAVNNGNQDGALNTGHTTSGVNYEPSRLEPRPADEKARYSELPISGTTQQAKITREQNFKQAGDLYRSYSPKEKTDLVQSFGESLADTDTESKNIMLSFLYKADPDYGTRVTEVAKGDLSKVKSLAASLKD

SEQ ID NO: 5770 - protein, 160 aa, Glycine max
MSLIPNIFGGRRSNVFDPFSLDMWDPFKDFPFPNSVSTSFPEFSRENSAFVSTRVDWKETPEAHVFKADIPGLKKEEVKVQIEDDKVLQISGERNVENEDKNDTWHRVERSSGKFMRRFRLPENAKVNEVKASMENGVLTVTVPKKEVKNHDVKAIEISG

SEQ ID NO: 5771 - protein, 263 aa, Triticum aestivum
  misc_feature (105)..(105): Xaa can be any naturally occurring amino acid
MRNSGATAASAPPAATMHGSYAAPPASSAGYAKIPTYPPPPSSSYPSPSPSPVPPAASASAPAPIQDPTAPPSSLAKAAELVTRFREQGQALIAARRPWGEVFRXPAFSKPPNVGEAVSRMRRNTAYFRANYALAVLAVVAASLLWHPGTLFALLALCAAWFFLYFARPAEGAQPLRVFGTEFDDGTVLALLSGVTVIAMLFTDVGWNVVGSVMIGLALAGAHAALRSTDDLFLTEQEAAGNGLVAAGFSAAGPILPTYVRIG

SEQ ID NO: 5772 - protein, 262 aa, Triticum aestivum
  misc_feature (234)..(235): Xaa can be any naturally occurring amino acid
  misc_feature (241)..(242): Xaa can be any naturally occurring amino acid
  misc_feature (248)..(249): Xaa can be any naturally occurring amino acid
  misc_feature (253)..(255): Xaa can be any naturally occurring amino acid
MERKSAILMNRYELGRMLGQGTFAKVYHARSLATNQSVAIKVIDKDKVLRVGMIDQIKREISIMRLVRHPNIVQLHEVMASKSKIYFAMEYVRGGELFARVAKGRLKEDAARKYFQQLIGAVDFCHSRDVYHRDLKPENLLVDEHGNLKGSDFGLSALKECQKQDGLLHTTCGTPAYVAPEIINKKGYDGEKADIWSCGVILFVLLAGYLPFQDSNLMEMYRKISKGDVRYPQXXSSDARXXLSRLLXXNPNXXXTMDKLIE

SEQ ID NO: 5773 - protein, 109 aa, Triticum aestivum
NKFVQKSRLRTGSGVPGISVDPRDPRAGARAPCPRLELCYSMSQRFLDEHQPPSKVEDSAPEPPAVVPPPPAQPIPNWKCSCPGDSPDEVKARLKYWAQAVACTVKLCS

SEQ ID NO: 5774 - protein, 334 aa, Haemophilus ducreyi
MKTLGEFIIEKQAEYPEAKGELSGILASIRLAAKIIHREINRAGLSQDILGFAGSENVQGETQMKLDIFANETMKKALLAREDVAGFASEEDDNFIAFDSERNRNAKYILMTDPLDGSSNIDVNVSVGTIFSIYKRISPIGSPVTIEDFLQEGRKQVAAGYVTYGSSTMLVYTTGNGVNGFTYDPSLGLFILSHPDMKMPAEGKYYSINEGQYVTFPLGVKKFIKYCQENDEASKRPYSSRYIGSLVSDFHRNLLKGGIYIYPTSTVYPQGKLRLLYEGNPMAFLAEQADGMATDGFQPILDIKPTELHQRVPFFIGSKTMVKQANTFMQTFTE

SEQ ID NO: 5775 - protein, 198 aa, Pyrococcus horikoshii
MIHRIKDEFVNVYIIDRGDHLVLIDTGIESTCEKILKKIEELGKPLKTVIITHYHLDHTGSLKCVKDGTGAKVVAHEEEVKAIEEKTGVRVDVPVKDGDVVEGLKVFHMPGHTRGSICLLDEESGALFVGDLMVERDGKLYEVPQQYSEDPMMNRERIKELLNIEFKAIYPAHGEPVLENAKEKVKELVESFSKGETN

SEQ ID NO: 5776 - protein, 655 aa, Burkholderia multivorans
MCGIDGFLNSVAFDEETARGTLARMTASLAHRGPDAQGLWVDPAAGIALGHRRLAIVDLSVHGRQPMASACGRYVMVFNGEIYNHRELRAQLERVGRAPAWRGHSDTEVLLAAFAAWGVDATLRRATGMFALALWNRESRVLTLARDRIGEKPLYYGRIGDALVFASELKALRAYPGFGGEIDRDALCLYLRHSAVPAPHTIYRGIRKLPPGSWIQFEHAQDTPRIRTYWALEHAIDAGHHEPFAGTAAEAVDRLDTVLRQAVARQMEADVPLGAFLSGGVDSSAIVALMQAQSAAPVDTFTIGFHEAGYDEAGYAKAVARHLGTRHTELYVTADHALDVVPKLPAIYDEPFSDASQIPTFLVAELTRRHVKVSLSGDGGDELFGGYTRYFLTPRLWRKLHRVPAAVRTRIAGALHALRPDHADQLAAVAQGAWGAGELRDSPTRIGDRLHKLGHVMTADSRIGLYRLLMSSVHHPERIALAGHEPPTPLDTVSAWPAHLSFAEQAMAIDTLTYLPTDILTKVDRAAMAVSLETRMPFLDHHVVEFAWRLPASLRLPEGQSKALLRRLLDRYVPTELIDRPKQGFCAPIDHWLRGALRDWADALLQPSRLRDEGFFDAAAVERLWRQHQTGRMNWQHQLWTVLMFQAWLDAQRAA

SEQ ID NO: 5777 - protein, 251 aa, Escherichia coli
MNLNSIPAFDDNYIWVLNDEAGRCLIVDPGDAEPVLNAIAANNWQPEAIFLTHHHHDHVGGVKELVEKFPQIVVYGPQETQDKGTTQVVKDGETAFVLGHEFSVIATPGHTLGHICYFSKPYLFCGDTLFSGGCGRLFEGTASQMYQSLKKLSALPDDTLVCCAHEYTLSNMKFALSILPHDLSINDYYRKVKELRAKNQITLPVILKNERQINVFLRTEDIDLINVINEETLLQQPEERFAWLRSKKDRF

SEQ ID NO: 5778 - protein, 496 aa, Kluyveromyces lactis
MGNSPSKNQYGIQGTIKNSGGSQQQQGLSLSDESGNEPNDPDDSRSLPTTTNNNNYNNLVSAKSRQISSSTPNNYGLDIDMSLARDLSKYPISISNTSSVSTTGSESSFSMKSVPQIVGSGGGGGSLPTTTSSPFLSDSHFDHSPMSLPPIKEENDTAPSSVSSSFRKGSKIPNQRSSKPIILRRSSHDLSCTDHVNIDDMIDKLLYLGESRIYHSEDFPFRSWEIQLVCTMAREIFLNQPSLLKLQAPIKVVGDVHGQFTDLLRILRLSGVPPDTNYLFLGDYVDRGKQSLETIMLLLCYKIKYPDNFFMLRGNHESANVTKMYGFYDECKRRLSTKAWKMFVDVFNSLPFAAIIQDKIFCVHGGISPQLSNLKQVSKIQRPTDIPDDGLLTDLLWSDPDSSINDWSLNDRGVSYTFSKKNIADFCSKFNFDLIIRGHMVVEDGYEFFARKKLVTIFSAPNYCGEFENWGAVMSVTTGLMCSFELLKPHGIKRKR

SEQ ID NO: 5779 - protein, 437 aa, Glycine max
MKVAKGRILVGKYELGKTIGEGSFAKVKFARNVQNGNYVAIKILDRKHVLRLNMMEQLMKEISTMKLINHPNVVRILEVLASKTKIYIVLEFVDGGELFDKIAANGRLKEDEARNYFQQLINAVDYCHSRGVYHRDLKPENLLDSNGVLKVSDFGLSTYSQKEDELLHTACGTPNYVAPEVLNDRGYVGSTSDIWSCGVILFVLMAGYLPFDEPTHMALYKKIGRAEFSCPSWFSPQAKKLLKHILDPNPLTRIKIPELLEDEWFKKGYKPTSFTEEEDLNVDDVVVAFNESNENLVTERKEKPVSMNAFELICRSQSFNLDSLFEKQTGQVKQETSFTSQCPANEIMFKIEEAAKPLGFNVYKRNYKMKLQGDKSGRKGHLSVATEVFEVAPSVHMVELRKTGGDTLEFHKFYKIFSSGLQDIVWHDTEGKKNMKN

SEQ ID NO: 5780 - protein, 674 aa, Unknown
  Synechococcus sp. WH 8102
MCGIGGVFLADRHQTLDRQLLVNMAAIQSHRGPDGFGVECLDAAGVGFCHARLSIIDLNESRARQPFLSNDRQVLMAHNGEFYDFQRIRADLTAQGVRFSSKSDSEILLRLYQRQGLESTLPLLRGEFAFALFDAADDCLYLVRDRFGIKPQYWTMTPEGLVFGSELKVLFAHQAVERRFTSEGLFHQLMQTMVPGTTAFAGVHQVQPGHVLKVQRRSDRLEVSESTYWDVDFPRLDQRDSTLTEADHIANVRAALLEAVEMRMVADVPVGCYLSGGIDSCSILGLASAVSQGPVKAFTIGFDDARYDETPIAAEMAEATGAEQDVMRLSGRELYGHMEQTLWHTERTIYNTLAVAKYLMSRHVNSVDYKVVMTGEGSDELFGGYPAFRRDMFLHGLEDLPQSDRQDWESLLQTNNSLVQGAMLAADQVDDPDLDAVVGFTPSCLQPWLACAPLVPDLLADEHRQALVEYSPGKAIAEQLNPQQLDGRHALDKAQYVWIKTMLEGQILTWGGDRVDMANSMEARPAFLDHHLAAAAVQVPPELRIKGKTEKYVLREAMAGLLPEVLYKREKFAFMAPPAHTEPEKWAQMKQLADDYLSDEAIDAAGLLSKEGVRALFARHDDPATTDAERVQMDAVINHLLGVQMLHRMFVAADVPAQAREQADRLGWRVLMPV

SEQ ID NO: 5781 - protein, 583 aa, Lycopersicon esculentum
MSSGGCSIVWFRRDLRLEDNPALAAAVRAGSVIAVFIWAPEEEGYYCPGRVSRWWIKKSLAHLDSSLKKLGTSLITKRSNDSVSSLLQVVKSTGATRVFFNHLYDPISLVRDNCAKETLSAEGVSVCSFNADLLYEPWEVVDDESRPFSTFSDFWEKCLTMPYDPEAPLLPPKRIISGDASRCPSDNLVFESELEKGSNALLARAWSPGWSNADKALTTFINGPLIEYSKNRSKADSATTSFLSPCLHFGEVSVRKVFHRIRTKQTLWANEGNKAGEESVNLFLKSIGLREFSRYMSFYHPYSHERPLLGQLKYFPWLVDEGYFKAWRQGRTGYPLVDAGMRELWATGWLHDRIRVVVSSFSVKVLQLPWTWGMKYFWDTLLDADLESDALGWQFITGTLPDGCEFLGIDNPQFEGYKFDPNGEYVRRWLPELARLPTEWIHHPWDAPESVLQAAGIELGSNYPFPIVEIVAAKERLEEALSQMWQLEAAARSAIENGMEEGHGDSTDEFVPIAFPQAMQIEMEANNVPVRNNNPTITALRRYGDQIVPSMSSSFFRNEDEETSVDIRNSVVDSRAEVPIISM

SEQ ID NO: 5782 - protein, 388 aa, Vigna radiata
YFDGWKAYDENPYDELTNSSGVIQMGLAENQVSFDLLEKYLEEHPEASTWGSGFRENALFQDYHGLRSFRTAMASFMEQIRGGRAKFDPDRVVLTAGATAANELLTFILANPGDALLVPTPYYPGFDRDLRWRTGVNIVPIHCDSSNNFQITPQALEAAYNEAEDDNTKVRGVLITNPSNPLGATVQRSILEYLLDFVTEKNIHLVSDEIYSGSVFSSSEFVSVAEILEARQYKEAERVHIVYSLSKDLGLPGFRVGTIYSYNDSVVTTARRMSSFTLISSQTQHLLACMLSDKKFTENYIGTNRERLRKRYQMIIEGLRSVGIECLKGNAGLFCWMNLSPLLEKPNKEGELELWNAFLHEVKLNISPGSSCRCSEPGWFRVCFANMD

SEQ ID NO: 5783 - protein, 649 aa, Arabidopsis thaliana
MANKYVSSVLKSLLVLLHLVFLSKQHVDSASIVKSLPGFEGQLPFELETGYIGVGEEEEVQLFYYFIKSERNPKEDPLILWLTGGPGCSAISGLLFENGPLTMKLDVYNGTLPSLVSTTYSWTKTSSIIFLDQPVGTGFSYSRTQQFNKPSDSGEAKRIHEFLQKWLGKHQVFSSNPFYVAGDSYSGLVVPATVQEISKGNYECCNPPINLQGYVLGNPLTDYTTGSNSRIPFAHGMALISDELYESLKKTCKGEYTNVHPRNTQCLKFVEEFNKCTNRIFQQLILDPLCETETPDCYIYRYLLTTYWANDATVREALQINKESIGEWVRCYYSIPYNNDIKSSMPYHVNNSISGYRSLIYSGDHDFEVPYLGTQAWIRSLNYSIIDDWRPWMVKNQIAGYTRTYANKMTFATIKGGGHTAESKPEEASIMFQRSFVEAPLGQWLTKGSLMLLQQDVWGSSPNYCDLLVDLQINGGKCAGDLQRCTIMDLIRKKKTKRSFSSILDWIKGMANNYVSSVLKSLLLLLHLVFLILYIGANEEEEVQLFYYFIKSDRNPKEDPLILWLTGGPGCSAISGLLFENGPLAMKLDVYNGTLPFLVSTTYSWTKTSSIIFLDQPVGTDQPVSIPLERHAKVSKRDIPVGSEVKNLP

SEQ ID NO: 5784 - protein, 395 aa, Anabaena variabilis
MTTQNITTLSSSPAQTELKTPGYQGCQSRSLHDSEIPEVDLFTPLIIRDITLPSRVAMSPMCQYSAENGFANDWHFVHLGSRAVGGTGLIMVEATAVTPQGRITPGDLGLWDDKQIEPLTRIVRFLRQQGSVTGIQLAHAGRKASCNVPWLGGTPLTPEQGGWQPVAPSPIPFQENAPVPISLDERGIQETIFAFVAAAQRALQVGFQMIEIHAAHGYLLHSFLSPLSNRRTDRYGGSLENRMRLLLEVVRRVRDVLPNGMPLFVRISATDWVEGGWDLQQSIILSRELKTLGVDLIDVSTGGLVPHARIPVEKGYQVPFAAKIREEAGIMTGAVGLINEAEYADQIITRGCADLVLIGRELLRNPYWSIYARCSLDEEPNWPVPYGYAVKRQRR

SEQ ID NO: 5785 - protein, 439 aa, Saccharophagus degradans
MQAQTPSNEPEDADTISVLPLEDLRVFTKAYEHIRSSYIEEIDDRTLLEYAIRGMLDELDPHSAFLDASSFDDLQVHTSGEFGGLGIEVGIEDGFVKVISPIDDTPAQKAGVEAGDLIIKINGTSVKGITLSDAVEKMRGAPGTDITLTIMRKDVEQPFDLVLTRDKIKVRSVRSDIVEHDFAYLRVAQFQLRTGQDLANEIKKLQKINSDLKGVILDLRNNPGGVLTASVEVADLFLNDGLIVYTEGRMHDANSQYSATPGDAVDGLPMVVLINGGSASASEIVAGALQDQNRALVLGTRSFGKGSVQTVISITEDRAIKITTALYFTPNGRSIQAQGIEPDIEVERVKITAVQPQADITEADLSGHLKNAKGGAEVKASDRGKRKNELHERDSQLYEAVNILRGLHLFQKAQQAKAEKELEKSQAAEQAAAETTETP

SEQ ID NO: 5786 - protein, 535 aa, Tetragenococcus halophilus
MAKDIKFSEDARRSMLNGVSKLADTVKVTLGPRGRNVVLEKSYGSPLITNDGVTIAKEIELENRFENMGAQLVSEVASKTNDIAGDGTTTATVLAQSIVKNVTSGANPLGIRRGIEQATQKAVEELQNISTPVESKEAIVQVGEVSSGSKQVGQYIADAMDKVGNDGVITIEDSQGIDTELDVVEGMQFDRGYLSQYMVTDNEKMEADLDSPYILITDKKISNIQDILPLLEQVVQESKPLLIIADDIDGEALPTLVLNKIRGTFNVVATKAPGFGGRRKAMLEDIAVLTGATVITEDLGLELKDATMDSLGKANKVTVDKDNTTIVEGAGDSTAIEDRVQLIKNQVAETTSDFDREKLQERLAKLAGGVAVIKVGAATETEVPKLKLRIEDALNAARAGVEEGMVSGGGTALVNVINKVAELDADDDAITGVNIVLRALEEPVRQISENAGFEGSVIIEKLKSEKLGIGFNAATGQWVNMVDAGIVDPTKVVRSALQNAASISALLLSTEAVIADRPDESGNDAGVALKEWIHQ

SEQ ID NO: 5787 - protein, 364 aa, Bacillus licheniformis
MKKQYESLFTPFTFKNGIQLKNRIIMPPMGHSSSLPGGFISDDELVYYAARATEVGMVITSATTVQPGTGFPGIPGAENDDQIPGLTRLAATLKKHGAKAILQLFHPGAKGIERTVSASAVAPNQPNAPVPRALSEQEIQDLIHSFGQTARRAIEAGFDGVEIHGANGFLIHQFFSPYYNRRNDGWGGTLEKRMRFPLQIIEEIRRVADSCHKPSFIIGYKFSPEEPETPGITMDETLSFVNVLREQGLDYLHVSLVDFRSLPRRGADRSRARMELIKEAVQDRLPLIGAGQVHTPEDALQALETGADLIGIGRGLLMDPEWLQKVRAGKEDDIQTTLSRHDQRKLAIPDAFWESIPMYIDFSD

SEQ ID NO: 5788 - protein, 368 aa, Pseudomonas syringae
MSLLLEPYTLRQLTLRNRIAVSPMCQYSSVDGLANDWHLVHLGSRAVGGAGLVITEAMAVTPDGRITPEDLGLWNDEQIEPLQRITRFINAQGAVAGVQLAHAGRKASTWRPWLGKHGSISLNEGGWTPVGPSAIAFDPQHTAPVQLSETQIQELIKAFVDSARRALEAGFKVVEIHAAHGYLLHQFLSPLSNQRTDEYGGSFENRIRFTLQVTEAVRAVWPAELPVFVRVSATDWVEDGWNADETVELARRLKAIGTDLIDVSSGGTSAKAEIPVGPGYQTRFAERVRKESEIATGTVGMITDPAQAEHILRTGQADIILLARELLRDPYWPLRADEDLGGRLATWPAQYQRATHRDQPIHESDLRD

SEQ ID NO: 5789 - protein, 777 aa, Neurospora crassa
MAQAYDDEELSISLSPSQIRSRNKRSGDGASGFGPSTGNLHEYGQHGQQLHPNINAVMADAPLRDKMRTEQRIGAYNIVKTLGEGSFGKVKLAVHRMTGQQVALKIIARKKLISRDMQGRVEREIEYLQLLRHPHIIKLYTVIKTPTEIIMVLEYAGGELFDYIVQHGKMKEDEARRFFQQMLCAVEYCHRHKIVHRDLKPENLLLDDNLNVKIADFGLSNIMTDGNFLKTSCGSPNYAAPEVIGGKLYAGPEVDVWSCGVILYVLLVGRLPFDDEHIPSLFAKIARGSYMVPTWMSPGAASLIKKMLVVNPVQRATIDEIRQDPWFLKDLPAYLHPPVEEFLNTGVDPNKAIKVSDIAPNAPPQEQEKLHNEVTEKISKTMGYGKRDVEEALEADEPSAIKDAYMIVRENKLMQSNLDFATSHPPSASILHLPSGEHRLTQKKSKSLSLRPSSFWSNTNEEYQDTLLKTDEEIPGLTTEESVPSPLHDPNMSSARSIASVSTATSPRPYVSKIGILPSSLPTYHRVFMEREKAKAEGLEPPDAIPTIVEPANQPRSQAEQEETIRRLKPHSRSQLRLDEANKRPQGLTPVHPPKKNKPARWQFGIRSRNAPWEALVCIYKALNKLGAGWIVDEDYERAHRDDDDTDDYDGPSIGSRKKSSSSMDPTKTYRLPADPWHIKIRWTTDKLKKHSVASGLSEAGENTHVSRDGSDSKYQVVAMRMEIQIYEMEHGVYLVDFKVDGYETPDGKLLEDKEVTSPFPFLDMAAKLIMQLADAD

SEQ ID NO: 5790 - protein, 151 aa, Wolbachia endosymbiont
MSNIVHSNKNNKCDNFSVRGLQRAVDNIFDSFFTGWDSELSRRGSSLLPACDFYETKESYCLSLELPGISKESIDISISSDSLIVKGEKTCNNESKDKQFYHRERYYGSFYRSIQLPVNVEQDKVSANFSDGILHVTIPKSEKHIKRIDVK

SEQ ID NO: 5791 - protein, 468 aa, Lactococcus lactis
MTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDQFVDKTVYDDGRIDYVKQHLEVLSDAIADGANVKGYFIWSLMDVFSWSNGYEKRYGLFYVDFDTQERYPKKSAHWYKKLAETQVIE

SEQ ID NO: 5792 - protein, 655 aa, Burkholderia cepacia
MCGIDGFLNSVACDEETARGTLARMTASLAHRGPDGQGIWVDPEAGIALGHRRLAIVDLSVHGRQPMASACGRYVMVFNGEIYNHRELRAELERAGRAPAWRGHSDSEVLIAAIVAWGVDATLRRATGMFAFALWNRASRVLTLARDRIGEKPLYYGRIGDALVFASELKALRGYPGFDGAIDRDALCLYLRQSSVPAPHTIYRGIHKLPPGTYIQFEHARDTPRLRAYWTLEQVIEDGRAQPFEGSADDAVGQLDAVLRQAVARQMEADVPLGAFLSGGIDSSTIVALMQAQSSTPVDTFTIGFHEAGYDEAGYAKAVARHLGTRHTELYVTADHALGVVPKLPSIYDEPFSDASQIPTFLVSELTRRHVKVSLSGDGGDELFGGYTRYFLTPRLWRKLHRVPGAVRARIAAALHALRPDHADQLAAVAQGAWGGVEARESAARIGDRLHKLGHVMTAESRIGLYRLLMSSVHHPERLALSGQEPATPLDTVSAWPAHLSFAEQAMAIDTLTYLPTDILAKVDRAAMAVSLETRMPFLDHHVVEFAWRVPAHVRLPEGQSKALLRRLLDRYVPSALIDRPKQGFCAPVDHWLRGALRDWAEALLRPSRLREEGYFDADAVERLWRQHVTGRMNWQHQLWTVLMFQAWLEAQRAA

SEQ ID NO: 5793 - protein, 731 aa, Crocosphaera watsonii
MFVMFRREVQLPLGKLVRQTQSLLPEEKRPKLVQWDEMYQLEKLIISLGDYFQELQYLQEEIAEQKASEKALEELNLAKSEFLSMMGHEIRTPLNAVTGMTGLLLDTELSDQQKEFVNIIRNSGENLLTMINNILDFSKIEANKLELEEAPFELGLCIEEVLRLFVSQASQKKLELAYLLEPNTPSGIVGDSTRLKQILANLIGNAVKFTPEGEVVIYVSSTVIEGGEGEVNPNYELRFAVKDTGIGIPKERCHRLFQPFSQVDASTTRQYGGTGLGLVISKRLSELMGGKMWVHSEEGKGSTFNFTLRAKAATSSSPVTSQEGESELMGKRVLIIDDNLTSQKILINQAQSWGMFTCAVDSGEKALEWLKRGITFDVAILDMNLPDMNGLELVREIRKQPNCTRLPLIMLSAITETEKTFQSSEEEFVAVLCKPVQRSQLYNVLMEIFSEIPRAPIRVTQSQSVQCSEKSLMGQTHPLKILVAEDVVVNQQVIHLLLEKLGYCADIVSDGQEVLEALKNFAYDVVLMDIRMPEMDGLTATDHICQNYAPDKRPRIIAMTAESMEGDRERFIAGGMDDYICKPVRIKELQEALSRCQPRSESLAIEPKMFNQLRNIAGKRTNEIIKGYLQDTALRIETMNKAIEKRDTEQLYQAAHALRSPSGNLGATNLYYLCKEMETIAREGSLEEASERILGITIEYDRVYYALKKELMREPIPEPIPEPMVKFGGIS

SEQ ID NO: 5794 - protein, 151 aa, Triticum aestivum
ARGKAGEVVPAYVWAPEEDGPYYPGRVSRWWLSQSLKHLDASLRRLGATHLFFNHLYDPLSLVRDHRVKQVLGAEGITVQSFNSDLLYEPWEVLDDHGCPFTMFTPFWNKCLCMVDPPAPMLPPKRINSGLCTAFFFFFFFLFSRKRNNNY

SEQ ID NO: 5795 - protein, 512 aa, Oryza sativa
MATFFRSANLASRVFDRQFLSPRPGATVNTVRQFYENLVPSYTICDIDCPDYSFRKFTDDGNYLVAFSRNHQDLIVYRPIWPTFSCNEPCDSHDLPPKAKKFDSFFKQLYSISLASSNEYICKDFFLYMECHQFGLFATSTAQSNDSSATEGAIHGVPSIEKITFYLVRLDDGAILDEKAFRNDFINLAHSIGAYLYEDLLCIVSLRYQTIHVLQIRDSGNLVEVRKIGAFCQEDDELFLHSHGQAARGVSFLPGIKQRLLSFIFRKTWNEESDQTLRVQHLKKKFYFHFQDYVDLIIWKVQFLDRHHLFIKFGSVDGGVSRSTEQNSAFFAVYNMETTDIVSLYQNSSEELYSLFEYFYDHFHTNPQNSSHGNFISSHSNNVHALDQLRTIKNKANSTSQQFVKKMMASLPYTCQSQSPSPYFDLSLFRYDEKLISAIDRHRHCTEHPIKFISVKQPNVVKFKIKPGSDSGASDSRAKRISSFLFHPFFPLALSIQQTYMQPTVVNLHFRR

SEQ ID NO: 5796 - protein, 484 aa, Proteus mirabilis
MEKKKLTTAAGAPVVDNNNVITAGPRGPMLLQDVWFLEKLAHFDREVIPERRMHAKGSGAFGTFTVTHDITKYTRAKIFSEVGKKTEMFARFSTVAGERGAADAERDIRGFALKFYTEEGNWDMVGNNTPVFYLRDPLKFPDLNHIVKRDPRTNMRNMAYKWDFFSHLPESLHQLTIDMSDRGLPLSYRFVHGFGSHTYSFINKDNERFWVKFHFRCQQGIKNLMDDEAEALVGKDRESSQRDLFEAIERGDYPRWKLQIQIMPEKEASTVPYNPFDLTKVWPHADYPLMDVGYFELNRNPDNYFSDVEQAAFSPANIVPGISFSPDKMLQGRLFSYGDAHRYRLGVNHHQIPVNAPKCPFHNYHRDGAMRVDGNSGNGITYEPNSGGVFQEQPDFKEPPLSIEGAADHWNHREDEDYFSQPRALYELLSDDEHQRMFARIAGELSQASKETQQRQIDLFTKVHPEYGAGVEKAIKVLEGKDAK

SEQ ID NO: 5797 - protein, 536 aa, Onion yellows
MSKKILYGKEARKALLQGVDAIANTVKVTLGPKGRNVILEKAYDSPAIVNDGVSIAKEIELKNPYQNMGAKLVYEVASKTNDKAGDGTTTATVLAQSMIHRGFDAIDAGANPVLVKEGIELAALTVAKKLLAKSKKVDAQEDIQNVAAVSSGSQEIGKIIAQAMQKVGKDGVINVDESKGFETELEVVEGLQYDKGYASPYFVSDRESMTVQLENALVLVTDHKISTVQEIVPILEEVVKASRPLLIVAEAVENEVLGVLVANKLRGTFNVVVTNAPGFGDNQKEMLQDIAVLTKANFVSKELNMKLADLKMDDLGNINKAIIKKDNTTLISNSKSPELEKRIQVLKTQIKNATSDYETKNLQERLAKLSGGVALIKVGAATDTELKDKKLRIEDALNATKAAITEGIVVGGGKALVEVYQELKDTLVSDNKEVQQGIDVVVQSLLVPTYQIAYNAGFSGKDVVKQQLLQPLNFGFNAKEGKYVCLLKEGIIDPTKVTRQAVLNAASISALMITTEAAVVSLKENKDNNFDLGTQE

SEQ ID NO: 5798 - protein, 365 aa, Yarrowia lipolytica
MSTAKKQTIHFSGHNNFRRRLVLATLSGMPVRIDKIRSDDVEPGVKDYEVSFLRLLESITNGSVFEISYTGTTVVFKPGIIVGGSVTHNCPLSRGVGYFIEPLLLLAPFGKKALTATLRGITSHSLDPSPDSIRTSVFPVMQKFGIERQELKIIQRGATPLGGGEVMLHLPHLVLHPKTLHATTTPTISKIRGIAYSCRVSPASVNRLIDGAREELRATGCETFIFSDVARGDESGKSPGFGIVLVGETRPGFCISAESVAVAGSIPEDLGRETAKKLIEEISRAGVFGRNQLDMAIIFMILGSGDVGRLVIGKQNIDERFVTLARDIKKFWGVEMRLKEDDENENEMICTVKGVGFVSASKKIA

SEQ ID NO: 5799 - protein, 191 aa, Oryza sativa
MATDGGGATPSPAAKKANLLDPYSIKHLLDETVSEVAKSKGYPEDARLSNRRLAVGAAVIAVALLAQFYPRKFPENRDVLLACIALYAALNVALQIVTYTKEKNAILFTYPPAGSFNRTGLVISSKLPRLSDMYTLTIASADPHSKSSSEPVHFTKSVTKWFTKDGVLVEGLFWKDVEKLIDDYNSDHRSK

SEQ ID NO: 5800 - protein, 336 aa, Pseudomonas syringae
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDIKIPESTQEFAINMSNQRHWEAPVQRYVNELLAGEEGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKE

SEQ ID NO: 5801 - protein, 520 aa, Neurospora crassa
MVHLTIIPKEDEIRDGLDIPLTGALKAVHLQLANDEDRFTTSVYGSKFAAADLPRHEMPDEEMPKEVAYRMIKDELSLDGNPLLNLASFVTTYMEEEAEKLMTESLPKNFIDYEEYPQTADIQNRCVSMIGRLFNAPVKDAEASSAVGTSSVGSSEAIMLGVLAMKKRWKNKRIAEGKPADKPNLIMSSAVQVCWEKATRYFEVEEKFVYCTPDRYVIDPKETVDLVDENTIGICCILGTTYTGEYEDVKAVNDLLVERGLDTPIHVDAASGGFVAPFVVPDLEWDFRLKNVVSINVSGHKYGLVYPGVGWVVWRSAEYLPQELVFNINYLGADQASFTLNFSKGASQVIGQYYQLIRLGKHGYRAIMSNLTRTADYLAESLAALGFIIMSQKSGQGLPLVAFRLKEDPDRTYDEFALAHQLRVRGWIVPAYTMAPKTEGLKMLRIVVREDFSRNRCDGLISDIRSCQGILEQMDKETVKKQQEFIHKHHVVSGKASHNHPKYHILWSESNSSRNQATPE

SEQ ID NO: 5802 - protein, 406 aa, Neurospora crassa
MSGEKTDFIRFTGHRAFTHRIVLSTLTGRPVHISKIRSSSATHPGLAPHEVSFLRLIEAITNGSVIDVSYSGTTITYQPGLITGTVAGVNAGAVGDVVEHTLPANNTRGITYFLLPLALLAPFSKAHMNVRFTGPGVITSATHLTGDISVDSFRTAVLPLYGMFGIPPARIELRVLSRSCSGPGGRGGGGVVELRFASQVRLPKTLHLNRRPGRIRRIRGVAYCTGVSASHNNRMITAARGVLNQLVSDVHVAAQYDPAPLVGDKSGAKKKIGIGFGLSLVAESSADGVLYSADVVAPPEGGVVPEDIGARCAYQLLEVIAQGGCVSNVSAPTLLTLMAMGSEDVGRLRLGREVLAREETIGLARDLKKFGAASWGIRDVDDDGETTDLVVSVKGTGVGNVGRKVA

SEQ ID NO: 5803 - protein, 338 aa, Desulfovibrio desulfuricans
MRQVTVTEHLLLHQTKSPAATGQFTALLYDLILAAKIISKSVNKAGLLDVLGGTGQVNVQGEHVQKLDEYANRVLIHRMERTGVLCAMASEENADLIRVPERFEAGDYILIFDPLDGSSNIDVNINVGTIFSILKRKPGASGSKDVTLGDVLQSGVEQVAAGYFLYGPSTMLVYSSGQGVHGFTLDPSVGEFLLSHPDIRYPEQGRIYSVNESYWHYWDEPTREVVSYFKGPDNPLGKPYSLRYVGSLVADFHRNLFYGGIFMYPMDYRLPEKPQGKLRLMCEASPLAFLAEQAGGRATDGTKRILDIVPGELHQRVPLFIGSAGDVDAVEAIYRRHS

SEQ ID NO: 5804 - protein, 935 aa, Leptospira interrogans
MEVKIVSLENDHILFLFFTNFESYFSETPSIFLQDSELRSTIFQKSANAILLLDPDKDLILEINQTASRYFEIQNQSEILNLPFSNLLAQDFTHFEYTSRKKKILSGETPSWDLEFKTLRGKKFWGNTSCRMISTHLNKIILVQIKDITEKVNTRKSLLEQAGTIAEHEANLNAIIENSEAMIWSIDKNYKLLIFNSQFQNVMQNFYHSEISTGFNLFQKELPPEIAKYWKEFYDRALSGEKVSVARKRPNQDGTFIFSELSFQPIRNTEYEITGVSAISVDITDKKLAEEKFRLLFERSSEPHVLYDDFGILECNPATLKMLRCSDKKLVLGKHPIHFSVETEKEKTNELESIALEKGSYTFEWVYKRFNDEEFSVEVTLIPIIIHQKRVFLSVWHEITERKVYEDSLKRAKEIAEAASKAKTDFLAMMSHEIRTPLNGVIGTVSLLEGTFLNTEQKEYLDIIKSSGQNLLILLNDILDLSRIESGQLKLEIQPVSPEKLTNEVVNLFRPMAEEKGLVVESEVSFNVPNWIISDPYRLRQVLTNLIGNSIKFTEKGKIHLSVEAEKFPNDKLRLIFHVKDTGIGIAEEKLELLFRAFSQVDSSTTRKYGGSGLGLTISKKLAELMKGEITVKSQVNSGSEFSLSILTEKLEYEIPAGVQELHSKNLATSAVISIQEFQFKEQIKKFCERNGFLVKMARTAKETIRIIGEEERIGVFLTDLNFPDMNLSEMLNELKKQNPSLKLTVILFMEKELKDSYYLVTNSLFNRPGFQIFMMFKPILLEELSKNFEKAFPIKVLKKEKQNENKKLLSEKIPLQILLVEDNVINQKIALRLLTKLGYNADSALNGLEGIEKLKTKNYDLIFMDIQMPEIDGYETTFQIRKDFGKSKPVIVAMTANAMEGDREKCLEAGMNAYISKPIQIQDIESTIVLLFQS

SEQ ID NO: 5805 - protein, 158 aa, Sorghum bicolor
LPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVTVRGAGHLVPVHRPAQAFLLFKQFLKGEPMPAE

SEQ ID NO: 5806 - protein, 434 aa, Trichodesmium erythraeum
MNIASIHSLFKNILYSGAIATTAAISLLAPSLSKPAEANLENSPKVVLDEAWQIVNREYVDGSFNHTDWKATRKSLLEKNYTSQEKAYEALRQALDQLNDPYTRFLDPEQFKALTSQTSGEMSGVGMQLKQEELTKTIVVVDVVENSPAMKGGLLPGDQIQEIDGKSTSDLSVSAAAKLIRGDVGTKVMLGVIRPGDREFEVTLTRARIELQAVRYDLKQEKNQRIGYIRLQEFSAHAGEQMQRAIEKLNNQNPDGYVLDLRGNPGGLLRISIDIARMWMDKGAIVSTVDRDGDRQEVLADRSALTDKPIVVLVDGDSASASEILAGALKDNGRATIIGDQTFGKALVQSVHSLSDGSGLAVTIAHYYTPKGTDISKKGVTPDVVLNLTDSQKRRLYRRPEAIATSSDPYYARAINLLRNEVLLSPLILGEQEN

SEQ ID NO: 5807 - protein, 355 aa, Unknown
  Shewanella sp. MR-7
MTIENTVNSVSNLFDTYKLNDTITLKNRILMAPLTRCMADADLVPTDDMVAYYARRAEAGLIISEATIIRPDGQGYPNTPGIFNQAQIAGWRKVTDAVHANGGKIFVQLWHTGRVAHPHFFGGGDVLAPSAEKVEGSVPRMRELTYVTPKAATLEDIQGLVRDYAKAAENAIEAGFDGVEIHGANGYLIDAFLHHDSNRRTDEYGGTPANMSRFALEVVDAIAARIGKDRTGLRISPGAYFNMAVDNRDRAVFDYLLPELEKRELAFVHIGIFDDSMEFDYLDGRVSSYVRANYGKTLVGVGGYSAQSASEAIAADKFDLIAIGRPFIANPDYVARVRQGHELVTYSDEMLASLV

SEQ ID NO: 5808 - protein, 468 aa, Lactococcus lactis
MTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 5809 - protein, 651 aa, Thermoanaerobacter brockii
MTHFPNLFSEGRIGNLVIRNRIVMPPMATNLANEDGSVSQRLIDYYVARARGGVGLIILENVQVDYPQGKNVACQLRLDDDKYMAGFFELAEAVHSYGAKIFMQIHHAGRQTTPGITEGLQPVAPSPVPCSFLGTQPRELTINEIEEIIQKFVDAAVRAKGAMFDGIELHGAHGYLIGQFMSPRTNRRVDKYGGSFERRMRFPLEIIRRIKEAVGEDYPISFRFSADEFVEGGNTLEEGKQIAKMLEEAGVHVLHVSAGIYESMPTLLEPSRFEQGWRVYLAEEIKKVVNIPVITVGVIREPEFAEKIIAEGRADFVAVGRGLIADPEWPKKAKEGRQNEIRKCISCNIGCIGGRVFQNLRLRCTVNPVAGREGVYSEIKQAPVKKKVVVVGGGPAGMQAAITAAKRGHQVILYEKKQHLGGQLEIASASPGKAKIKWFRDWLEAELSRAGVEVRSGVTADAETIAALSPDYVILATGSEPVTPRIKGAEKENTFVFQAWDVLAGKVSFDKDEEVVVIGGGLVGCETAHYLAEKGAKVTIVEMLSDIAIDMEPISRFDMMQQFTKLGISARTGKVVTEILPRGVAAVGKEGKQDFIRAHKVVLAIGQSPVGNELKKTLEDKGIDVRVIGDAYNVGKIIDAVSSGFQVAWQI

SEQ ID NO: 5810 - protein, 315 aa, Triticum aestivum
  misc_feature (169)..(169): Xaa can be any naturally occurring amino acid
MAAAEVYSPTAAAAAQHQQRGKAATQAWQAVVGWIGFLLQVLLQILRGTPSCAQLLSFVGFRYPLLSSASAAPDQPSPEVAFMPLRSEIPADAAPVPAPPSEPLQRLTVVLDLDETLVSAYESSGLPPIVRTQAVEAGLHCFDMECISTDKDVEGKQKVNHVTVFERPXGLHEFLQKTSEFADLILFTAGLEGYARPLVDIIDAHNRFKLRLYRPSTVTTEYREHVKDLSCLSKDFSRIVIVDNNPFSFIVQPLNGIPCVPFSAGQHSDDQLMEVIFPLLKHLSVQRDVRPALYERFHMPEWFQKHGIPRTDQAL

SEQ ID NO: 5811 - protein, 590 aa, Pseudomonas fluorescens
MCGLAGELRFDQQPADLAAIERITHHLAPRGPDAWGFHAQGPIALGHRRLKIMDLSDGSAQPMIDSQLGLSLAFNGAIYNFPELRAELEALGYAFYSGGDTEVLLKGYHAWGEALLPKLNGMFAFAIWERDAQRLFIARDRLGVKPLYLSRTGQRLRFASALPALLKGGDINPILDPVALNHYLNFHAVVPAPRTLLAGIEKLPPASWMRIEADGTTEQKTWWTLPYGPHADEKNLTLEDWRDRVLDSTREAVAIRQRAAVDVGVLLSGGVDSSMLVGLLREVGVENLSTFSIGFQDAGGERGDEFQYSDLIAKHYGTQHHQLRIDEKEIIEQLPAAFRAMSEPMVSHDCIAFYLLSREVAKHCKVVQSGQGADELFAGYHWYPQVDGAADPYAAYREAFFDRSYDDYAATVQPKWLTANDAAGDFVKEHFAQPGADAAVDKALRLDSTVMLVDDPVKRVDNMTMAWGLEARTPFLDYRLVELSARIPGQFKLPDGGKQVLKEAARRVIPSEVIDRKKGYFPVPGLKHLQGETLSWVRELLLDPSQDRGLFNPAMLDQLLTDPQGQLTPLRGSKLWQLAALNLWLSEQGI

SEQ ID NO: 5812 - protein, 412 aa, Glycine max
LFYLDPEAEVVALSPKTLLATNRFICEICNKGFQRDQNLQLHRRGHNLPWKLKQRSSKDIIRKKVYVCPEPSCVHHEPSRALGDLTGIKKHFCRKHGEKKWKCDKCSKKYAVQSDWKAHSKTCGTREYRCDCGTLFSRRDSFITHRAFCDALAEESARSVTGIVANSTTQPTEAAGVVISSSSLHQDMIHASNNNFPLKKEQQGCIPHWLGQPSPSSASSSFLFSHQDHHLHENPNPRGGPTLLPPPYHQTAPHMSATALLQKAAQMGATMSKTGSMIRTHQQQAHVSANAALNLSSRDHQMNPTPHDLLPFGNNKAVDNGVGVSPSLLHHVINSFSSSPFEGTFEDTFGGGDAMTADEGGGGGAGGNNNEGLTRDFLGLRHLSHTDILNIAGVGNCMNSSQHNQTRNPWQG

SEQ ID NO: 5813 - protein, 240 aa, Oryza sativa
MGRGKIVIRRIDNSTSRQVTFSKRRNGIFKKAKELAILCDAEVGLMIFSSTGRLYEYSSTSMKSVIDRYGKSKDEQQAVANPNSELKFWQREAASLRQQLHNLQENHRQLMGEDLSGLNVKELQSLENQLEISLRSVRTKKDHVLIDEIHELNRKGSLVHQENMELYKKISLIRQENAELYKKIYETEGPSEVNRDSPTPYNFAVIEKTNVPVQLGLSTLPQHSDAEQSTAPKLGLQLNP

SEQ ID NO: 5814 - protein, 276 aa, Mesorhizobium loti
MPELITLNDGAAIPQLGLGVWQVDHGITADVVGWAIKAGYRLIDTAQGYQNEEGVGEAIRAADVARSELYITSKLRNGAHERDAALRAFDDTMEKLGIEQIDLFLIHWPVPSRDKYVEAWKTLIELKQAGRIKSIGVSNFNRDHLERIIGETGVVPVANQIELHPRFQQRELREFHAGHNIQTESWSPLGSGRLLGDPTIAGIAKKHGKSAAQTIIRWHLQQGLIVIPKSVRQDRIAANFDVFDFELDAQDLKTIAGMDSADGRDGPNPATAAFLF

SEQ ID NO: 5815 - protein, 372 aa, Neisseria gonorrhoeae
MEEQLAQNDQPSEKLVRLYGAWAEGGAGVLVTGNVMVAESGKGSINDVLISDDRALEMLKKWAKARTQNDTLLIMQINHAGKQSPAVVNKTPLAPSAVPLVGMNGFINPPRELSADEINGLIQQFVQTAKIAEQAGFSGVQIYAVHGYLISQFLSPHHNRRQDQWGGSLENRMRFLLETYTAIRAAAGKDFLVGVKLNSADFQKGGFDESESVQVVQKLSEMGIDFIEVSGGNYESPQMLAAKDSTRKREAFFIDYAEKARAASQAPLIITGGFRSQTAMEDALSSGHLDLVGIARPFALVPDLANKMQNRTYQTVQADRIQTGVAFVDKKAGAMLEMNWYMTQMDLIGQGKQSNPKIVGVESIAENFAGKR

SEQ ID NO: 5816 - protein, 265 aa, Yarrowia lipolytica
MAMHRVAPDIPLWVGSIYSLSAHISFEKYNINHIISMVRGELPGNQIQGYTHLHVEMDDDEEENIMQYFPETNKFIEDACGEWMTKVAESGKYKNYPENVESVHLEYPHNPDPPGVLVHCMAGISRSSTIVIAYLMKKLGLTAEQGLALVKKGRKIANPNPSFVEQLKIYEQCGYEIDDSKPLYRQWILKKDSEGIPNIGSTPKFKYRSETEGLTSRGQGFSADFRRQIRPKMNQSGAVEDATEATPEQTAPSMKTSLLRCRMCR

SEQ ID NO: 5817 - protein, 250 aa, Neisseria gonorrhoeae
MKITPVKALTDNYIWMIQHGNHAVCVDPSEPSPVLEFLVRNRLMLAQTWVTHPHPDHEGGAAALWRGYMESPVYGESDIEAATHTVTAGTRFTFGNGQVTVWATPGHTDRHTSYLLETSDGIHVFCGDTLFSAGCGRVFTGTVEQLYDNFQRFNQLPEGTLFYPAHEYTAANLRFAAHIEPDNADIQTALKAAEHTPTLPVTLAHERRVNPFLRTEIPAVRQRAEALVGKTLNSGLEVFAALRELKNAYR

SEQ ID NO: 5818 - protein, 399 aa, Clostridium tetani
MNKKKWIGWTIAIVLLTNTLTYIGSNIIPLAMPNGNVVVRKEDYNNLVQFNKLFQIKDLIHERYDGEINEKDLEEGAIKGLANSLKDPYTVFMTKKEYDDFNTQTEGNYSGVGIQLQAKDNKIVIVDIFEESPARKAGILPKDEIEKVNDIPVDGSQLEKAVSLMKGVEGSEVKLTLFRKDKGNFDVNLKRSKINLKTVAGQMLDEDVALVQVTMFDENTAKNFKSELDKLKSQGMKGLVLDLRGNPGGVLDECVDMVSNFVPKGKTIVSTMDKYKSERKYKSKGGNYVGLPLVVLTNEGSASASEIFAGAIRDYKIGTLVGEKTFGKGLVQTLYETGEGTALKITISKYYTPNGENINKIGIKPDVEVKYPEELLKKPYNRNEDPQFKKALEVVKEKI

SEQ ID NO: 5819 - protein, 448 aa, Francisella tularensis
MALHGKKDTIDNLDFFEQSLPKFKLPLNSQDPLEVYQEIKDELMLDGNSKQNLATFCQTEVDDFIHKLMDDCIDKNMIDKDEYPQTAEIESRCVNILANLWNSSAENAIGCSTTGSSEAAMLGGMAMKWRWRDKMKAQGKDYTKPNLVTGPVQVCWHKFARYWDIELREIPMSNESLIMTPEAVLERCDENTIGVVPTLGVTFTGQYEPVEQVCKALDDFERQTGVDIPVHVDAASGGFLAPFVEPELKWDFRLPRVKSINSSGHKFGLSPLGVGWVIWADKKYLPDDLIFNVNYLGGNMPAFALNFSRLGGQIVAQYYNFVRLGFEGYKKVHQLCYDVAEYIAKELRKMEIFEIIHAGEGGIPAVSWSLKATKEYSLFDISEKVRAKGWQIAAYTMPNNREDLVVMRVLVRRGFSYDLAQLMIRDLVAVIDSLEGKLKILKRSSFAH

SEQ ID NO: 5820 - protein, 493 aa, Unknown
  Shewanella sp. MR-7
MSDNQPQAAKHALMWFRQDLRLTDNQALTAACDWVRQAPGAKLRAIYIATPSQWLSHDMAPIQIDFIQRHVNLLAQGLASLGIEFELIQLDSFKEVPAFLASYCEKLGVERVFAGREPEINEQKRDQACLDAGIPLVLSDEHCLLPPGTVLNLSGDMYKVFTPFSRKWREVAAKRAILPLAVPAPLGPMLPEPKPISFKERFPFTSKLTSSEQWAAGEGQAKRILTAFIQQKAQDYKQDRDFPALEGTSVISPYLALGVLSPRQCIAALLGRFPEVIVDDTSPGRTWLNELIWREFYRHLLVAFPDLSKGHNFNRQADHVQWRNNQAEFLAWCEGKTGYPIVDAAMRQLNQTGWMHNRLRMVVASFLTKHLLIDWRWGERYFRQHLIDGDLAANNGGWQWSAGCGCDAQPYFRIFNPISQSEKFDPDGSFIRKYLPELASWGIKRLHQPNMQKTPSLFEVQMLESDSAYPCAIVEHNAARARALAVLGVLKKA

SEQ ID NO: 5821 - protein, 338 aa, Kluyveromyces lactis
MFKERLLNILKHIRPMSTETTAKYYPKIVESAQADQSLKLNHTCFRVKDPKVTVAFYQEQFGMKLLDHKKFPDMKFDLYFLSFPNKQFSNNSQGAIDVFRENGILELTHNYGTESDPAYKVNNGNEEPHRGFGHICFSVSNLEAECERLESNGVKFKKRLTDGSQRNIAFALDPNGYWIELIQNNESGEGNNYKFNHTMVRVKDPIKSLEFYQNVLGMKILDVSDHSNAKFTLYFLGYENDQKGIARGSRESILELTHNWGTENDPDFAYHTGNTEPQGYGHICISNKDPATLCAEIEKLYPDIQWSPKFNQGKMKNLAFIKDPDGYSIEVVPYGLGV

SEQ ID NO: 5822 - protein, 567 aa, Aspergillus nidulans
MRQKRKLSNGADERYHPNAQQTADFGIVLRDFYPPEMSNARCEAYNSGILERPIESWQKAYTETSAQQNAMTANAAVVHWFKSDLRLHDNRALQMAYRVAREHKIPLIGLYILSPEDLTAHLSSPARVDLTLRTLEQLKRDLGELDVPLYMETQACRKDIPRRIINLCQEWGANHLFANLEYEVDELRREAKLIRLCAENGIRFETAHDMCVVPPGVLSSQQGRQYAVYSPWFRSWLAFLNENPEYLEVSEDPTSNPGDARRYFKELFECPVPATPENKRFDDVEKADRVRRAFPAGEHEGLRRLEEFLEKATAYDDERNFLSGETTSKLSPYFASGSLSARTAVAKAREANAGKISRGEAGYISWISEVAWRDFYKHVLVHWPFICMNKCFKFEFTNIDWSYNNTHFEAWAAGKTGYPLVDAAMRQLHATAWMHNRCRMVVSSFLCKDLLIDWRRGERYFMEHLIDGDFASNHGGWGFGSSTGVDPQPYFRIFNPIRQSERFDPDGEFIRRWVPELRGVEGNAIHAPYERGAGDIARANGYPEPIVDHARQRGVALRKYKDAARGA

SEQ ID NO: 5823 - protein, 363 aa, Methanothermobacter thermautotrophicus
MTYTSGRILGSMCTSSHPLARRVYCDFLESNLGDPGLFRGTRELESGVIGMLGELLSEPDAAGHIITGGTEANLMAMRAARNMAGAEKPEIIVPKSAHFSFRKAADILGLRLREAELDQDYRVDVESVRKLISENTVAVVGVAGTTELGRIDPVEELSEICLDEDIHLHIDAAFGGFIIPFLRETGAELPEFDFKLQGVSSITVDPHKMGLAPIPSGCILFRDASYLDAMSIETPYLTEKQQSTIVGTRTGASAAATWAIMKHMGREGYRKLALRVMGVTRRLRDGLVELDYQLVVEPELNIVAFNHPAMGPHELADRLEELGWAVSVSSCPPAIRVVLMPHIMEEHIELLLRDLEGIRLREE

SEQ ID NO: 5824 - protein, 376 aa, Lycopersicon esculentum
MENKVVEEKQVDKIPLMSPCKMGKFELCHRVVLAPLTRQRSYGYIPQPHAILHYSQRSTNGGLLIGEATVISETGIGYKDVPGIWTKEQVEAWKPIVDAVHAKGGIFFCQIWHVGRVSNKDFQPNGEDPISCTDRGLTPQIRSNGIDIAHFTRPRRLTTDEIPQIVNEFRVAARNAIEAGFDGVEIHGAHGYLIDQFMKDQVNDRSDKYGGSLENRCRFALEIVEAVANEIGSDRVGIRISPFAHYNEAGDTNPTALGLYMVESLNKYDLAYCHVVEPRMKTAWEKIECTESLVPMRKAYKGTFIVAGGYDREDGNRALIEDRADLVAYGRLFISNPDLPKRFELNAPLNKYNRDTFYTSDPIVGYTDYPFLETMT

SEQ ID NO: 5825 - protein, 740 aa, Catharanthus roseus
MESCNCIEPQWPADELLMRYQYISDFFIALAYFSIPLELIYFVKKSAVFPYRWVLVQFGAFIVLCGATHLINLWTFTMHSRTVAVVMTTAKVLTAVVSCATALMLVHIIPDSLSVKTRELFLKNKAAELDREMGLIRTQEETGRHVRMLTHEIRSTLDRHTILKTTLAELSRTLALEECALWMPTRSGVELQLSYTLRLPNPVGFTVPILLPVINQVFSTNRAVKISPNSPVARLRPTGKYMPGEVVAVRVPLLHLSNFQINDWPELSTKRYALMVLMLPSDSARQRHVHELELVEVVADQVAVALSHAAILEESMRARDLLMDQNVALDLARREAETAIRARNDFLAVMNHEMRTPTHAIIALSSLLQETELTPEQRLMVETILKSSNLLATLINDVLDLSRLEDGSLQLDIATFNLHSLFREVLNLIKPITSVKRLFATLSLAPDIPEYAISDEKRLMQIMLNVVGNAVKFTKEGGISITAFVAKSDSLRDPRAPEFFPVPSDSHFYLRVQVKDSGSGINPQDIPQLFTKFAQSQTLATRNSGGGGLGLAICKRFVNLMEGQIWLESDGLGKGCTAIFMIKLGIPGRSSEAKLPLVSRVPADHVQTTFPGLKVLLMDDNGVSRMVTKGLLLQLGCEVTTVSAGDECLRVISNEHRVAFMDVSIPGKDIYEVAVRIHEKFSKRLDRPLIIALTANADRVMKENCLRVGMDGVVQKPISVDKMRSVLSELLDHGVLLEAQ

SEQ ID NO: 5826 - protein, 157 aa, Arabidopsis thaliana
MSLIPSFFGNNRRSNSIFDPFSLDVWDPFKELQFPSSLSGETSAITNARVDWKETAEAHVFKADLPGMKKEEVKVEIEDDSVLKISGERHVEKEEKQDTWHRVERSSGQFSRKFKLPENVKMDQVKASMENGVLTVTVPKVEEAKKKAQVKSIDISG

SEQ ID NO: 5827 - protein, 1406 aa, Unknown
  Frankia sp. CcI3
MSPAYDPQPSARHDLDAPGGDATATIVPHASLPVDDTRASRAAADELIADLLHGLTRLCEGDFSTRLAARDGYAGDVVRKFDELAAIQERHARELARVSKVIRRDGRLTLRMEDLGNPGGWSDMTQAVNSLIDDLARPTHEVARVIAAVAEGDLSQHMALEIAGQPVRGEFLRIGTTVNTMVDQLSSFADEVTRVAREVGTEGNLGGQAKVKGVSGVWRDLTESVNSMAGNLTSQVRNIAQVTTAVAQGDLSQKITVDARGEIHELKSTVNTMVDQLSAFADEVTRMAKEVGTEGKLGGQAQVKGVSGVWRDLTDSVNVMAGNLTTQVRSIAEVAAAVARGDLTRQITVDARGEVAGLAHTLNTMVDQLSSFADEVTRVAWEVGTEGNLGGQAHVRAVSGVWRDLTESVNSMAGNLTSQVRNIALVATAVARGDLSQKITVAAQGEILELKDTLNTMVDQLSSFADEVTRVAREVGTEGNLGGQAHVRGVSGVWRDLTESVNSMAGNLTSQVRNIALVTTAVARGDLSQKITVTAQGEIAELKDTVNTMVDQLSSFAAEITRVGREVGVEGKLGGQATVAGVAGTWKDLTDNVNQLASTLTIQLRAIGDVSTAVTRGDLTRSISVEAEGEVAELKDNINQMIARLRETTEVNAQQDWLKSNLARIGSKMQGQRDLYAVCQMIISEMTPAVNAQQGTVYLLDFIEGDKLRYVAGYGSVPRRRSDGTFLFGEGLIGQAALERDRIRVEHVPAGYLNIRSGLGEAPPCDLVVVPVVFENQVLGVIELASFSPFSELHLTLVDQLVDTIGVVLNTIMANARTEELLAQSQRLTQELRSQSVELQRTNNELEEKAALLEEKNHEIELARIGLEEKAEQLALSSQYKSEFLANMSHELRTPLNSLLILAKLLADNPDRNLSRKQIDFAETIHSAGSELLELINDILDLSKVEAGKMNVDATTVRTAALCDAVAGVFGPVAEEKGLSFQVNLAPDVPAEFVTDEQRLQQVLKNLLSNAVKFTDTGTVRLDVTVARPDLPFLSPSLCSAGTVLSFAVTDTGIGVAVEKLRMIFEAFQQADGTTSRRYGGTGLGLSISKEIARLLGGAIAVSSVVGRGSTFTLYLPSAPPAQTPPFGVTPGEPDNVLMIVDPSGQYLGRRSGEGVDAEPGGGPAPSAGRDAGPANGWQNPDADRFGTAALAPSSPSSSSSLSPTRSGPGAGGTAGHGDAGGIGGAHWSAAASGPAEGSAAFTSGWRPSEPVTVGTPFLTESTESTESASRPLTEGSEGSDPLVGTTVLVVDDDVRNVFALTSALEMYGMRVLYADNGHDAIRMLQQDTPPVHLVLMDVMLPGMDGNETTSMIRDMPAFADLPILVLTAKAMPGDREKSITAGATDYITKPVDLEHLLGVMRSYLY

SEQ ID NO: 5828 - protein, 1124 aa, Lathyrus sativus
MSTTRPSQSSNNSGRSRNSARIIAQTTVDAKLHATFEESGSSFDYSSWVRVSGSVDGDQQPRSNKVTTAYLNHIQRGKQIQPFGCLLALDEKTCKVVAYSENAPEMLTMVSHAVPSVGDHPALGIGTDIRTVFTAPSASALQKALGFAEVSLLNPILVHCKTSGKPFYAIIHRVTGSLIIDFEPVKPYEVPMTAAGALQSYKLAAKAITRLQSLASGSMERLCDTMVQEVFELTGYDRVMAYKFHEDDHGEVIAEIAKPGLEPYLGLHYPATDIPQAARFLFMKNKVRMIVDCNAKHVKVLQDEKLPFDLTLCGSTLRAPHSCHLQYMANMDSIASLVMAVVVNDSDEDGDSADAVLPQKKKRLWGLVVCHNTTPRFVPFPLRYACEFLAQVFAIHVNKEIELEYQILEKNILRTQTLLCDMLMRDAPLGIVSQSPNIMDLVKCDGAALFYRNKLWLLGATPTEYQIREIALWMSEYHTDSTGLSTDSLLDAGFPGALSLSDTVCGMAAVRITSKDIVFWFRSHTAAEIRWGGAKHEPGEQDDGRKMHPRSSFKAFLEVVKARSVPWKDFEMDAIHSLQLILRNASKDTDIIDLNTKAINTRLNDLKIEGMQELEAVTSEMVRLIETATVPILAVDVDGTVNGWNIKIAELTGLPVGEAIGKHLLTLVEDSSTDIVKKMLNLALQGEEEKNVQFEIKTHGDQVEFGPISLIVNACASRDLRENVVGVCFVAQDITAQKTVMDKFTRIEGDYKAIVQNPNQLIPPIFGTDEFGWCCEWNAAMIKLTGWKREEVMDKMLLGEVFGTQMSCCRLKNQEAFVNFGIVLNKAMTGLETEKVAFGFFSRKGKYVECLLSVSKKIDAEGLVTGVFCFLQLASPELQQALHIQRLSEQTALKRLKVLTYMKRQIRNPLAGIVFSSKMLEGTDLETEQKQIVNTSSQCQRQLSKILDDSDLDGIIDGYLDLEMAEFTLHEVLVTSLSQVMNRSNTKGIRIANDVAEHIAKESLYGDSLRLQQVLADFLLISINSTPNGGQVVIASSLTKEQLGKSVHLVNLELSITHGGSGVPEAALNQMFGNNVLESEEGISLHISRKLLKLMNGDVRYLKEAGKSSFILSVELAAAHKLKG

SEQ ID NO: 5829 - protein, 352 aa, Staphylococcus xylosus
YSTNDITQYTSASIFSEVGKQTEMFARFSTVAGERGAADAERDIRGFALKFYTDEGNWDLVGNNTPVFFFRDPKLFASLNHAVKRDPRTNMRSAQNNWDFWTSLPEALHQVTILMSDRGIPKGFRNMHGFGSHTYSMYNDKGERVWVKFHHRTQQGIENLQPDEAAKIIADDRESSQRDLFEAIENKDYPKWKTYIQVMTEEQARNHKDNPFDLTKVWYKGDYPLIEVGEWELNRNPDNYFQDVEQAAFAPTNIVPGLDFSPDKMLQGRLFSYGDAQRYRLGVNHWQIPVNQPKGVGVENICPFSRDGQMRILDNNQGGGTHYYPNSDGSFEDQPEFKKPGLKVEGEAYEYD

SEQ ID NO: 5830 - protein, 697 aa, Desulfovibrio vulgaris
MCGIAGIVSPGAPVASATLAAMTESLAHRGPDACGLFIRPSGAGSPHVGLGHRRLSILDLSDAGAQPMQSEDGAFTLVFNGEIYNYPDLRRDLEAAGHIFRSTSDTEAILRGYMAWGEGVVARLKGMFAFALWDERKRSLLLARDRFGKKPLHYAVTRQGTLLFASEPKALLAHPEFRPEPDAASLLHFLRYDYVPAPRSIYAGAAKLPPSHLMVWRDGRLEVRRYASLAFSGATGDRGVPLREAEAAVDALLDAAVQRRLASDVPLGVFLSGGLDSSTVLAYMTRHIPAHDIRTFAIGFDEASYDESAHAEAMARHAGSHHTMMRLPAARMLDLLDMVWTTQDEPMADASIIPTLLLCRFAREHITVALGGDGGDELFAGYDPVLADLPARCLDWLPPAALRLLQGIALRLPTGDANMSLGFKVQRFLSGLGAREVAARHQTWLGAFDDEGARAMLHPDLRAATRDVSPLDALDMLREECRDASRFDAMLHFYQRFYMCGSILTKVDSASMAVSLEVRSPFLDQDLADYVNRLPREHKLRGLTRKVLLRRLMRSRMPDALLKRPKKGFGLPLARWFRHELRPLVTAMLDPGRVAQGGLLDPVTVERMVRDHLSGRRDHRKEIWSALCVEAWRERYLHHSRATASDTIEFGTTPHGDGHLITAQAVPARSSAAINDSTNDSPSWAASPSRHRCNDSI

SEQ ID NO: 5831 - protein, 354 aa, Staphylococcus xylosus
VTNDITQYTSASIFSEVGKQTEMFARFSTVAGERGAADAERDIRGFALKFYTDEGNWDLVGNNTPVFFFRDPKLFASLNHAVKRDPRTNMRSAQNNWDFWTSLPEALHQVTILMSDRGIPKGFRNMHGFGSHTYSMYNDKGERVWVKFHHRTQQGIENLQPDEAAKIIADDRESSQRDLFEAIENKDYPKWKTYIQVMTEEQARNHKDNPFDLTKVWYKGDYPLIEVGEWELNRNPDNYFQDVEQAAFAPTNIVPGLDFSPDKMLQGRLFSYGDAQRYRLGVNHWQIPVNQPKGVGVENICPFSRDGQMRILDNNQGGGTHYYPNSDGSFEDQPEFKKPGLKVEGEAYEYDSDL

SEQ ID NO: 5832 - protein, 360 aa, Dechloromonas aromatica
MTTLFDPIQMGDIALANRIVMAPLTRNRAIEGNKPGPLTVEYYRQRATAGLIVAEASPISPTAQGYLDTPGIWSAEQVVAWQAVTKAVHAEGGKIVLQLWHVGRISHISLLPAGEVPVSSTDKVADASTFTSEGFIPVSKPRALHDDEIPALIEDYRKAARNAIAAGFDGVEIHAANTYLIEQFLRDSVNDRSGPYGGSIENRTRLLLEVTRAVAGEIGAGRTGIRLSPMTTFTAPLDSNPQALYGYVVEQLAPLGLAYLHVIEGETGGTRTPEGKPFDYAALHRAYPGVWMLNNGYDRDLALQTVADGKADLIAFGRPFISTPDLVRRLRDGAPLNELRADKLYGGGAEGYTDYPTLAG

SEQ ID NO: 5833 - protein, 277 aa, Bacillus cereus
MILTNLKDYTTLHNGVKMPWFGLGVFKVEDGSEVIDSVKAAIKNGYRSIDTAAIYQNEEGVGQAIRESGVSREELFITSKVWNSDQGYETTLQAFETTLEKLGLEYLDLYLVHWPVKGKYTESWKALETLYKDGRVRAIGVSNFHIHHLQDVFEIAEIKPMVNQVEYHPRLAQEELHAFCKEHNIQLEAWSPLMQGQLLDNPTLQEIATKYNKSTAQIILRWDLQNEVVTIPKSIKEHRIIENANIFDFELSADDMKAIQALNEDRRVGPDPDNFNF

SEQ ID NO: 5834 - protein, 348 aa, Ustilago maydis
MGAEDYSPPATDIITLTRHVLTEGFKLRTESAASGDLTILLSSLQTTCKFIESNVRKASLINLIGAAGNTNVQGEDQKKLDVLSNEIMINALRASGKTAVLVSEEDDEAIFVGEKEEGGTFESTKGKYCVVFDPLDGSSNIDAGVNIGTIFGIYLVKEGSKGTLEDVLRPGREMVAAGYCMYGSSANLVLTTGNGVNGYTLDNQIGEFILTHPNIRLPSRGKIYSVNEGNSMYYYEPVLKYLDSIKYPKGEGAKPYSARYIGSMVADVHRTLLYGGIFIYASDKKSKDGKLRMLYEAFPMAFITEQAGGLATTGTQRILDIQPTSIHQRCPVFLGSKDDVEDLMKCFQ

SEQ ID NO: 5835 - protein, 449 aa, Triticum aestivum
MYRAKRAALSPKVKRRVGKYELGRTIGEGTFAKVRFAKNTETMEPVAIKILDKEKVQKLRLVEQIRREICTMKLIKHPNVVRLHEVMGSKARIFIVLEYITGGELFDTIYTNGRLKEEEARKYFQQLINAVDYCHSRGVYHRDLKLENLLLDAAGNLKVSDFGLSALTEQVKADGLLHTTCGTPNYVAPEVIEDRGYDGAAADIWSCGVILFILLAGFLPFEDENIIALYKKISEAQFTCPSWFSTGAKKLITRILDPNPATRITIPQILEDPWFKKGFKPPVFDDKYETSFDDVYAAFGDSEDQHVKEETEHKPTSMNAFELISLNQGLNLDNLFEAKEEHKRETRFTSQCPPKEIISKIAEAARPLGFDIQKKNYKMRMENPKAGRKGNLNVATEVFQVAPSLHVVELKKAKGDTLEFQMFYRSLSTQLKDVVWKCGGEVEDNGTAA

SEQ ID NO: 5836 - protein, 622 aa, Ralstonia solanacearum
MTDTTSAPPVRHAHDLPFGAACLGPDRTRFRLWAPDAVEAWVDIDQGEAVRMAPEPGGWHAATVPVGAGTCYRYRVTNREGITLTVPDPAARAQWQDVHGPSLVVDPLRYAWQHPGWMGRPWHETVLYELHVGALGGFDGVRARLPELARLGITAIELMPVAEFPGARNWGYDGVLPFAPEAGYGPPDALKALIDSAHGLGLMVFLDVVYNHFGPEGNYLHHYARRVFRDDVHTPWGAAIDFRQPEVRAFFLHNALMWLMEYRFDGLRLDAVHAIGARDWLEELAARVRQAVEPGRHVHLVLENEHNTASLLRGAPPGTLGTGAFEAQWNDDGHNALHVLLTGEHEAYYAAYADAPAQRLARVLQDGFCYQGEPSVIHDGAPRGEPSGWLPPTAFVLFLQNHDQIGNRAFGERLTRLAHPDALRAAQALLLLSPQIPLLFMGEEWGCLRPFLYFTSHHGALAEAVREGRRREFARFAAFADPHQRERIPDPNDERTFLDSQPGSTDPTLPEQLDWLNRTQGLLALRHARIVPRLPGTRALDAVPLGATGALARWRLGDGSVLTLAINLGTQPVAVPTALAGNPADLLHESRDGVAAALAAHRVPPRACIALLHAASPPDLQR

SEQ ID NO: 5837 - protein, 775 aa, Ralstonia solanacearum
MTSVHDFATATRPATPSAAAQEPAPALPPGLDRNTLDALTHGRLGDPFAVLGPHRLETAEGERPHRVVRAFHPGARRVQAIDPRGQVMAELAPVGRTGLFHGRLPDDAPDADGHPGAYRLRVVWPAGAGHEAVQEAEDPYAFGLLLGDLDLHLIAEGRHWELARCLGAQAMRQDDVAGVRFAVWAPNARRVSVVGDFNQWDGRRHPMRLRHGTGVWELFVPAGLGAGPGSRYKFELVGADGHLLVKADPVARRTEAPPATASVVADPLPFRWSDAAWMETRAARQRPDAPIAIYEVHAGSWLRDVEDGGRSLDWDALGERLIPYVAGLGFTHVELLPVAEHPFGGSWGYQPLGLFAPSARFGPPEAFARFVERCHQAALGVIVDWVPAHFPSDPHGLARFDGTALYEHADPREGFHQDWNTLIYNFGRHEVRGFLIASALEWLEHFHIDGLRVDAVASMLYRDYSRPADAWVPNRYGGRENLEAVAFLQQMNAVVHARCPGAITIAEESTAWPGVTAAVEFNGLGFDYKWNMGWMHDTLHYMQRDPIYRQHHHDGLTFGLVYAFSERFILPLSHDEVVHGKGSLLGKMPGDDWQRLANLRAYLAFMWTHPGKKLLFMGGEFGQLGEWNHDAAPEWHLLDDPRHRGVQRLVHDLNALYRSEPALHARDCAPEGFSWVIGDDRANSVFAYLRLDTAGTPMLIVANMTPVPRDGYRIGVPDVDGAVRWREMLNTDSAVYGGTNLGNGGVVDVEDVESHGWRRSVVVRLPPLAVVVLKV

SEQ ID NO: 5838 - protein, 240 aa, Triticum aestivum
  misc_feature (168)..(168): Xaa can be any naturally occurring amino acid
  misc_feature (184)..(184): Xaa can be any naturally occurring amino acid
  misc_feature (194)..(194): Xaa can be any naturally occurring amino acid
  misc_feature (204)..(204): Xaa can be any naturally occurring amino acid
HGNGFRVLFELIWRDYFRFLSAKYGNSIFHLGGPRKVASKWSQDEALFESWKDGRTGYPLIDANMKELLATGFMSNRGRQIVCSFLVRDMGIDWRMGAEWFETCLLDYDPASNYGNWTYGAAGPLTGVGNDPREDRYFSIPKQAKTYDPDGKYVAYWLPELRSLAKEXRRNFPGASYIKQVVPXLKFDGGLQKXDPQFHRQTRXPKNIYRRTKMDGRWWIKYHHPFKEARGEFKANGYRQ

SEQ ID NO: 5839 - protein, 607 aa, Bacillus cereus
MCGITGWVDWKEDLSNQHVILEKMANRIQHRGPDAEGFWFSPRAAFAHRRLIVIDPEGGTQPKTFRAGDYTYALTYNGEIYNFRELREQLRKCGHAFETHSDTEVLLHAYLEWKEDCVQHLNGIFAFALWDDQKQQLFLARDHLGVKPLFYTERNDSIIFGSEIKALLAHPSVPAEIDADGINEIFGLGLFRTPGCGVFKHIQEVRAGHSITFTRDKKVVQKYWNLESKVHTDSIEDTSSHILSILQDTVKRQLIADVPLVCMLSGGLDSSGITALAGKEFAAENKTLHTYSVDFVNSAKDFELTFARTGLDAPWVKRVSEHVGTSHHDIIVNAEELANHLFVPLHAKDLPSAGEMETSLYLLFCEMKKDATVALSGESADEVFGGYPWFHQEELLYVDKFPWLTNWKNTSPLLLNEVSNQCNLENYIDTRFQEAILEVPTLEGESKKSAKQRQMFYLFLTRFLPFLLDRKDRMSMAVGFEVRVPFCDYRLVEYLWNVPFNIKSIDNIEKGILRRALKPALPDDIRNRRKSAYPTSQDPHYLQTIRHLSLDMCSNKNNPIFSLINHSTLLAIANQSNKEINNFEARSAMEYMLQVNEWLKTYHIHIA

SEQ ID NO: 5840 - protein, 550 aa, Ehrlichia chaffeensis
MANVVVTGEQLDKSIREVVRILEDAVGCTAGPKGLTVAIGKSYGAPEVTKDGYKVIKSIKPEDPLALAIANIITQSASQCNDKVGDGTTTCSILTAKVIEEVSKAKAAGADIVCIKEGVLKAKEAVLEALMSMKREVLSEEEIAQVATISANGDKNIGSKIAQCVQEVGKDGVITVEESKGFKELDVEKTDGMQFDRGYLSPYFVTNSEKMLVEFENPYILLTEKKLNIIQPILPILENVARSGRPLLIIAEDVEGEALSTLVLNKLRGGLHVAAVKAPGFGDRRKDMLGDIAILTGAKHVISDDLAIKMEDLTLAELGTAKNIRITKDTTTIIGSVDNSSANVQSRINQIKMQIEASTSDYDKEKLRERLAKLSGGVAVLKVGGSSEVEVKERKDRVEDALHATRAAVEEGVVPGGGAALLYTLSVLENLKSKNDDEQLGINIVKRALQAPIKRIIKNSGSENAPCVIAHLLKQNDKELIFNVDTMNFANAFTSGVIDPLKVVRIAFDFAVSLAAVFMTLNAIVVDVPSKDDANAGAGGMGGMGGMGGF

SEQ ID NO: 5841 - protein, 505 aa, Staphylococcus aureus
MSRQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAERDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKFHFRTQQGIENLTDEVAAEIIATDRDSSQRDLFEAIEKGDYPKWTMYIQVMTEEQAKNHKDNPFDLTKVWYHDEYPLIEVGEFELNRNPDNYFMDVEQAAFAPTNIIPGLDFSPDKMLQGRLFSYGDAQRYRLGVNHWQIPVNQPKGVGIENICPFSRDGQMRVVDNNQGGGTHYYPNNHGKFDSQPEYKKPPFPTDGYGYEYNQRQDDDNYFEQPGKLFRLQSEDAKERIFTNTANAMEGVTDDVKRRHIRHCYKADPEYGKGVAKALGIDINSIDLETENDETYENFEK

SEQ ID NO: 5842 - protein, 545 aa, Campylobacter coli
MAKEIIFSDEARNKLYEGVKKLNDAVKVTMGPRGRNVLIQKSFGAPSITKDGVSVAKEVELKDSLENMGASLVREVASKTADQAGDGTTTATVLAHAIFKEGLRNITAGANPIEVKRGMDKACEAIVAELKKLSREVKDKKEIAQVATISANSDEKIGNLIADAMEKVGKDGVITVEEAKSINDELNVVEGMQFDRGYLSPYFITNAEKMTVELSNPYILLFDKKIANLKDLLPVLEQIQKTGKPLLIIAEDIEGEALATLVVNKLRGVLNISAVKAPGFGDRRKAMLEDIAILTGGEVISEELGRTLESATIQDLGQASSVIIDKDNTTIVNGAGEKANIDARVNQIKAQIAETSSDYDREKLQERLAKLSGGVAVIKVGAATETEMKEKKDRVDDALSATKAAVEEGIVIGGGAALIKAKAKINLDLKGDEAIGAAIVERALRAPLRQIAENAGFDAGVVVNSVENAKDENTGFDAAKGEYVNMLESGIIDPVKVERVALLNAVSVASMLLTTEATISEIKEDKPAMPDMSGMGGMGGMGGMM

SEQ ID NO: 5843 - protein, 387 aa, Streptomyces coelicolor
MHVPSTAPPPATAAPLFGPFTVGSLALENRIVMAPMTRELSPGGVPGPEVAAYYARRARNGVGLIITEGAAIGHPSSERRAAVPRIHSADALAGWTRVTQAVHAAGGRIAAQLMHVGLDPLLWGMTPAEMDAASPAGFELLSPSGVDPSQPAAATVGREMSDVDISSVIEAYARAAAEARQAGFDAIELHAAHGYLIDQFFWAVTNRRKDRYGGDLSARTRFGADVVRACRHAVGEDFPIFLRFSQWKVGHYAARLADSPDELAAVLGPLVQAGVDAFHCSTRRFWQPEFEGSDLNLAGWTKKVTGRPVIAVGSVGLKDSDFLSYLDGKGADVGDVSVVADRLAQGEFDLVAVGRALIADPAWPAKVRGGRSADLIPFDARMLTSLH

SEQ ID NO: 5844 - protein, 866 aa, Idiomarina loihiensis
MNSFWTFLQLIFVILQVTSLALYALLPAPWSDTVLVAMILFSLIIGIVIWWWSRRNALTAPFRQPFLSSDSLQLFEQVFNDLPTRVYWRDPELKLLGGNRAFANDFGIDPESLAGKTDAEIDSLASNDVLLERDRKTFSQQAPSVNAEIELKVSGKSQWVEHSSVPLYDDDHNIIGILGSYYDISGIKSVAEEMEKAKETAERANQSKGEFLANMSHEIRTPINAIVGMANLCLKTELTQKQKRYIKVIDSSSQALLGVINDILDFSKIDAGKLTVERIPFDLQDVLTSLADMFAYRAYDKDLEFIINLPANIPTRLIGDPLRLNQVLVNLISNAIKFTEDGEINVAVNLLDSSRDNVLLRISVTDTGIGMDEEQRANLFKAFTQADTSTTRKYGGTGLGLAISRRLILLMGGDIGVTSAAGQGSTFYIEVELPLQTEQDNSHHQYLLQKLKGVRILAIDDNLSTREMLYEMLRSYQVDVKVCRTAEQALQVFQLSVEDNNPYQLVLVDWRLPGMDGLEFCQKITERYAEDIRPKMTLATGYYAEELSEKAKQAGVNDIISKPFTASTLGRSLTSTLFQRELSDADDADSGDGIPESILRAPILVVEDNEINQQVAREILSSHKFKVDIVENGQLAVEAVHNKNYSLVLMDIQMPVMDGLKAAQTIRADFNYQQLPILAMTANAMSGDEERSLAAGMQGHIAKPIDEQQLIKAIIKWAVPGDYTNNQQPEVPPESKQDEVNKPPVRIPQVKGIEFETALKRLQYNVELYLKLVEQLYETYQGSATKVSDFITRGQHESARRYFHSLKGAAANLGFTQLQSKAADLEQFMAEGNIDKVADQITELEKRLRYAHQAAVDLEAIQQHQS

SEQ ID NO: 5845 - protein, 470 aa, Streptomyces avermitilis
MPLHKGPVKSDERPMSFNPFFGEANPVSGMTEAPPKHRLADGPLPPSTAYQLVHDELMLDGNARLNLATFVTTWMEPQAGVLMAECQDKNMIDKDEYPRTAELEKRCVAMLADLWNAPDAGAAVGCSTTGSSEACMLAGLALKRRWARRNADRYPARDVRPNLVMGINVQVCWEKFCNFWEVEMRQVPLEGERYHLDPGAAAELCDENTIGVVGILGSTFDGSYEPIAELCAALDALQERTGLDIPVHVDGASGAMIAPFLDEDLVWDFRLPRVASINTSGHKYGLVSPGVGWALWRDSEALPEELVFRVNYLGGNMPTFALNFSRPGAQVVAQYYTFLRLGREGFRAVQQTTRNVARSLAERVAALGDFHLLTRGDELPVFAFTTAPEVASYDVFDVSRRMREHGWLVPAYTFPPNREDLSVLRVVCRNGFSTDLAELFVEDLSRLLPDLRRQARPQTHDKDAATGFHH

SEQ ID NO: 5846 - protein, 285 aa, Glycine max
  misc_feature (69)..(70): Xaa can be any naturally occurring amino acid
  misc_feature (161)..(161): Xaa can be any naturally occurring amino acid
MPPKPLDYGSINENVKKSQYAVRGELYLRASELQKEGKKIIFTNVGNPHALGQKPLSFRSPGLLLCAKXXFLLDDPNVGLLFPADAIARAKHYLSLTSGGLGAYSDSRGLPGVRKEVAEFILRRDGYPTDPELIYLTDGASKGVMQILNTIIRGQDDGVIXFFLVSTAVFYIQCPLKELPTTSYCQILVPVPQYPLYSATIALLGGTLVPYYLEETANWGLDVNELRQSVEQARFKGITVCVLSLQCYVSTLFLHQTHKTKHLHVWKMLNQCEGSESCHIESICC

SEQ ID NO: 5847 - protein, 676 aa, Magnetospirillum magnetotacticum
MVPQCHYEVAMPHRHLLSPITLRAIHLPNRMIMGSMHLGFEGLPDAWPRLAAFYAERARGGIGLIVTGGVAPNEQGNFGPDGTVLTSEAELPGHQLITQAVHREGGRIIMQILHCGRYSRMKDIVAPSAIRAPINSATPRELTDAEIVQTVADYANCARLALLAGYDGVEVMASEGYLINEFLAPRTNKRTDRWGGDLHGRMRFLVEIVRAVRQALGEAKMMSVRLSMVDLVEDGLSADEVVAVAQAIEIEGCDLINSGIGWHEARVPTIAHTVPQGVWSWATARVKAAVKIPVAASNRIKTPDLAESLIAEGQCDLVSMARPLLADPAFAAKVARGEASTINACIGCNQGCLDPIFSGGAATCLVNPRAGREGEFMARPPCETKRIAVVGGGPAGLACALEAAKRGHAVTLFDAAPQLGGQFILAQTVPGKEEYAATPAYYAQALTQAGVTLRLGRAAAASDLTGFERIVLATGIRPRKLDLPGADHPKVVGYEDILSGAKRAGARVAIMGAGGIGFDVALTLVGEDHEADFNAQWGIDRAFTHRGALAEPSAPPPPKRAITMLQRKPDRPGASLGKTTGWIHKAHLQRHHVDMLAGVTYRRIDDAGLHVTLNGEDRLIEADTIVVCIGQEPRRDLADELKALGRDVQLIGGARDASKLDALAAFEEGTRLGLAL

SEQ ID NO: 5848 - protein, 384 aa, Methanococcus maripaludis
MDEQDILNELREYRNQDLKYEEGYILGSMCTKPHPMARKISEMFFETNLGDPGLFKGTSKLEKEVVSMIGGILHNKNAFGYLISGGTEANLTAMRAFKNISKSKGKPQNIIIPETAHFSFDKAKDMMDLNVVRPPLTKYFTMDVKFIKDYIEDSKNEVSGIVGIAGCTELGSIDNICELSKIAVENDILLHVDAAFGGFVIPFLDDKYKLDGYNYDFDFSLNGVSSITIDPHKMGLAPISAGGILFRDNMFKKYLDVDAPYLTEKQQATIIGTRSGVGVASTWGIMKLLGIDGYETLVNESMEKTMYLVKKAREYGFETAIDPVMNIVALNDENKHDTCMKLRDENWYVSVCRCVDALRIVVMPHLEIEHIDGFLESLSNTKKY

SEQ ID NO: 5849 - protein, 403 aa, Nocardia farcinica
MTEIFHPAALGPITLRNRVIKAATFEGRTPDAIASEDLIAFHREVAAGGVGMTTVAYCAVAPEGRTERRQIWLRPEAVPSLRKLTDAVHAEGAAACAQIGHAGPVADASSTRLPALAPSPMFSPLGMRRMKVPAEHEIADLVAAHARAALLAEEAGFDAVEIHFGHNYLASSFLSPLLNRRTDGYGGTLANRARFAREIARAVRAAVGGRLAVLAKLNMEDGVPGGLTLPESLQVAAWLEQDGSLDALELTAGSSLLNPMLLFHGTPPRKSFANVLPVPARWGFRVVGKKFLREYPYQPAYLLERARQFRRELSLPLVLLGGVTDLDSMRLAMAEGFDFVAMGRALLREPDLLQRIQADAGTRSACTHCNECMPTIYSGTRCVLRLDSPGTVRHAAASQIEPA

SEQ ID NO: 5850 - protein, 220 aa, Zea mays
MAEPAAAGRKTRVGPYEVGKTIGEGSFAKVKHAHDSRTGAVRAIKVLDRNHVLRHKMVEQIKREISTLKLIKHPNVVQLHEVMASRTKIYMVLEFVDGGELFDKIVNSGRLGEDEARIYFHQLINAVDYCHSRGVYHRDLKPENLLLDSHGTLKVSDFGLSAFAPQTNEDGLLHTTCGTPNYVAPEVLADKGYDGMAADVWSCGIILFVLMAGYLPFDDA

SEQ ID NO: 5851 - protein, 730 aa, Haemophilus influenzae
MTTAVTQATIDGFFDASNGDPFATLGMHETEQGIEIRTLLPDANRMVVIERESGKEITELDCVDERGFFVGVIPNCRQFFAYQLQVFWGNEAQIIEDPYRFHPMIDDLEQWLLSEGSMLRPYEVLGAHFMECDGVSGVNFRLWAPNARRVSIVGDFNYWDGRRHPMRFHPKSGVWELFLPKASLGQLYKFELIDCYGNLRLKADPYAFSSQLRPDTASQISALPNVVEMTEQRRQANQANQPISIYEVHLGSWRRNLENNFWLDYDQIADELIPYVKEMGFTHIEFLPLSEFPFDGSWGYQPLGLYSPTSRFGSPEAFRRLVKRAHEAGINVILDWVPGHFPSDTHGLVAFDGTALYEHEDPREGYHQDWNTLIYNYGRNEVKNFLSSNALYWLERFGVDGIRMDAVASMIYRDYSRAEGEWIPNQYGGRENLEAIEFLKHTNWKIHSEMAGAISIAEESTSFAGVTHPSEDGGLGFNFKWNMGWMNDTLAYMKLDPIYRQYHHNKMTFGMVYQYSENFVLPLSHDEVVHGKYSLLGKMPGDTWQKFANLRAYYGYMWGYPGKKLLFMGNEFAQGREWNYEESLDWFLLDENIGGGWHKGVLKLVKDLNQIYQKNRPLFELDNSPEGFDWLVVDDAANSVFAFERRSSNGERIIVVSNFTPVPRHNYRIGVNVAGKYEEILNTDSMYYEGSNVGNFGCVASEKIESHGRENSISVSIPPLATVYLRLKAK

SEQ ID NO: 5852 - protein, 291 aa, Arabidopsis thaliana
MDGSSEKTTNKLVSILPNYRIGKTLGHGSFAKVKLALHVATGHKVAIKILNRSKIKNMGIEIKVQREIKILRFLMHPHIIRQYEVIETPNDIYVVMEYVKSGELFDYIVEKGKLQEDEARHLFQQIISGVEYCHRNMIVHRDLKPENVLLDSQCNIKIVDFGLSNVMHDGHFLKTSCGSPNYAAPEVISGKPYGPDVDIWSCGVILYALLCGTLPFDDENIPNVFEKIKRGMYTLPNHLSHFARDLIPRMLMVDPTMRISITEIRQHPWFNNHLPLYLSIPPLDTIDQAKK

SEQ ID NO: 5853 - protein, 209 aa, Bacillus cereus
MKWIQMPLGPLQTNAYILMNDQKECIIFDPGHEGEKLVTYLQEKQLKPLAVLLTHAHFDHIGAVDAVRDAFHIPVYVHKEEADWLGDATVNGSQIFMMNRSITAKPADHIIDAEGTLTIGSFNFEIFETPGHSPGSISYYTKEANAVFSGDVLFQMSIGRTDLPGGSFAELIGSIEEKLFVLPDETAVLCGHGPETSIGFEKENNPFLQ

SEQ ID NO: 5854 - protein, 468 aa, Methanosarcina barkeri
MISKKVNLETLDESKKYRVGAYSARYIPQVKEKGIPKYEFPEEGMSPRAAYQLVHDEQSLDGNPFLNLASFVNTWMEPEADKLVMENINKNIIDIFEYPQTDKVIQSNIVNMLGRLFNGHHTKFMGTATAGSSEAIMLGLLAHKWSWKNSGRGTGKPNIIFGNDAHVCWDKFAKYFDVEARKIPIDKDERKISAAAVSEQIDENTICVGCVLGTTFTGEIDPVKDINDLLLRYKKEKGWDIPIHIDAASGGFILPFTEPDFEWDFRLESVKSINVSGHKYGLTYPGLGWLIFRDENDLPEDLIFHVNYLGEMEDSYTLNFSGGSAMVVAQYYNILRFGRAGYTRIMKNILEVSQDLAEKVDRLGRFEMLNKGERLPIIAFKQKEETDYSLQQLSYKLRERGWIIPAYCLPENAADIEIMRIVVRENFTSDMAAILVNDIENACQFFENGRKSETKKPCPPDDGMVHIC

SEQ ID NO: 5855 - protein, 253 aa, Bartonella henselae
MLIEQFICREDNFGVLIHDETSGYTAAIDAPESNAIQNALKRRNWTLQTIFLTHHHHDHVEALAELKQIYKAIVIGPEAEKEKISHIDQTLKPDESFLFGTHTILALSTPGHTLGALSYYFPQENLLFAGDTLFSLGCGRLFEGTPAQMLNSLKKLRQLPDETLLYCGHEYTKSNALFALTLDPYNQKLQQRAEDVFLLRAKNAMTLPVTLGQEKKNNPFLRWDNRTLRKTLRMEKETDEEVFAEIRKRKDNF

SEQ ID NO: 5856 - protein, 1331 aa, Streptomyces coelicolor
MTSDSAGPVDAVPGDQELRRLLAGLTAVRDGDFGTRLPDDADGLMGDIAKVFNGMVDQLSVFTSEVTRVSREVGTEGALGGQARVPGVSGTWADLTDSVNAMAGNLTSQVRDIAQVATAVARGDLSQKIDVDARGEILELKNTINTMVDQLSAFADEVTRVAREVGTDGRLGGQADVQGVRGTWRDLTDSVNFMAGNLTNQVRNVAQVATAVAKGDLSQKITVDARGEILELKNTINTMVDQLSAFADEVTRVAREVGTAGNLGGQARVRGVSGTWKDLTDNVNVMASNLTGQVRSIAQVATAVARGDLSQRITVDAEGEVAALADVINTMVDTLSAFADEVTRVAREVGTDGRLGGQANVPNVAGTWKDLTDNVNSMANNLTNQVRNIALVTTAVARGDLSKKIDVDARGEILELKTTINTMVDQLSAFADEVTRVAREVGTEGRLGGQAEVEGVSGTWKRLTENVNELAGNLTRQVRAIAEVTSAVAEGDLTRSVTVEASGEVAELGDNINAMVESLRETTRANQEQDWLKTNLARISGLMQGHRDLPVVAELIMDELVPLVSAQYGAFYLAEDGDDGPELRLVGSYGYPEDTARPNRIAFGRTLVGQAARSRRTIMVNELPPGYLTISSGLGEVVPAALVLLPIVVEGQVLGVIELASVAAFSQINRDFLEMLMETIGVNVNTIVANARTDELLAESQRLTGELQARSAELQTQQEELQHSNAELEDKASLLAAQNRDIEAKNLQIEQARQELEARAQQLSLASKYKSEFLANMSHELRTPLNSLLILAQLLAQNPSRNLTPKQVEYAGIIHSAGSDLLQLINDILDLSKVEAGKMDVSPERVTLRQLIEYVEATFRPMTSQKGLEFTVVTAPGAPADLLTDDSRLRQVLRNLLSNAVKFTERGGVELAVEPAPDDEVPGGVVRGGPVVAFRVKDTGIGIPEQNLESIFGAFQQADGTTSRKYGGTGLGLSITREIAQLLGGAVTVDSTPDRGSTFTLYLPVARPDFEDLLARAPEHLAADASSDVLDRPAPVAELTGGHRRRPRRLLVVEERPRGLLTLVAESVVADLTHGRDDAGDRPPLDVITAVGAEEAAGALAAEPCHCVVLELGMPDGEASRFLRALRGDSALASVPVLVHSGHRADAAVAEDLRSRAAGGTLEFLAGLDELRERIALHLAAEEPGDVLSLVRPEEPPRPDPRAGQGPPAGRTVLVVDDDARNLFALSGILELHGFRVLHAENGRRGIEALVDHPEVALVLMDVMMPEMDGYTATAEIRRIPRYAELPIIAVTAKAMPGDREKSLASGASDYVTKPVDTQDLIACVRRWLPA

SEQ ID NO: 5857 - protein, 651 aa, Agrobacterium tumefaciens
MVDDFHFREKIFHFDHERIPERVVHARGYGAHGYFETYDSLATHTKADLFQRAGERTPAFVRFSTVAGNKGSADLARDVRGFAVKLYTKEGNWDLVGNNIPVFFIQDAIKFPDLVHAAKQEPDRAFPQAQTAHDTFWDFISLTPESMNMVMWIMSDRTIPRSFRFMEGFGVHTFRFINAKEQSTFVKFHWKPKLGLQSVAWNEAVKINGADPDFHRRDLWTAIQSGNFPEWELQVQLFDQDFADSFDFDVLDPTKIIPEEILAPKPVGRLVLDRMPDNFFAETEQVAFMTQNVPPGIDFSNDPLLQGRNFSYLDTQLKRLGGPNFTHLPINAPKCPFAHFQQDGHMAMRNPTGRANYQPNSFGEGQRESPTRGFQHFAAEEQGVKARLRPESFADHYSQARQFYISQTPPEQRHIASALTFELSKVETVEIRERMVSHLLNIDETLATTVAQKLGLQTMPEPANTAIPTRQDLEPSPALSIVERGPKRFEGRKLGILITDGVDAKLLKGLTQAVTAEKAVFEFIAPKVGGVTASNGTLIEAHHMIDGGPSVLFDAVALLTSEAAIAELTEEATARDFVADAFQHCKFIGYDRSALPLLEIAGIADAMDEGVLPLPGEEGLAAFVAELGKLRVWAREPSLKLGKASVPVNKE

SEQ ID NO: 5858 - protein, 404 aa, Streptococcus pneumoniae
MKEYNKSSKLEHVAYDIRGPVLEEAMRMRANGEKILRLNTGNPAEFGFTAPDEVIHDLIMNARDSEGYSDSKGIFSARKAIMQYCQLKKFPNVDIDDIYLGNGVSELIVMSMQGLLDNGDEVLVPMPDYPLWTAAVSLAGGNAVHYICDEAVEWYPDIDDIKSKITSNTKAIVLINPNNPTGALYPKELLLEIIEIARQNDLIIFADEIYDRMVMDGHVHTPVASLAPDVFCVSMNGLSKSHRIAGFRVGWMVLSGPKTHVKGYIEGLNMLSNMRLCSNVLAQQVVQTSLGGHQSVDELLLPGGRIYEQRNFIYNAIQDIPGLSAVKPKAGLYIFPKIDRNMYRIDDDEQFVLDFLKQEKVLLVHGRGFNWQEPDHFRIVYLPRVDELAQIQEKMTRFLKQYRR

SEQ ID NO: 5859 - protein, 607 aa, Bacillus cereus
MCGITGWVNWNKDLSNEHVILEKMAHSIQHRGPDAEGFWFSPRAAFAHRRLIVIDPEGGAQPKTFRAGDYTYALTYNGEIYNFRELREQLRKCGHTFETHSDTEVLLHAYLEWKEDCVQHLNGIFAFALWDDQKQQLFLARDHLGVKPLFYTERNDSIIFGSEIKALLAHPSVPTEIDADGINEIFGLGLFRTPGCGVFKHIEEVRAGHSITFTRDKKVVTKYWNLESKAHTDSTEDTASHILSILQDTVKRQLIADVPLVCMLSGGLDSSGITALAGKEFAAENKTLHTYSIDFVNSAKDFELTFARTGLDAPWVKRVSEHVGTSHHDIIVNAEELANHLFVPLRAKDLPSAGEMETSLYLLFCEMKKDATVALSGESADEVFGGYPWFHQEELLYVDKFPWLTNWKNTSPLLLHEVSNQCNLEEYIDTRFQEAILEVPTLKGESKKSAKQRQMFYLFLTRFLPFLLDRKDRMSMAVGFEVRVPLCDYRLVEYLWNVPFNIKSIDNIEKGILRRALKPALPDDVRNRRKSAYPTSQDPHYLQTIRHLSLDMCSNKNNPIFSLINHSTLLAIADQSNKDINNFEARSAMEYMLQVNEWLKTYHIHIA

SEQ ID NO: 5860 - protein, 479 aa, Bacillus licheniformis
MNQKIVRLIIALSLLCGLVTGAGPIPLHDVVSKASAAEEAAAKSTARNELEKIEKAYDLISNEYVEQVDREKLLEGAIQGMLSTLNDPYSVYMDKQTAKRFSDSLDSSFEGIGAEIGMEDRKIIIVSPFKQSPAEKAGLKPNDEIISIDGDSMSGMDLNDAVLKIRGKKGSTVTLKVHRPGMKDQLTFTIKRDEIPLETVFASIKKVQDKPVGYIAISSFSEHTAKDFTAELKKLEKKGIKGLVLDVRGNPGGYLQSVEDILKHFVTKDHPYIQIAERNGNKKQYFSKLKEKKPYPVSVITDKGSASASEILAGALKEAEGYDVVGDPSFGKGTVQQAVPMGDGSNIKLTLYKWLTPKGNWIHKQGIQPTVPVTQPAYFSAGPLQLKEPLKPDMNNNEIKRAQFLLKGLGFVPGREDGYYNESTKKAVMAFQAANKLKQTGIIDQKTANTMNLRIEEKKMDEKNDLQLQAALKVLFNKK

SEQ ID NO: 5861 - protein, 362 aa, Leptospirillum ferrooxidans
MSELFSPLQLASVTFPHRIFLSPMCQYQAREGYVTPWHFVHLGARAQGGASLVMMEASSVSPEGRLSHGDVGLWEDGQGKALAPLVDLVHSLGSRIGIQLAHGGRKASCHRPWEEGGRPLSESSGAWPVVGPSPMAFSEGYPIPKEMDSPEMERVAESFVRSAIRAKASGFDVLELHLAHGYLLHEFLSPLTNMRLDQWGGSIEGRMRYPLEVVRRVRQVWPQELPLFVRISATDWVPGGWSIEDSVVLARQLKLLGVDLIDVSSGGIVPHAAIPVAPLYQVALSERIRSEAKIPTGAVGLVTAPEEAESIVRSGKGDAVLIGRAMLRNPNWPLEAALKLGGFLSPPDSYLRAWPPVGCPAG

SEQ ID NO: 5862 - protein, 223 aa, Aspergillus fumigatus
MFYSYFGPHRTTILAEHLSPGTSSTAASSLASIILPKITHDKPQKLTYTHERLFIHYIADSPSGSSDDAGRRIPFAFLLEMKRKFLSTYPPSSTDFSSLPAYGCAAFNSELRSLLQTYNTAPPSDSLASARREIDSVRDIMTENIERVLERGERIDLLVDKTDRLGGSAHDFRVRSRGLRRRMWWKNIKLMVLLAVVVVFLIYLFVGMGCGLPAWGKCVGHSA

SEQ ID NO: 5863 - protein, 339 aa, Brassica napus
MDHEADAFRDLMTITRFVLNEQSKYPESRGDFTILLSNIVLGCKFVCSAVNKAGLAKLIGLAGDTNIQGEEQKKLDVLSNDVFVKALVSSGRTSVLVSEEDEEATFVESSKCGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAEEEKN

SEQ ID NO: 5864 - protein, 206 aa, Anemia phyllitidis
VMVYKFHEDEHGEVVAEIRRSDLEPYLGLHYPATDIPQASRFLFMKNRVRMICNCAATPVRVIQDKGLRQPLSLAGSTLRAPHGCHSQYMANMGTIASLVMAVIVNDNDEEVEQQNTSPKQEKLWGLVVCHHTTPRAVPFPLRSACEFLMQVFGLQLNMEMELAAQMREKHILRTQTLLCDMLLRDAPIGIVSESPNIMDLVKGSI

SEQ ID NO: 5865 - protein, 741 aa, Streptomyces coelicolor
MALRDTSIPEPSGPVPPAPGACATAPPLDPTDRGRLLAGAHHDPHSLLGAHPVPGGIAFRVLRPFAREVGVVVDGERHTLASEEDGLFSGVLPLAGIPSYTLVVAYEQGETQETHDPYRFLPALGELDLHLIGEGRHEQLWQALGAEPMTHEGVTGTRFTVWAPNAQGVRVATDFTHWDGTAFPMRSLGSSGVWELFLPGVGEGTRYKFEIHSRYGHRFLKADPMARAAEEPPNTASVVTASRYEWGDAQWMRTRADTPVHEAPFSVYEVHLPSWRPGLTYRELAEELPAYVKDLGFTHVELMPVAEHPYGPSWGYQVTGFYAPTARLGSPDDFRFLVDALHRAGIGVIMDWVPAHFPKDDWALGRFDGDPLYEPGDSRRAEHPDWGTYTFDFARTEVRNFLVANAVYWCEEFHIDGLRVDAVASMLYLDYSRDSGQWEPNQYGGREDLAAMAFLQEMNATVYRRCPGVVTIAEESTAWGGVTRPTDTGGLGFGLKWNMGWMHDSLEYVAHEPVHRRYHHHEMTFSMVYAYSENYVLPISHDEVVHGKQALVSKMPGDWWQRRANVRAYLGFMWAHPGKQLLFMGQEFAQGAEWSEKQGPEWWLLDEGYHSAGDHRGVQDLVRELNTRYTRTPALWQRDTDPAGFRWVSVDAAEDNVFAFLRYGTDGTPLLAVSNFSPVVRHEYGLAVGDEAVAWQEVLNTDAEEYGGGGVGNPDPVKPEDGSIRITLPPLATVWLMPYAL

SEQ ID NO: 5866 - protein, 204 aa, Anemia phyllitidis
VMAYKFHDDEHGEVVAEIRRSDLEPYMGLHYPATDIPQAARFLFMKNRVRLIYDCRLPPVKVIQDKNLVQPLSLAGSTLRAPHRCHAEYMGNMGSIASLGMAVIVNDDDSSDAGNMQQRTRLWGLVVCHHTSTRYVPFPLRSACEFLMQVFSLELNMEVELAAQRREKHILQTQTLLCDMLLRDAPIGIVSQSPNIMDLVKGSI

SEQ ID NO: 5867 - protein, 206 aa, Dryopteris filix-mas
VMAYKFHEDEHGEVLAEIRRSDLEPYLGLHYPATDIPQASRFLFMKNRVRMICDCRAIPVRVIQDKELRQPLSLAGSTLRAPHGCHGQYMANMGSIASLVMAVVVNDNDEDLSNRPHQPKMRRLWGLVVCHHTTPRAVPFALRSACEFLMQVFGLQINMELELAAQMREKHILRTQTLLCDMLLRDAPIGIVSESPNIMDFVKGSI

SEQ ID NO: 5868 - protein, 215 aa, Photorhabdus luminescens
MKYQIIPVTAFMQNCTLIWNEDSKEAAIVDPGGEAEKLIAEIERRGLKLTQILLTHGHFDHVGATAEVAKHFNAPVYGPQQEDAFWIEGLQAQSRMFGIEECPSFEPDRWLNEGDELRVGGVDLSVLHCPGHTPGHVVFVNHVDKLIYMGDVLFKGGVGRSDFPRGNHRQLINSIKDKLLPLGDDYEFIPGHGPMSTLGHERQTNPFLQDEVPSW

SEQ ID NO: 5869 - protein, 639 aa, Unknown
  Chrysanthemum x morifolium
MDSCDCFETQWPADELLVKYQYISDFFIAFAYFSIPLELIYFVQKSAFFPYRWVLMQFGAFIVLCGATHFINLWTFSSHSKTVAIVMTVAKLSTAFVSCVTALMLVHIIPDLLSVKTRELFLKQRAEDLDREMGLIIKQEETGRHVRMLTHEIRSTLDRHTILKTTLIELGRTLDLEECVLWMPSTKGMILEVSHSLHNLIPFRSTVPINLPIITEVFNSAEAIRIPHNCPLARIRTPVGSYIPPEVVAVRVPLLHLSNFEIDNWPDNSAKSYAVMVLILPMNGVRKWRDHEMELVTVVADQVAVALSHAAILEESMRARDQLMEQNFALNLARQEAEMAIHARNDFLAVMNHEMRTPMHAIIALSSLLLETELTPDQRAMIETILKSSNLLAALVNDVLDLSRLEDGSLELESEVFNLHGLFKEVVTLINPIASVKNTSMALNCDLDLPAFGIGDEKRLMQIILNVVGNAVKFTKGGHVSIQASILSPEYLQEWRTPEFCPTLTEGLFYLLAQVKDSGSGIKQQDIPHIFTKFSEPRSASNRSGGAGLGLAICKRFVNLMGGHIWIESGGLGKGTTVAFLVKLGLCNYPNDPTMQRLVPRTVPKARPHQGSGELIQHRQLDREGYQGAASFPLYNRSM

SEQ ID NO: 5870 - protein, 639 aa, Unknown
  Chrysanthemum x morifolium
MDSCDCFETQWPADELLVKYQYISDFFIAFAYFSIPLELIYFVQKSAFFPYRWVLMQFGAFIVLCGATHFINLWTFSSHSKTVAIVMTVAKLSTAFVSCVTALMLVHIIPDLLSVKTRELFLKQRAEDLDREMGLIIKQEETGRHVRMLTHEIRSTLDRHTILKTTLIELGRTLDLEECVLWMPSTKGMILEVSHSLHNLIPFRSTVPINLPIITEVFNSAEAIRIPHNCPLARIRTPVGSYIPPEVVAVRVPLLHLSNFEIDNWPDNSAKSYAVMVLILPMNGVRKWRDHEMELVTVVADQVAVALSHAAILEESMRARDQLMEQNFALNLARQEAEMAIHARNDFLAVMNHEMRTPMHAIIALSSLLLETELTPDQRAMIETILKSSNLLAALVNDVLDLSRLEDGSLELESEVFNLHGLFKEVVTLINPIASVKNTSMALNCDLDLPAFGIGDEKRLMQIILNVVGNAVKFTKGGHVSIQASILSPEYLQEWRTPEFCPTLTEGLFYLLVQVKDSGSGIKQQDIPHIFTKFSEPRSASNRSGGAGLGLAICKRFVNLMGGHIWIESGGLGKGTTVAFLVKLGLCNYPNDPTMQQLVPRTVPKARPHQGSGELIQHRQLDREGYQGAASFPLYNRSM

SEQ ID NO: 5871 - protein, 645 aa, Chlamydophila pneumoniae
MKKLVRLCVVLLSLLPNVLFSSDLLREEGIKKMMDKLIEYHVDAQEVSTDILSRSLSSYIQSFDPHKSYLSNQEVAVFLQSPETKKRLLKNYKAGNFAIYRNINQLIHESILRARQWRNEWVKNPKELVLEASSYQISKQPMQWSKSLDEVKQRQRALLLSYLSLHLAGASSSRYEGKEEQLAALCLRQIENHENVYLGINDHGVAMDRDEEAYQFHIRVVKALAHSLDAHTAYFSKDEALAMRIQLEKGMCGIGVVLKEDIDGVVVREIIPGGPAAKSGDLQLGDIIYRVDGKDIEHLSFRGVLDCLRGGHGSTVVLDIHRGESDHTITLRREKILLEDRRVDVSYEPYGDGVIGKVTLHSFYEGENQVSSEQDLRRAIQGLKEKNLLGLVLDIRENTGGFLSQAIKVSGLFMTNGVVVVSRYADGTMKCYRTVSPKKFYDGPLAILVSKSSASAAEIVAQTLQDYGVALVVGDEQTYGKGTIQHQTITGDASQDDCFKVTVGKYYSPSGKSTQLQGVKSDILIPSLYAEDRLGERFLEHPLPADCCDNVLHDPLTDLDTQTRPWFQKYYLPNLQKQETLWREMLPQLTKNSEQRLSENSNFQAFLSQIKSSEKTDLSYGSNDLQLEESINILKDMILLQQCRK

SEQ ID NO: 5872 - protein, 190 aa, Oryza sativa
  misc_feature (37)..(37): Xaa can be any naturally occurring amino acid
KNEGLVLLADEVYQENIYVDNKKFNSFKKIARSMGYXSVNLCSNITGQILASLVMNPPKAGDASYASYKAEKDGIPQSLARRAKALENAFNSLEGITCNKTEGAMYLFPQLSLPQKAIDAAKAANKAPDAFYALRLLEATGIVVVPGSGFGQVPGTWHIRCTILPQEEKIPAIISRFKAFHEGFMAAYRD

SEQ ID NO: 5873 - protein, 486 aa, Triticum aestivum
MSPASARALTVDSLNPKVLALADHLRGAVAGRAQRMQKELETNPGLYPFDEIIYCNLSNPHYLGQQPIKFFREVLALCDYPHLLNCSVTSSIFSSDAITRAREILDLIPGRAMGGYSHCQGTEGLRNAIAAGIATRDAFPCNAEDIFLTDGAAAPVHMVMHLLIRDEKDGILCPIPSHFLYTSSMALCGATLVPYYLDESGGWAVSISNLKKQLDGARSEGITVRGLVVVNPGNPTGQVLVKENQCEIVEFCRNENLVLLADEVYQENVYTDEKKFISFKKIARSMGFGEEDISLISFHSVSNGYYGECGRRGGYMEVTGFNSEVRKQVYKVASLSSCSNLAGQVLVSLVMNPPKVGDESYTSYREERDRIMLSLSRCAEAMVQAFNSLEGLTCSKAEGAMFVFPSVRLPKRAIAAAEAMNAKPDVFYALRLLENTGIVVLPGSVFGQVPGAWHFRCTILQQEEKVQLIIYRFKAFHKAFMEEFRD

SEQ ID NO: 5874 - protein, 546 aa, Burkholderia fungorum
MAAKEIIFSDVARSKLVEGVNILANAVKVTLGPKGRNVVLERSFGSPVVTKDGVSVAKEIELPDRVQNIGAQLVKEVASRTSDAAGDGTTTATVLAQAIVREGQKYVAAGLNPLDLKRGIDKAVVAAIDELKKISKPTTTSKEIAQVATISANGEESIGQRIAEAIDRVGKEGVITVEDGKSLDDELDVVEGLQFDRGYLSPYFINDQDKQVAVLDNPYVLLHDKKVSNIRDLLPVLEQVAKASRPLLIIAEDVEGEALATLVVNNIRGILKTVAVKAPGFGDRRKALLEDIAILTGGQVIAEETGLTLEKATLAELGQAKRIEVGKENTTVIDGAGEHKNIEARVKQIRAQIDEASSDYDREKLQERVAKLAGGVAVIKVGGATEIEVKEKKDRVDDALHATRAAVEEGIVPGGGVALIRVRNAISGLKGANADQDAGIKIVLRALEEPLRQIVTNAGEEASVVVAKVAEGSGNFGYNAQTGEYGDLVESGVLDPTKVTRTALQNAASVAALLLTTDATVYEAPKDPAPATSAAGPGAPGAGYDF

SEQ ID NO: 5875 - protein, 470 aa, Staphylococcus aureus
MTKTLPEDFIFGGATAAYQAEGATNTDGKGRVAWDTYLEENYWYTAEPASDFYNRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYKGEIGVVHALPTKYPFDPSNPEDVRAAELEDIIHNKFILDATYLGKYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIIDGANVKGYFIWSLMDVFSWSNGYEKRYGLFYVDFETQERYPKKSAYWYKELAETKEIK

SEQ ID NO: 5876 - protein, 185 aa, Xanthomonas oryzae
MLRPYSTQETAMALNDLQHVPGAIAAPAETHGFVFNHTMLRVKDAKQSLDFYTRVLGFRLLDARDFADATFSLYFLALLPEGTAIPDDDAQRRLWMAGIPGVLELTHNHGTDTQDGPVYHDGNSDPRGFGHICVSVPDIHAACARFDSLNVPYQKRLEDGRMKHLAFIKDPDGYWVEIISNTPLA

SEQ ID NO: 5877 - protein, 715 aa, Streptomyces coelicolor
MTRARPNWKGSPVWSGHPYPLGAAYDGQGTNFALFSEVAERVDLVLVDDDGNHSTVPLPDVDGFVWHCYLPGVGPGQRYGYRVHGPWAPAVGHRCNPAKLLLDPYTRAVDGLVDNHASLFERARGKADPGDSAGHTMLGVVTDPFFDWGDDRPPRRPYSESVIYEAHVRGLSRTHPDVPEELRGTYAGLAHPAVVDHLTSLGVTAVELMPVHQFVHDGVLLDRGLSNYWGYNTIGFFAPHNGYAALGTRGQQVSEFKSMVKTLHEAGLEVILDVVYNHTAEGNERGPTLSFRGIDNASYYRLVDGDWQHYYDTTGTGNSLLMRHPYVLQLIMDSLRYWVTEMHVDGFRFDLAATLARQFHEVDRLSAFFDLIQQDPVISRVKLIAEPWDVGEGGYQVGNFPQLWSEWNGKYRDAVRDFWRAEDHSLGEFASRLTGSSDLYQHSRRRPRASVNFVTAHDGFTLRDLVSYNDKHNEANGEDNRDGESHNRSWNCGAEGGTKDPAVRELRGRQQRNFLATLLLSQGIPMICHGDELGRTQRGNNNAYCQDNEISWIDWRLDGEQRALLDFARRLIALRADHPVLRRRRFFHGETLTHADQPLPDLVWLLPDAREMTDDDWQRSDAHTVGVFLNGDAIAEPDPRGRPVVDDSFLLLLNSHWEPADFRLPDAGYGERWTALVDTADPDGVPDEAEHKAGTRLTVEQRSLVLLSRPSRTGR

SEQ ID NO: 5878 - protein, 394 aa, Zea mays
MASFVVHHHGSPLDREGKVKMSALALRSSLRPCEAAEEVGAGQAWCRGADMGVAAFVDEFSVEDLLDLEDLCEVDKDCAELGDTVPAAESVQEGDKVSSDSHGSSVLSYELMTLPVPHPMIDLPLPAHDAEELEWVSRIMDDSLAELPPPPKLPAAPLGAARRPLEGAVAGPMRSPTTTICALSTEALVPVTRAKRSKRSRGSVWSLSGGAPLSESTSSSSTATTSSCSSSASFSPLLLLPADPSLVLSSHLLDETPRPKKKSKHGKHGKSGKPKKRGRKPKHHPKPPQFSGGAAYAPAQGDRRCSHCGVQKTPQWRAGPEGAKTLCNACGVRYKSGRLLPEYRPACSPTFVSSIHSNSHRKVLEMRRKKDGDLGQLPLPVPAALLLGPAVESF

SEQ ID NO: 5879 - protein, 337 aa, Magnetospirillum magnetotacticum
MPYKRITLTHFLLQEQRRLGGSGSFTALMTDIIFACKMISHEVNRGALAGNLGVAGSENVQGEEQKKLDVLANDIFLHMNALGGSYAGMASEELEDVHAVHGAADGKYLLLFDPLDGSSNIDVNISVGSIFSILKLPEGADAGSKDAFLQPGVKQVAAGYALYGSSTMMVLTTGNGVNGFTLDNNVGMFLLTHPNMTIPADTKEFAINASRERFWEPPVKRYIDECRQGKEGPRGKDFNMRWVASMVAEVHRILCRGGVFLYPADTENMKKGGKLRLMYEANPMAFIVEQAGGAATTGRGRMMEVQPTGLHQRVPVILGSKTEVERIGAYHTEYDAK

SEQ ID NO: 5880 - protein, 73 aa, Quercus suber
SLDVWDPFEGFPPLSSHSNFPSETSSFAAAKLDWKETPNAHVFADVPGQKKEEVKVEIEDRRVLQISGERSQD

SEQ ID NO: 5881 - protein, 312 aa, Saccharomyces cerevisiae
MDSQPVDVDNIIDRLLEVRGSKPGQQVDLEENEIRYLCSKARSIFIKQPILLELEAPIKICGDIHGQYYDLLRLFEYGGFPPESNYLFLGDYVDRGKQSLETICLLLAYKIKYPENFFILRGNHECASINRIYGFYHECKRRYNIKLWKTFTDCFNCLPIAAIIDEKIFCMHGGLSPDLNSMEQIRRVMRPTDIPDVGLLCDLLWSDPDKDIVGWSENDRGVSFTFGPDVVNRFLQKQDMELICRAHQVVEDGYEFFSKRQLVTLFSAPNYCVEFDNAGAMMSVDESLLCSFQILKPAQKSLPRQAGGRKKK

SEQ ID NO: 5882 - protein, 336 aa, Streptomyces avermitilis
MTRNRASADGVPQPLMATYYAQRASAGLIIAEAATPNAVGQTYPNITAIHDATHVAGWRGVTDAVHAAGGRMFLQLQHGGRVGHPATSGLTPVAPSPVPLPETIFTPSGHRPSVVPREMTAADIRTTVADFAAAARNAIDAGFAGVEVHSANGHLLHQFLATNTNRRTDAYGGSVAARIRFAVEVTEAVADAIGAERVGVRISPGTTVNGVEEDDTELLYPAFVEALAALGPAYLHLVHADPDQPLFRHIRENWPTTLMANPVLGPELPADGGAHAAGRLLTAGADLIALGRPFLANPDLVTRLRTGAPVNPVRDRFMMYVGGERGYTDYPTLTVA

SEQ ID NO: 5883 - protein, 955 aa, Desulfovibrio vulgaris
MEMRTPKNPGEGLAHQSLLRLAPGGPILGPVLSAIRIPAFTLDSDGLVVFMNDPFLDLVLRPAADLLGKPLSVVVPAIHAPLVARAAADILAGTCDDLLLPVSGQGGTALPVRFRTVHAVDAEGAPVCHAFATHALPRRHDESLRYAELFHLCPVPLWQQDVTEAQQAIDTLRTSGVHDLRAYFEAHPHVLAEFARRIRIVDANETASGLFAGCREDLLDPDLFMRLGMRQFVMELLVMLASGADRLSVEAACRALDGGERALQIEARLMPGFGLTGMRVIACGTDITERNRSQAALADFRNLVEAMSDNMIDMLWAKDTECRYIFANRAIRENLLHSDDERVLGRTDLHFAERQRHLGHEHTFGELCIDSDRVVLQTRTSGRFREDGKVQGRYLMLDVQKSPLYDRQGKLLGTVGTGRDITLLKAQEDALLRSQQLLKWTVEASTDTIWQYDVVHDRFLCNNRCPGLLALSDAEDECHCRHRADPADAELLLHNLRNGQGGDKGFSMELRLRDDEGVWHWMYCRGKVVEYDEEGRPTLVVGANTDITERKRFETELRQARDDAEAANKAKSIFLANMSHEIRTPLNGVLGMLQLLEDAPLTSDQQELLHVASQSSRNLLTVINDILDFTRLGSVAPSFASDPFDAAGALYTVRDTLATGAKDKDIRIETDISPNVPPLLIGDVTRFRQILFNLVGNAVKFTQQGTVRISLHGLERHSPAGALRMLLMVEDSGIGIPQDMLGNVFEPFFQVDGSYRRRYPGTGLGLGIVRSLVHGMGGTIAIDSEEGAGTTIACTLMFGRIEKTPEGVTEGFETGAGLKVLVVEDDHISRVAASRMLERLGHYPVVASSAVEGIAMLRQQTFDCVLMDIQMPEMDGLELTEALRSGLVPGVEDIPVLALTAHVLTEERRDFMSRGISGYLAKPLEMDILAKALTQIPPGGKGHAAIIARADTSPI

SEQ ID NO: 5884 - protein, 377 aa, Unknown
  Vibrio sp. Ex25
MEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLIPAPDYPLWTASVALSGGKPVHYLCDEGADWYPDLEDIKKKITPKTRGIVLINPNNPTGAVYSRDFLLEVIEIARQHKLIIFADEIYDKVLYDGATHTSVATLTEDVLVMTFNGLSKAYRVCGFRGGWMFLTGPKHLAQGYVNGLELLSSMRLCANVPMQHAIQTALGGYQSINELILPGGRLLEQRNRAYELINQIPGVSCVKPKGAMYLFPKIDTKMYNIKNDQQMVLDFLKQEKVLLVQGSGFNWPKPDHFRIVTLPHVEDLEIAIGRFERFLSTYSQ

SEQ ID NO: 5885 - protein, 402 aa, Unknown
  Bartonella sp. SV12uk
TTTATVLGQAIVQEGVKAVAAGMNPMDLKRGIDAAVEEVVASLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKAEISARVNQIKAQIEETTSDYDREKLQERLAKLAGGVAVIRVGGATEVEVKEKKDRVDDALNATRAAVEEGIVAGGGTALLRAANALTVKGSNPDQEAGINIVRRALQAPARQIATNAGEEAAIIVGKVLENNADTFGYNTATGEFGDLIS

SEQ ID NO: 5886 - protein, 323 aa, Aspergillus nidulans
MADQDVDLDSIIDRLLEVRGSRPGKQVQLLESEIRYLCTKAREIFISQPILLELEAPIKICGDIHGQYYDLLRLFEYGGFPPEANYLFLGDYVDRGKQSLETICLLLAYKIKYPENFFVLRGNHECASINRIYGFYDECKRRYNIKLWKTFTDCFNCLPIAAIIDEKIFTMHGGLSPDLNSMEQIRRVMRPTDIPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPAEKKQKYVYGAMSSGRPITPPRKQKK

SEQ ID NO: 5887 - protein, 402 aa, Unknown
  Bartonella sp. SV06uk
TTTATVLGQAIVQEGVKAVAAGMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKAEINARVNQIKAQIEETTSDYDREKLQERLAKLAGGVAVIRVGGATEVEVKEKKDRVDDALNATRAAVEEGIVAGGGTALLRAANALTVKGKNPDQEAGINIVRRALQAPARQIATNAGEEAAIIVGKVLENNADTYGYNTATGEFGDLIA

SEQ ID NO: 5888 - protein, 274 aa, Unknown
  Exiguobacterium sp. 255-15
MEFVTLNNGLVMPQLGYGVFKVPEQEVYEAVREALRVGYRSIDTAMIYENEAGVGRALKDSGIPREDIFLTTKVWNKDQGYERTLAAFETSLQKLGVDYVDLYLIHWPMPDEDLYMDTWRALEQLYRDGKAKAIGVSNFHIPHLTRVLEEGTVVPAVNQIELHPFLSQEAIRAFCQKNGIVVEAWSPLMKGRDALTDPVITDIAARHGKTPAQVVLRWHLQHDIIAIPKSVTPSRIQENLDIFDFVLSPDDMRQIDQLNRNERTGSNPDEMHKK

SEQ ID NO: 5889 - protein, 902 aa, Cryptococcus neoformans
MSNFLPIPTKAATPLPSFAKHLLDYISAHFRDTHSEAFRKDVDVLVGMRKDWVEAKLEAHPEIIRAFMRYHAQLAFLSTKFPSDINLPFAYYLPFPATFSLSPDAPISLSSLTFERACVLFNMTALYASMAAAERRAEAEGIKRALGYLTAAAGVLEYLITSVLPTLRSELSSPQAAGYDMTESFLGTLKEFVLAEAQECYWQQAVLQGTYKNGLIGKLSMKVSEYYKAALASMNGTDYPSSSYFPLNWTAHMNVKQMHFEAAAQFRLSQEDLEKSRYGEEIGRLKVAESLAKKGLDAARKGVADSVVSDLKQLHAAIKSSLERAVRDNDLVYVQPIPPANQLAPIVGVGMVKVNVPAEVAEPVAWLMGGKAGMEPLFSGLVPYGVHLALSIYDDRKDTLVRDLDGKREELDGLAASTLQSLNLPGSIQALDRPVGLPPSLLKKSEEVASSGGIERIRSLLDEVNRLAHANVQSLNEAMDILDQEATENESLIARQPELQQTRQPSHVANQPLIQMAEQYEATIKQAGGSDATVRAKWEEWARLVGILAAGEMEMEDYVPGTTSPSGSLPPSVRPLRASLEELDDRIAHRARLVREARQISAADDIRPEVLKEAAKLAHGGSGDVKTEWFEDLFEKGLEKYMGVKREMDEEVAKHDELLEQIRTQNESFLSERKDDPIIKERERRLQDMDLAYWKWREIVDNAEEGIKFYNSFAEMLHGFKAACGQFLNTRRIDVGQMTTQFQQQMNVSEPQQQPEPRYQSPSPQSFQPSFSPSPSHFQPSAPSSFSSSPVRSPAPSAPARRESPPKTLSFLPHPSSSAWQPASVDFLPPPPPPPILRSGGIQSQPKVAPPVTPSITAIRDQTQGTPRRMTRAAAAAAERDEATERNKYSSGGPRRKGGGVV

SEQ ID NO: 5890 - protein, 820 aa, Oryza sativa
MLCLTSSSSSAPAPLLPSLADRPSPGIAGGGGNVRLSVVSSPRRSWPGKVKTNFSVPATARKNKTMVTVVEEVDHLPIYDLDPKLEEFKDHFNYRIKRYLDQKCLIEKHEGGLEEFSKGYLKFGINTVDGATIYREWAPAAQEAQLIGEFNNWNGAKHKMEKDKFGIWSIKISHVNGKPAIPHNSKVKFRFRHGGGAWVDRIPAWIRYATFDASKFGAPYDGVHWDPPACERYVFKHPRPPKPDAPRIYEAHVGMSGEEPEVSTYREFADNVLPRIRANNYNTVQLMAIMEHSYYASFGYHVTNFFAVSSRSGTPEDLKYLVDKAHSLGLRVLMDVVHSHASNNVTDGLNGYDVGQNTHESYFHTGDRGYHKLWDSRLFNYANWEVLRFLLSNLRYWMDEFMFDGFRFDGVTSMLYHHHGINKGFTGNYKEYFSLDTDVDAIVYMMLANHLMHKLLPEATIVAEDVSGMPVLCRPVDEGGVGFDFRLAMAIPDRWIDYLKNKEDRKWSMSEIVQTLTNRRYTEKCIAYAESHDQSIVGDKTIAFLLMDKEMYTGMSDLQPASPTINRGIALQKMIHFITMALGGDGYLNFMGNEFGHPEWIDFPREGNNWSYDKCRRQWSLVDTDHLRYKYMNAFDQAMNALEEEFSFLSSSKQIVSDMNEKDKVIVFERGDLVFVFNFHPNKTYKGYKVGCDLPGKYRVALDSDALVFGGHGRVGHDVDHFTSPEGMPGVPETNFNSRPNSFKVLSPPRTCVAYYRVDEDREELRRGGAVASGKIVTEYIDVEATSGGTISGGWKGSEKDDCGKKGMKFVFRSSDEDCK

SEQ ID NO: 5891 - protein, 108 aa, Candida glabrata
MASNDNYDPYLLSEDGGQSKAAALKSEIDDTVDIMRNNINKVAERGEMLTSIDDKADNLAMSAQGFKRGANRVRRQMWYKDLKMRMCLFLVIVILLVVIIVPIVVHFS

SEQ ID NO: 5892 - protein, 505 aa, Burkholderia vietnamiensis
MTRSDLPHEARPVVVWFRDDQRLADNPALTHALDTGHPVVCVYVHDAAPKHGRAMGGAQRWWLHESLSKLDDALAAHGGSLILLRGNEHEAITGFAAAIGAAMVVWNRRYAKAQTGTDASIKRDLIDRGIAVSTFNGHLLREPWTVTTREGLPFQVFSAYWRAARRDDFFPPVPLPAPSHIRFFPVPAHATPHVCTLRELELQPSAPDWAGGLRETWQCGEQAASDQLEAFLENSLSDYPTLRDFPAARATSRLSPYLRFGNISVRQVWYATLSAADAMRSARIVRGVDSKDGPLSKFLSEIGWREFSYHLLYHFAPLHQVNFRRQFDSMPWRDDAKSLRKWQTGRTGYPLVDAGMRELWHTGWMHNRVRMVAASFLSKHLLIDWRQGEAWFWDTLVDADEASNPASWQWVSGSGADAAPYFRIFNPVLQAQKFDPHGDYTRRWVPELAQLSADTVHAPWAASREQLQRASVTLGRSYPMPIVDHQCARARALESVKRLDSESHA

SEQ ID NO: 5893 - protein, 384 aa, Pyrococcus abyssi
MSKFPEKGLPREEVLNLLEDKTKVDLTFSSGKILGSMCTMPHELAIEVFARYIDRNLGDPGLHPGTRKIEEEVIEMLSDLLHLEKGYGHIVSGGTEANILAVRAFRNISDAERPELILPKSAHFSFIKAGEMLGVKLVWAELKQDYAVDVKDVEAKISDNTIGIVGIAGTTGLGVVDDIPALSDLAREYGIPLHVDAAFGGFVIPFAKSLGYDLPDFDFKLKGVESITIDPHKMGMAPIPAGGIIFRRKKYLKAISVLAPYLAGGKVWQATITGTRPGASVLAVWALIKHLGFEGYREIVRKAMELSRWFAEEIKKLNNAWLVREPMLNIVSFQTKNLRKVERELKRRGWGISAHRGYIRIVFMPHVTKEMVEEFLRDLREVLK

SEQ ID NO: 5894 - protein, 492 aa, Helianthus annuus
MDPYKYRSSSAYNAPFWTTNSGAPVYNNNNSLTVGSRGPILLEDYHLVEKLANFDRERIPERVVHARGASAKGFFEVTHDITALTCADFLRAPGVQTPVIVRLSTVIHERGSPETLRDPRGFAVKFYTREGNFDLVGNNFPVFFIRDGMKFPDMVHSLKPNPKSHIQEDWRIMDFFSHHPESLHMFTFLLDDIGVPQDYRHMDGSGVNTYTLINKAGKAYYVKFHWKPTCGVKSLLEEEAIKIGGANHSHATQDLYDSIAAGNYPEWKLFIQTIDPDHEDRLDFDPLDVTKTWPEDIFPLQPVGRLVLNKNIDNFFAENEQLAFCPAIIVPGIYYSDDKLLQTRIFSYSDTQRHRLGPNYLQLPANAPKCAHHNNHYDGFMNFMHRDEEIDYFPSRYDPARHAEQYPIPPVRLSGKRDKCVIEKENNFKQPGERYRSFSPDRQERFINRVVGGLSDPRVTHEVRSIWVSYWSQADKSLGQKIASRLNVKPNY

SEQ ID NO: 5895 - protein, 147 aa, Brassica napus
MDFGRFPIISILEDMLEVPEEHSEKGRSNPWRAYVRDQKAMAATPADVIEHPDAYAFVVDMPGIKGDEIKVQVESDNLLVVSGERKRENKEKEGVKYVRMERRMGKFMRKFQLPENADLEKISASCNDGVLKVTVGKLPPPEPKKPK

SEQ ID NO: 5896 - protein, 469 aa, Mesoplasma florum
MEIKKLKKFDDDFLWGASISAFQAEGASTKDGKGLSIQDVKKISEKYSDFSVAADFYNNYKEDIALLKEMGLSSFRFSISWTRIIPDGDGEINKKGIIFYHNLIDELKKNGIEPIVTIYHFDLPFSLQQKGGWSNRDMIVKAFLKYSKVLFNEYAKKVKYWLTINEQNVMIMIGSKMKFLNGGDKKFNQNELYNQSHNMFIAQALVMEEMHNNFPNCLIAPALNIVSIYPNSNKPQDYLAAMNASVMRNWYYLDAIVRGEYNPIMYKYLEDNNFLPDFRKGDYEILKKAKPDFIAFNYYTSATVKSEINNFIEVEELIDQQRLFDVPGMFSYCENPNLEKTEYGWDIDSTGFRVTMREMYERYRLPLMITENGLGHSEQLNENNTVDDDYRIQYYEKHLNELRKCISEGIKIISYNAWTAIDIVSSHQGFSKRYGFIYVDRTEKDLKEMKRYPKKSFYWYKEYIKKIKY

SEQ ID NO: 5897 - protein, 492 aa, Brassica napus
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLVSKSGKVLFVKFHWKPTCGIKNLTDEEAKVVGGANHSHATKDLHDAIASGNYPEWKLFIQTMDPAAEDKFDFDPLDVTKIWPEDILPLQPVGRLVLNRTIDNSFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPIPNKSYTGIRTKCIIKKENNFKQPGDRYRSWAPDRQDRFVKRWVEILSEPRLTHEIRSIWISYWSQADRSLGQKLASRLNVRPSI

SEQ ID NO: 5898 - protein, 579 aa, Gibberella zeae
MCGIFACHRHPDVEKFKPTALKLAKQIRHRGPDWSGSVISNHTILCHERLSIVGVESGAQPLTNADDSIILAVNGEIYNHRHIRKHLKERYHFKTTSDCEVIIPLYTEFDTDAPNHLDGMFSFVLYDKKQDRTIAARDPIGITTFYQGWSSTEPGTIYFASELKCLHSVCDKIVAFPPGHVYDSKTGETTRYFNPSWWDPKKVPSTPVDYKVLRQALEKSVRKRLMAEVPFGVLLSGGLDSSLTASIAQREVTRLRKQALEANGNVLPVEDPDTGEGLVGVDDDDHLDTLTYLPQLNSFSIGLPGSPDNKAALEVAKFLGTKHHVMTFTIEDGLNALSDVIFHLETYDVTTIRASTPMYLLSRKIKAMGIKMVLSGEGSDEIFGGYLYFHAAPDKDSFHEETVRRVKNLHLSDCLRANKSTSAWGLEARVPFLDKEFLEYSMNIDPQDKMITKEKLEKYILRKAFDTSDEPGEQPYLPDNILWRQKEQFSDGVGYGWIDALKDTAEKQVTDEMMKNPKPEWGNDIPDTKEAYWYRCMFDEHFPPHCASTVMRWTPTWSKQTDPSGRAIATHNAKYDSAA

SEQ ID NO: 5899 - protein, 465 aa, Bacillus subtilis
MAHTEQYRFPKDFWWGSSASATQMEGAADRDGKGQNIWDYWFEKEPHRFFDHVGPADTSQFYDNYKEDIRLMKELGHNSFRMSISWSRLIPNGTGEINDKAADFYNNVIDELIANGIEPFVNLFHFDMPMALQKIGGWVNRETVDAYENYARTCFRLFGGRVKKWFTHNEPIVPVEGGYLYDFHYPNKVDFKEAVQVGFHTMLSSARAIQAYREMKQDGKIGIILNLTPSYPRSSHPADVKAGEIADAFFNRSFLDPSVKGEFPKELVDILKHEGFMPDYNAEDLDIIKKNTVDLLGVNYYQPRRVKAKEHLPNPDAPFLPDRYFDPYVMPGRKMNPHRGWEIYEKGVYDILINLKENYGNIECFISENGMGVEGEERFRDEQGIIQDDYRIEFIKEHLKWIHRAIQEGSNVKGYHLWTFMDNWSWTNAYKNRYGFVSVNLEKDGERTVKKSGKWFKEVAEHSGF

SEQ ID NO: 5900 - protein, 147 aa, Geobacter metallireducens
MAIVKYTPFGDLRNLQEQMNRLLDMAWSRESGEELREGVWQPPVDIFEDENGVVIKAELPGIDQKDIEVKIEDNTLTIRGERKHDQEVKKENYHRVERYYGSFMRSFSLPTTIDRDTVKAVCDKGILTITLPRREETKPKQINVEVK

SEQ ID NO: 5901 - protein, 408 aa, Gibberella zeae
MGDIFDAGSNSKLFTPLDIANGKIHLKHRIVHAPLTRNRGTPLNPESTPENPNRVWIPNDLITEYYSQRATNGGLIISEGLPPSLEGNGMPGVPGIFLPEQVQGWKKVVDAVHAKGGYIYAQLWHSGRANIPQLTGTPILAPSATPWDDPNETFAYPPPHTSTPVKLADYPPVEMTVEKIKSTIADYVNAAKNALEAGFDGVEVHGGNGYLPEQFLSSNINKRTDHYGGSEEKRCNFVLELMDELAKAVGQDNLAIRLTPFGLFNQARGEKRVETWGHLCRELKSKFPQLSYVSFVEPRFEQIFSEAEKQQFLGSWGLPTVDLSLFRNIFAGTPFFSAGGFNDVNSWGVVESGKCDGVLYGRYFISNPDLVERLRNGWPLQPYDRSTFYGPFKDNAAGYTDYPFYNGE

SEQ ID NO: 5902 - protein, 145 aa, Bacillus anthracis
MRNLFPEITKRQNGIFDFGPSLLEGMTDAFFKPMNMDIFKVDVHEQSDKYTVKADLPGFQKENIQVEFEQDVLTIQATNHNEVEEKNENGTYIRKERSIGSVTRRFSFKQVEEENVRANYKDGVLTIELPKLKEEKNSKTTINIE

SEQ ID NO: 5903 - protein, 447 aa, Arabidopsis thaliana
  misc_feature (344)..(344): Xaa can be any naturally occurring amino acid
  misc_feature (346)..(346): Xaa can be any naturally occurring amino acid
MDSSNVEENLNPETKSAEEQNPLAIFHSSLPIASLSLTLFPSSTQFLKLFAHHPNKVKIPTQASSLTHLSLSSVSPFPSSRISFKSTIAANPLQSPLSIVPRRPVDPSSAAALRRAAVVWFRNDLRVHDNECLNSANDECVSVLPVYCFDPRDYGKSSSGFDKTGPFRAQFLIESVSELRKNLQARGSNLVVRVGKPEAVLVELAKEIGADAVYAHREVSHDEVKAEGKIETAMKEEGVEVKYFWGSTLYHLDDLPFKIEDLPSNYGAFKDKVQKLEIRKTIAALDQLKSLPSRGDVELGDIPSLLDLGISPTPRTSQEGKPTMVGGETEALTRLKSFAADCQXRXSKGNQKGGNNSVFGANFSCKISPWLAMGSISPRSMFDELKKTISASTTSTTPRNGPGDTGLNWLMYELLWRDFFRFITKKYSSAKTQVEAGPATACTGAFA

SEQ ID NO: 5904 - protein, 548 aa, Xenorhabdus nematophila
MAAKDVKFVNDARSKMLRGVNVLADAVKVTLGPKGRNVVLDKSFGAPVITKDGVSVAREIELEDKFENMGAQMVKEVRSKANDAAGDGTTTATVLAQAIVIEGLKAVAAGMNPMDLKRGIDKAVVSAVEELKKLSVPCSDSTAIAQVGTISANSDETVGKLIAEAMDKVGKEGVITVEEGTGLEDELAVVEGMQFDRGYLSPYFINKPESGSVELENPYILLVDKKISNIRELLPVLEGVAKASKPLVIIAEDVEGEALATLVVNNMRGIVKVASVKAPGFGDRRKAMLQDIATLTNGTVISEEIGLELEKATLEDLGQAKRVVINKDTTTIIDGVGEEGAIAARVTQIRQQIEESTSDYDREKLQERVAKLAGGVAVIKVGAATEVEMKEKRARVDDALHATRAAVEEGVVAGGGVALVRVASAISGLTGENEDQNVGIRVAMRAMEAPMRQIVDNSGEEPSVVVNNVKAGENNYGYNATTEQYGDMIEMGILDPTKVTRSALQFAASIAGLMITTEAMVTDLPKDDKADLGAAGGMGGMGGMGGMM

SEQ ID NO: 5905 - protein, 590 aa, Pseudomonas syringae
MCGLAGELRFDHQPADLAAVERITHELAPRGPDAWGFHSQGPIALGHRRLKIMDLSDGSAQPMIDSNLGLSMAFNGAIYNFPELRAELESLGYQFHSGGDTEVLLKGYHAWGAEMLPKLNGMFAFAIWERDSKQLFIARDRLGVKPLYLSKTDKRLRFASSLPALLKGGDISGMLDPVALNHYLNFHAVVPAPRTLLAGVEKLPPASWMRIDASGKVEQKVWWTLPYGPHEDEKNLTLEDWRDRVLDSTREAVAIRQRAAVDVGVLLSGGVDSSMLVGLLREVGVEDLSTFSIGFQDAGGERGDEFQYSDLIAKHYGTRHHQLRIQESEIIEQLPAAFRAMSEPMVSHDCIAFYLLSREVAKHCKVVQSGQGADELFAGYHWYPQVDGASDPVAAYRYAFVDRSYAEYADTVQPKWRTANDAAGDFVRDHFAQPGASAAVDKALRLDSTVMLVDDPVKRVDNMTMAWGLEARTPFLDYRLVELSARIPGKFKLPDGGKQVLKEAARLVIPSEVIDRKKGYFPVPGLKHLQGDTLNWVRELLTDPSQDRGLFNPTMVDKLLTNPEGQLTPLRGSKLWQLAALNLWLSEQGL

SEQ ID NO: 5906 - protein, 336 aa, Pseudomonas aeruginosa
MSRVTLSRYLIEQTRSHNTPADLRFLIEVVARACKEISHAVSKGALGGVLGSMGTENVQGEVQKKLDVMSNEILLEANEWAGNLAGMASEEMDHPYQIPGRYPKGAYLLVFDPLDGSSNIDVNVSVGTIFSVLRCPSEYLNQNDTLREEAFLQPGTTQVAAGYAIYGPQTMLMLTLGNGVKGFTLDRELGSFVLTHDNISVPESTAEFAINMSNQRHWEAPVKRYVEELLAGKEGPLGKNYNMRWIASMVADVHRILTRGGVFMYPRDAREPEKPGKLRLMYEANPMSFIIEQAGGAATNGTQRILDIKPENLHQRVAVFLGSKQEVERITGYHAE

SEQ ID NO: 5907 - protein, 176 aa, Pseudomonas aeruginosa
MSFNTEVQPGICMEPDAITQEYVFNHTMLRVKDPKRSLDFYSRVLGMRLLRRLDFEEGRFSLYFLAMTRGEEVPDALDERQRYTFGRQSVLELTHNWGSESDDSQYHNGNQDPRGFGHICFSVPDLVAACERFETLGVNFVKPLDRGMKNVAFISDPDGYWVEIVQASLNGEMGRG

SEQ ID NO: 5908 - protein, 142 aa, Francisella tularensis
MSKEIRYNPFELKHSINDLFDNFFSFPKSYQEEKYLENIHLDITEDEAAYNISADLAGIEEKDIDIELDKNKLSIKAKREHLDKDKKHHIQERYYGEFQRSITLPDNIDSDKIEAKYSNGVLSLNIPKKEKDNTTKKISIKS

SEQ ID NO: 5909 - protein, 283 aa, Listeria monocytogenes
MKTVKLNNGVEVPILGFGTYQITDAAEAEQAVKDAIKTGYRHIDTAQSYMNEEAVGRGIAASGVDRKELFITTKIWVENVSYKGVMSSFDRSLKRLGLDYIDLLLIHQPFNDVYGAWIAMEELQASGKIRAIGVSNFSPDRVIDLAAFNEVTPQVNQIEVNPFQQQAANLAVLRKEGVTIEAWAPFAEGKNDIFNNPVLTKIGAKYGKSAAQVILRWLVEQDIIVLAKSVKPERMAQNLAIFDFELTEADKGEIASLDQGESQFFSHADPEMVKWMASRKLNV

SEQ ID NO: 5910 - protein, 635 aa, Solanum tuberosum
MESCDCIEALLPTGDLLVKYQYLSDFFIAVAYFSIPLELIYFVHKSACFPYRWVLMQFGAFIVLCGATHFISLWTFFMHSKTVAVVMTISKMLTAAVSCITALMLVHIIPDLLSVKTRELFLKTRAEELDKEMGLIIRQEETGRHVRMLTHEIRSTLDRHTILKTTLVELGRTLDLAECALWMPCQGGLTLQLSHNLNNLIPLGSTVPIIFLLSMRFLVALKQYRFHIPNPLARMRNTVGRYIPPEVVAVRVPLLHLSSFTNDWAELSTRSYAVMVLVLPMNGLRKWREHELELVQVVADQVAVALSHAAILEDSMRAHDQLMEQNNALDDARQEAEMAIRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQILLNVAGNAVKFTKEGHISIEASVAKPEYARDCHPPEMFPMPSDGQFYLRVQVRDTGCGISPQDIPLVFTKFAEARPTSNRSTGGEGLGLAICRRFIQLMKGNIWIESEGSGKGTTVTFVVKLGICNHPNALPLLPMPPRGRLNKGSDDLFRYKQFRGDDGGISVNAQRYQRSL

SEQ ID NO: 5911 - protein, 124 aa, Brassica napus
  misc_feature (99)..(99): Xaa can be any naturally occurring amino acid
  misc_feature (115)..(115): Xaa can be any naturally occurring amino acid
  misc_feature (122)..(122): Xaa can be any naturally occurring amino acid
MEPQAEPKPIPLMTPYKMGASLDLAHRVVLAPLTRQRSYGNVPQPHAAVYYGQRATPGGMLITEATGVSDTAQGYTDTPGVWTAEQAEAWRPVVDAVHXKGALFFCLWHVGRVSXYGSQPGXAA

SEQ ID NO: 5912 - protein, 190 aa, Prunus armeniaca
GFFEVTQDVPQLTCADFLRAPGVQTPVIVRFSTVIHERGSPETLRDPRGSAVKFYTREGNFDLVGNNFPVFFVRDAMKFPDAIRAFKPNPKSHIQETWRILDFFSHLPESLHTFAFFYDDLGIPQDYRHMEGSSVHAYTLVSKAGKVHYVKFHWKPTCGVKCLLEDEAIKVGGANHSHATKDLYDSIAAG

SEQ ID NO: 5913 - protein, 201 aa, Aspergillus nidulans
MSSRKKVMLKVIILGDSGVGKTSLMNQYVNKKFSGSYKATIGADFLTKEVLVDDRLIWDTAGQERFQSLGVAFYRGADCCVLVYDVNNSKSFEALDSWRDEFLIQASPRDPESFPFVVIGNKIDMEESKRMISSKRAMTFCQSKGNIPYFETSAKEAVNVEQAFEVIARSALAQEEAEEYGGDYTDPINIHDTTERDGCAC

SEQ ID NO: 5914 - protein, 1080 aa, Desulfovibrio vulgaris
MPHSSRSAIGLQVRVSLLVLMVTMVLLAGFAFWEHTLLREAEEMQLRQETRLLADRAARLLALPLWNLDGPSARAIIQAEMDDPRVYGIAVFEQGRQLFEGMQRDASWRVVPWVGSAPPDVVEERRDLVVEGTQVGSLSIMVSPRFLAARLAERFQQAVWRYTLLAGILAVGLMLLVRSVLIAPLGRLGGVARRVTSEENFALRAPKGADDEIGELVDSFNAMLERIEQRNRLLGEQRRRLEMEVSERTAEFVGARERAERESKAMADFLAAITHEVRTPMTGIIGLLDISLRGQLEPRLREHLEIVRSSSHALLDVINGVLDFSRIEAGKLRIERIPFALRESVEDVLDLFRAHLAERDVALVLDMASDLPCKVAGDPTRLRQVLVNIVGNAFKFTEQGEIVVRISHERQGDGSVLLRFAVRDTGVGIPAEARKRLFEMFSQADASVARRFGGSGLGLAIARELVRLMGGSIEVDSTPGRGTVFRFTVHCGFVEGPSDPLPLPQGVRVVLGESHASLQRVLSGLLRRWGAEVVAVSGAAALKDAAADADVCVLSSHLQGGLAALSRPGQPGPPVLLLVPYGEEPEPSLCAGAGVVAFVGRPVRAATLRAALDAVFAPGMPDGAQATAMKGDMRAGLHIPSSRDGSGGASSAARVVEGQAVTGPMTQPGAMPSVGASGDGHDADQSVHEGGSGLEGMRVLVAEDDDVSRLVLREMLTGFGVQVNETADGATMLAHFAAAPYDVVLIDVQMPVLDGFATLERLRALPDGDTVPVALFTAQKLSVAELAERGIRVAGVVEKPLEMETLVAFLRGLRAVKGQGRHDVAGADAAPRMAGQEHGESAVTDATLSPNAATLISGETLVLGGTADGAATRGVGVPGMAAVAEVIASGGHETETSSSTSDANASSFESGAATPSSIPGDGASSHMPDAEASSVPAGVADVSAVAATTTSRSRAPRRLAGPPLPTALEGVDIGEVLTRVGGKEWLLLKVLRSFVTAYADAADGLAAMVEAGDDEAVKLRGHTLAGAAGNISAHELRAICLALEMGGDKSTQQSLVAAFRGELDRVVTSIREMLARYEEP

SEQ ID NO: 5915 - protein, 995 aa, Gibberella zeae
MAQSPMISVPLKATNEIDWVEPLKRYIRDTYGDDPERYAEECATLNRLRQDVRGAGKDSTSGRDMLYRYYGQLELLDLRFPVDEQHIKISFTWFDAFTHKSTAQYSLAFEKASIIFNISAVLSCHAAAQDRGEESALKTAYHNFQASAGMFTYINENFLHAPSSDLSRETVKALIHVMLAQAQEVFLEKQVADKKKPALLAKLASQAGYLYSQALEGVQENVTKAIFEKVWLLMTQIKSNLLNSMAQYYQALADEEQDKHGIAVGRLQTAETQAKEAERVARSFPNSVPMSSNLSADCGGFLQELTKRHLSTVQSQLQSALKDNDYIYHKEVPAEASLEAVAKLPAAKPIPVSELYAGQDIQRITGPDLFAKIVPFAVTESASLYDEEKAKLVRAEAERVDTANGEMAASLDYLRLPGALQVLKGGFDQDILPDEDFRQWCEDVSDQENPVTLFDSLRTEKDSILSILDKSTKQLDMEEGVCEKMRSKYENEWTQQPSSRLTTTLRGDIRHYREALDEASRSDNQLAGKLRQNEMDFDEMRRAAKSGEADQLFQRAVAQARARGSNATSPAGLEPNLLDDDFDEGPSVIDQINRVEDILKKLNSIKRERNQVLKDLKEKAHNDDISQILILNKKSISNYEAQLFEQELEKFRPHQNRLLQANHKQSALMKELTSAFNRLLQDKRVQSEQSKYETIQRQRSSVINRYKRAYQEFLDLVAGLQSAKNWYAEMRETVESLEKNVDSFVNNRRSEGAQLLNQIEQERSSNKNSQAEMERERLRGLMDRMSMDPNKSSPQPQQNRPTPPSQYQQSQAPRYPQTNYQGQYQQPNSPPPQQAQQQAYQNFSPPPTTTTTQSFGPPPINTFVQPTYNPSQYGRTPGPTSPPPNQTSFNIGGYRGPASPPPNQSTFGQSQSFGGYGASSTPQTQGGYVPPGFVPPPPPPGPPPLGPQQTFHYGNQPNSAHPNSAYPQSAMPPQQQQQQQQQQQNDPWAGLNAWK

SEQ ID NO: 5916 - protein, 280 aa, Listeria monocytogenes
MTLSFSDTYRLNNGIEMPRHGFGVYKLTDEARMRTALETAVDVGYRLFDTASFYHNEKELGDFFASSGLKRDEFFVTTKMWNTEQGYDETLRAFEKSQKKLQLDQIDLYLVHWPKQDTFFDTWRAVEKLYDEGLVRAIGVSNFEAHHLDRLRTSANVLPVVDQLETHPHFPNHLLHRYLEELHIVHQAWSPLGRGGVLQEQILIDLAEKHGKSPAQIVLRWHLQNNISIIPKSETPSRIRENAAIYDFELSEADMRQVERLNTGERVSHAPDVMYVRSEI

SEQ ID NO: 5917 - protein, 210 aa, Unknown
  Brownea sp. Lavin 6225
YDRVMAYKFHEDDHGEVIAEITKPDMEPYLGLHYPATDIPQAARFLFMKNKVRIIVDCRAKHVKVLQDEKLPFDLTLCGSTLRDPHSCHLQYMENMNSVASLVMAVVVNDNDEDGDSSDSVQPQKRKRLWGLVVCHNTTPRFVPFPLRYACEFLVQVFAIHVNKELELEYQIVEKNILRTQTLLCDMLMRDAPLGIVSQGPNIMDLVKCD

SEQ ID NO: 5918 - protein, 508 aa, Haemophilus influenzae
MSSQCPFSHLAATNLTMGNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDLVGNNTPVFFLRDPRKFPDLNKAVKRDPRTNMRSATNNWDFWTLLPEALHQVTVVMSDRGIPASYRHMHGFGSHTYSFWNEAGERFWVKFHFRTQQGIKNLTDAEAAEIIANDRESHQRDLYEAIERGDFPKWTLFVQIMPEADAEKVPYHPFDLTKVWPKKDYPLIEVGEFELNRNPENFFADVEQSAFAPSNLVPGIGASPDRMLQARLFNYADAQRYRLGVNYRQIPVNRPRCPVHSNQRDGQGRVDGNYGSLPHYEPNSFSQWQQQPDFAEPPLRINGDAAHWDYRNDDKDYFSQPRALFNLMNAEQKQSLFNNTAAAMGDAPDFIKYRHIRNCHWCDAAYGEGVAKALGLTVEDALKARDTDPALGQGGLL

SEQ ID NO: 5919 - protein, 480 aa, Arabidopsis thaliana
MASRTTPSRSTPSRSTPSGSSSGGRTRVGKYELGRTLGEGTFAKVKFARNVENGDNVAIKVIDKEKVLKNKMIAQIKREISTMKLIKHPNVIRMFEVMASKTKIYFVLEFVTGGELFDKISSNGRLKEDEARKYFQQLINAVDYCHSRGVYHRDLKPENLLLDANGALKVSDFGLSALPQQEDGLLHTTCGTPNYVAPEVINNKGYDGAKADLWSCGVILFVLMAGYLPFEDSNLTSLYKKIFKAEFTCPPWFSASAKKLIKRILDPNPATRITFAEVIENEWFKKGYKAPKFENADVSLDDVDAIFDDSGESKNLVVERREEGLKTPVTMNAFELISTSQGLNLGSLFEKQMGLVKRKTRFTSKSSANEIVTKIEAAAAPMGFDVKTNNYKMKLTGEKSGRKGQLAVATEVFQVAPSLYMVEMRKSGGDTLEFHKFYKNLTTGLKDIVWKTIDEEKEEGTDGGGTNGAMANRTIAKQST

SEQ ID NO: 5920 - protein, 450 aa, Zea mays
MDIKDMKTRGKTLTERYEMGKLLGKGAFGKVHYARDLESNQGVAIKIMDKDRVLKAGLSEQVKREITTMRLVEHKNIVRLHEVMATRNKIYIIMEYAKGGELLDKVKRSGRLTEADTHRYFQQLIGALDHCHSRGVYHRDLKPENLLLDENGDLKVSDFGLSAFSESRRTDGLLHTVCGTPVYIAPEVIKKTGYDGAKSDIWSCGVVLFVLAAGYLPFQGPNLMEIYRKIHDRDFRCPSWFSHKLKRLLYKILNPNPSMRPSIQEIKESTWFRKGPREISAVNEKVLSENATTTNAAPVLASRRKEIAHEDMKSLVATNLNAFEIIALSAGLDLSGLFIKECRKETRFTSDKPALAIIAKLEDVAKALNLRIRKKDNNTVSIQGRKEGGNGVLKFDTQIFEITPSCHLVQIKQTSGDLLEYEKLLEEGIRPGLKDVVSAWHGDDLQQKQK

SEQ ID NO: 5921 - protein, 368 aa, Bdellovibrio bacteriovorus
MTNKRIEWPVALFLVLNPLITLILAPIYFYNFGFQWDILLFALVFAAATNLGITAGYHRLFSHKSYDAHPIVKALFLLIGASAFQGSALKWSSDHRRHHTHIDGEKDPYNINEGFWYAHMGWMFFKDSVDQKIHAPDLEKDWMVKFQNDHYVPIAILTGFIFPMLVGWAMGSWLGGLVIAGGLRIALTQQSTFFINSLCHTLGKQTYSKEISARDSWFVAILTHGEGYHNFHHKFQIDYRNGIKWYHWDPTKWVIRTLSAMGLATKLRQISNVEILKARLQAEAAELTKHGFAEEKLAQMKEKILEAQNRMKKLREDYEQFKVDAVRKREELKEAYDHKLEELRRDMEIARLEFQMGMKQWRVYLRSV

SEQ ID NO: 5922 - protein, 150 aa, Betula pendula
GVKCLLDDEAIRVGGANHSHATKDLYDSIGAGNYPEWKLYIQIIDPDHEDKFDFDPLDVTKIWPEDILPLQPVGRLVLNKNIDNFFAENEQLAFCPSIVVPGVYYSDDKLLQTRIFSYSDTQRHRLGPNYLQLPANAPKCAHHNNHHEGF

SEQ ID NO: 5923 - protein, 565 aa, Sorghum bicolor
MALLLASAINHTAHPAGLRSHPNNESFSRHHLCSSPQNISKRRSNLSFRPRAQTISSESAGIHRLSPWEIPRRDWFPPSFLFGAATSAYQIEGAWNEDGKGPSTWDHFCHNFPEWIVDRSNGDVAADSYHMYAEDVRLLKEMGMDAYRFSISWPRILPKGTLAGGINEKRVEYYNKLIDLLLENGIEPYITIFHWDTPQALVDAYGGFLDERIIKDYTDFAKVCFEKFGKKVKNWLTFNEPETFCSVSYGTGVLAPGRCSPGVSCAVPTGNSLSEPYIVAHNLLRAHAETVDIYNKYHKGADGRIGLALNVFGRVPYTNTFLDQQAQERSMDKCLGWFLEPVVRGDYPFSMRVSARDRVPYFKEKEQEKLVGSYDMIGINYYTSTFSKHIDLSPNNSPVLNTDDAYASQETKGPDGNAIGPPTGNAWINMYPKGLHDILMTMKNKYGNPPMYITENGMGDIDKGDLPKPVALEDHTRLDYIQRHLSVLKQSIDLGADVRGYFAWSLLDNFEWSSGYTERFGIVYVDRENGCERTMKRSARWLQEFNGAAKKVENNKILTPAGQLN

SEQ ID NO: 5924 - protein, 734 aa, Agrobacterium tumefaciens
MKKPLNSAEEKKTGDITKAEIEAIKSGLHSNPFQIIPLHETPEGFSARCFIPGAEEVSVLTLDGNFVGELKQIDPDGFFEGRIDLSKRQPVRYRACRDDAEWAVTDPYSFGPVLGPMDDYFVREGSICGYSTGWARIPLKLEGVEGFHFAVWAPNGRRVSVVGDFNNWDGRRHVMRFRKDTGIWEIFAPDVYACAYKFEILGANGELLPLKADPYARRGELRPKNASVTAPELTQKWEDQAHREHWAQVDQRRQPISIYEVHAGSWQRSEDGTFLSWDELEAQLIPYCTDMGFTHIEFLPITEHPYDPSWGYQTTGLYAPTARFGDPEGFARFVNGAHKVGIGVLLDWVPAHFPTDEHGLRWFDGTALYEHADPRQGFHPDWNTAIYNFGRIEVMSYLINNALYWAEKFHLDGLRVDAVASMLYLDYSRKEGEWIPNEYGGRENLESVRFLQKMNSLVYGTHPGVMTIAEESTSWPKVSQPVHEGGLGFGFKWNMGFMHDTLSYFSREPVHRKFHHQELTFGLLYAFTENFVLPLSHDEVVHGKGSLIAKMSGDDWQKFANLRSYYGFMWGYPGKKLLFMGQEFAQWSEWSEKGSLDWNLRQYPMHEGMRRLVRDLNLTYRSKAALHARDCEPDGFRWLVVDDHENSVFAWLRTAPGEKPVAVICNLTPVYRENYYVPLGVAGRWREILNTDAEIYGGSGKGNGGRVQAVDAGGEIGAMLVLPPLATIMLEPEN

SEQ ID NO: 5925 - protein, 738 aa, Zea mays
MVPEGENDGLASRADSAQFQSDELEVPDISEETTCGAGVADAQALNRVRVVPPPSDGQKIFQIDPMLQGYKYHLEYRYSLYRRIRSDIDEHEGGLEAFSRSYEKFGFNRSAEGITYREWAPGAFSAALVGDFNNWDPNADRMSKNEFGVWEIFLPNNADGTSPIPHGSRVKVRMDTPSGIKDSIPAWIKYSVQAPGEIPYDGIYYDPPEEVKYVFRHAQPKRPKSLRIYETHVGMSSPEPKINTYVNFRDEVLPRIKKLGYNAVQIMAIQEHSYYGSFGYHVTNFFAPSSRFGTPEELKSLIDRAHELGLLVLMDVVHSHASSNTLDGLNGFDGTDTHYFHSGPRGHHWMWDSRLFNYGNWEVLRFLLSNARWWLEEYKFDGFRFDGVTSMMYTHHGLQVTFTGNFNEYFGFATDVDAVVYLMLVNDLIHGLYPEAVTIGEDVSGMPTFALPVHDGGVGFDYRMHMAVADKWIDLLKQSDETWKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDLGDADYLRYHGMQEFDQAMQHLEQKYEFMTSDHQYISRKHEEDKVIVFEKGDLVFVFNFHCNNSYFDYRIGCRKPGVYKVVLDSDAGLFGGFSRIHHAAEHFTADCSHDNRPYSFSVYTPSRTCVVYAPVE

SEQ ID NO: 5926 - protein, 470 aa, Streptococcus pneumoniae
MENLQVKALPKEFLLGTATAAYQVEGATRVDGKGINMWDVYLQENSPFLPDPASDFYYRYEEDIALAAEHGLQALRLSISWVRIFPDIDGDANVLAVHYYHRVFQSCLKHNVIPFVSLHHFDSPQKMLETGDWLNRENIDRFIRYARFCFQEFTEVKHWFTINELMSLAAGQYIGGQFPPNHHFQLSEAIQANHNMLLAHALAVLEFHQLGIEGKVGCIHALKPGYPIDGQKENILAAKRYDVYNNKFLLDGTFLGYYSEDTLFHLNQILEANNSSFIIEDGDLEIMKRAAPLNTMFGMNYYRSEFIREYKGENRQEFNSTGIKGQSSFKLNALGEFVKKPGIPTTDWDWNIYPQGLFDMLLRIKEEYPQHPVIYLTENGTALKEVKPEGENDIIDDSKRIRYIEQHLHKVLEARDRGVNIQGYFIWSLQDQFSWANGYNKRYGLFFVDYETQKRYIKKSALWVKGLKRN

SEQ ID NO: 5927 - protein, 271 aa, Oryza sativa
MEAATPTRPPHAAPSSSPSPSPASLRQWRPAAQRNLRNQWSRLLAAKARYMPGMDLGVLKDMPGIREKASGKLARREEQCQSMLLSAYREMVLATAELVRASHSMRCFSKVAANSPLIRFTERQDDMNDSGDGGGSPVFKWFSVLEFENLAQELVDMFISELQLKRLLVLELLSVTFKEGVQHDASLEWSNELFDGEFNEFQSIGLLSGDSYALPKNWSAGVSKAWQPDQTPSHEVLQVYLTSWLANVNIKTSRIDEIFELVGEEMQIKLS

SEQ ID NO: 5928 - protein, 186 aa, Triticum aestivum
IRGVTFSTNVSPQIENRILYAARGLFNKFIPDVHIFTDHRAGLSGGLSAGYGVSVVAETTTGCLISADATVSYPNVDEMSEQSKKPELMSPEDLGEQVASMLLHAAAQGGVVDSTHQGLLFMLCALCPPDVSKVRVGQLTPHAIESLRNIKEFLDVKFIIKPDPNSNTVSLKCVGAGVKNLARKIS

SEQ ID NO: 5929 - protein, 948 aa, Colwellia psychrerythraea
MHKISLKDWVIILTIIPTTLIGFGLASYFSYSRSVELNDFLEQRAKSIIEPIAIASKDPLLSKNRDKLRQLIGFTHRNQSSIVKSIVIFTEDNQVFVTSAYHGDTNLMRLKAGVELPHHTNTETLSDYIIFRTPIIDENYNNQSNANITAMASSEYNYATNNSKPVIIGYIAMQIDKSHLNFQQQSQFIVAFAFALLGSLLSAIFAIRLIKKVTKPINSMVQAIERIREGKLESRVSGQLIGELNFLKNGINAMAQSLDGYQNEMQASIDQATIDLRESLEQFEIQNVELSISKRKAQEANRVKSEFLANMSHELRTPLNGVIGFTRQVLKTPLTENQRDYLQTIDRSANNLLTIINDILDFSKLDAGKMVTENIPFSLRESIDETLTLLAPSAHKKNIELSINLPQELPDSLVGDTMRIKQIITNLVSNAIKFTPQGSVAVDITSEEISQNNIKLKVIVTDTGIGMTTNQQRTIFDAFTQADQSITRLYGGTGLGLVICQRLAQEMNGDIGFSSEKNHGSSFWFTFQCEINAMPLMLELDNQHLANKTVLYFEENNHSREATKNLLKHWKMRVTSVINRHELSQVLSHSSQTQRGFDYALIGHNQTATALSELKKTIAQVQPISSNIHLALNNTSPSLQEALIASGAISCMSKPLSPTTLSRVLQPVMETKAEKLTLNAAMDKVLPIKVLAVDDNEANLKLIKALLLEQVAEVVEADNGMSAVELCKVENFSLIFMDIQMPIMDGISALKEIKQLTNNNNTPIIAVTAHALSGEREKMHQQGFNAYMTKPIDETMLRHIIYEYCDFDHLVNSTVPVISTDVINQVESASKVIDWPLALKRSANKADLAKEMLLGLVESLPETQLSIREAIDVQDIAQIKRLVHKLNGACCYTGTPNLAKITIQLETQLKMGLSTEELEPEFLEFFEHIEQVLFAVPEALKEMSENSH

SEQ ID NO: 5930 - protein, 442 aa, Rickettsia typhi
MLLRFIIALFFSINCVVEGKETENKISNQEAYKQFQDVFERIEKDYVQVPDRQKMIDEAINGMLNSLDPHSNYYTDEDLEDIFTFTKGEFGGIGVEIMYDSGAIKIISSIDDLPAFKAGLKGGDYIVGVNDELVSTLGPNKAIKEMRGTPGTKVRLLIIKEEEAKPQELELTREIVKIKPIKAHLEKNNIAYIRITTFNESTISELKAAVKKLKTESKDNLKGIILDLRNNAGGILDQAIAVSDYFIDSGVIVTTKGRTTSSNSETKANEFSLKAPRVPMIVLINGNSASASEIVAGALQDHKRAIILGTKSFGKGSVQALTQINSRAAVKLTISKYYTPSGRSIQAEGIEPDILIEPAKVEYPEVKKIDKRFSESSLKNYLKNDNEKNKDSKKETKAKNNKQEESELSELYKKDYQFARAYDVITGLIINMNLETQENAKQ

SEQ ID NO: 5931 - protein, 1035 aa, Desulfovibrio vulgaris
MYEGWEASRLPSQGESLNMPGMTYDQRTESTGPQVKDEAAGSAEVQALRERIARLEDENRLLRLCARFEGPAPGEALGSLLPEIIAPASDAPLVYAYVSDMQTHELLFVNRSLTMAVGAWQGRKCYELLQGRDTPCPFCTSGRLQRNPERPVVWEWRNPRLGRWFRCIDRCIHWPDGRPVRYELAVDITDMREAQEDLLRFRAALDASAEAIFLVDLEEGRFLDVNSGACTMLGYDRDTLLGLGLCGIRRSMAADGCRQILDSIAAGAVLENVETVYLHRDGTFVPVEVGARLVDRVGGPRLAIMVARDVSEKRKARRAMEVRYLYEHVLSSCARELLSRSCSESTLVGVLGALRQGAGACRAYIFENYEDAEGRLCCSQRYESSAPGVRPELDNPALQNIIYASEAPNWLHELRKGRAVVGPVADQPLPERDVLQAQGIRSLLVLPIFARGVWCGFVGFDDTRTERTWQGGDILFLQTASEILGAALERHRAEAELAASHQRAEEASRAKSVFLANMSHEIRTPLNAIIGLTELTLQEPISQGVGENLRGVLHSAEALLAVVNDLLDLSRVESGRLHLESVEFSPSRLARGVVRLMTHVADRKGLDFELYIARDVPPTVTGDPARLRQVLLNLVGNALKFTDEGGVSLTVTPCICSTDTGGGILKGGNGGVRGLRFTVTDTGIGIPPDRQACIFESFVQADESTARRFGGTGLGLAISRRLVEMMGGRLELRSEPGKGSEFWCDVPFASEGAARDGICEVACVATPDAPSGTGRRPEGRGAGDRRLEAAPLRILVVESDPLCRRAMVKSLGRRGHAVTALSALSEAAEVLVAERHDAVVVEATPGAWAFCESLRQGGYGANRAALPLVFICDGDTFLPESVEPLAAPHALLSRPVKGRALCEAVEHLAGADAGQPASERVALPEDVPLLQPGALLLTAPDAQMRFVRQVPSLRESLWSAMDRGSRVELASLAHLLRHEAEGIGALRLQVLAERLEDRVRIGATEDARPVFMLLADALNQLEHDLRKLVPALSED

SEQ ID NO: 5932 - protein, 641 aa, Listeria innocua
MKFNSMFSPIDIGPMRVPNRFVVSPMCNNYANTDGTLTDTSLAYYKERALGGFGLITFEATVVDVRAKGGANKACLYSDHQIASFKRVIDACHDAGAKISVQLQHAGPEGNSKVSGYPLKAASAIASAEGRNTPEAISREELYELIELYGEAALRAKKAGADAVEVHCAHGYLVSSFLSGRTNKRVDEFGGCFENRMRLPRLIIESIRKRVGHSIAILCRINSTDGVDGGLSVQDSATVAAYLEDCGLDGLHVSRSVHIRDEYMWAPTVLHAGFSSDLVTQIKRAVSIPVITVGRFTEPHYAELMVREGRADLVAFGRQSLADPETPNKAAAGKLDELLPCIACLQGCVANMYAGKPITCLVNPLLGRESEAYLPKTPSKKVVVIGGGVGGLYAGWMAGSRGHDVTVYEASDIIGGQMRLAAYPPGKGDLTNMVRSYIKKCEQFDVEIKTNTPVTPELIQDIAPDAVIIATGATPLVLPIPGIEDSGLIHAVDLLDGKESCGKKVLVVGGGMVGSETAAFLGEAGHDVTVVELRDEVGADVISEHRKFLMRDFDEYKIKSITNAKVTSFLPDGVTYSLADEKEYRIDGFDSVVLAMGSRAYNPLEEAIKKIVPETYVIGDAVRARRALDATKEALDAVLQL

SEQ ID NO: 5933 - protein, 239 aa, Triticum aestivum
MAVEAVLEAATMIPSPPSKEMEASSSTSEEASALLGQAEGWSKRKRSRRQRALDPSEEEYLALCLLMLAHGHRDSAPAAAPEQQHGCSVCGKVFASYQALGGHKASHRKPTAAPAGAEDQKPLAAVAAASSSGSGEAAVSAGGGKVHECNVCRKTFPTGQALGGHKRCHYDGTIGSAAAGPTQKLAAKAAAASATAASQGFDLNLPALPDIPERCAVTEDGEEVLSPASFKKPRLMLAA

SEQ ID NO: 5934 - protein, 486 aa, Lactobacillus plantarum
MYKPTYPKTFPKDFLWGGATAANQVEGAWNEAGKGLTTAEVVKKTTDRKHMSMDDVTISSIQTALDDQTDTMYPKRRGVDFYHHYKEDIKLFAEMGFKVYRFSIAWSRLFPKGDELKPNSDGLAFYDRVIDELRRYHIQPLVTLSHYEMPIGLTLKQNGWASRATIADFNRFTEVVFKHFKGRVPYYLTFNEINTGTWGFHATGAVDTENSAHDQMQLRYQALHHQFIASALATKQLHAIDPDAKIGSMLARMQTYPATPNPADVQAAQVEDDKNLFFTDVQARGEYPEFMNRFFAENDIQLQMAPDDQTILAKYPVDFISFSYYMTTVTQADAPEQVNGNMATGGRNPYLEESDWGWQIDPVGLRVTLNEMWDRYRKPLFVVENGLGALDQLTTDQQVHDTYRIDYLRKHIAQMKAAVQDGVQLMGYTMWGPIDLISFSTSEMSKRYGFIYVDQDDAGKGSLKRYKKDSFYWYQKVIKSNGEDLA

SEQ ID NO: 5935 - protein, 508 aa, Haemophilus influenzae
MSSQCPFSHLAATNLTMGNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDLVGNNTPVFFLRDPRKFPDLNKAVKRDPRTNMRSATNNWDFWTLLPEALHQVTVVMSDRGIPASYRHMHGFGSHTYSFWNEAGERFWVKFHFHTQQGIKNLTDAEAAAVIASDRESHQRDLYEAIERGDFPKWTLFVQIMPEADAEKVPYHPFDLTKVWPKKDYPLIEVGEFELNRNPENFFADVEQSAFAPSNLVPGIGASPDRMLQARLFNYADAQRYRLGVNYRQIPVNRPRCPVHSNQRDGQGRVDGNYGSLPHYEPNSFSQWQQQPDFAEPPLRINGDAAHWDYRNDDNDYFSQPRALFNLMNADQKQSLFNNTAAAMGDAPDFIKYRHIRNCHWCDAAYGEGVAKALGLTVEDALKARDTDPALGQGGLL

SEQ ID NO: 5936 - protein, 176 aa, Callerya atropurpurea
YDRVMAYKFHEDDQGEVIAEVTKPGLEPYLGLHYPATDIPQATRFLFMRNKVRMIVDCSAKHVKVHQDKNIPFEGTLCGSTLRAPHSCHLQYMENMNASASLVMAVVVNDDEEDEDSAGDVEPQKRKRLWGLVVCHHITPRFVPFPLRYACEFLAQVFAIHVNKEIELEYQIIEKE

SEQ ID NO: 5937 - protein, 565 aa, Sorghum bicolor
MALLLASAINHTAHPAGLRSHPNNESFSRHHLCSSPQNISKRRSNLSFRPRAQTISSESAGIHRLSPWEIPRRDWFPPSFLFGAATSAYQIEGAWNEDGKGPSTWDHFCHNFPEWIVDRSNGDVAADSYHMYAEDVRLLKEMGMDAYRFSISWPRILPKGTLAGGINEKRVEYYNKLIDLLLENGIEPYITIFHWDTPQALVDAYGGFLDERIIKDYTDFAKVCFEKFGKTVKNWLTFNEPETFCSVSYGTGVLAPGRCSPGVSCAVPTGNSLSEPYIVAHNLLRAHAETVDIYNKYHKGADGRIGLALNVFGRVPYTNTFLDQQAQERSMDKCLGWFLEPVVRGDYPFSMRVSARDRVPYFKEKEQEKLVGSYDMIGINYYTSTFSKHIDLSPNNSPVLNTDDAYASQETKGPDGNAIGPPTGNAWINMYPKGLHDILMTMKNKYGNPPMYITENGMGDIDKGDLPKPVALEDHTRLDYIQRHLSVLKQSIDLGADVRGYFAWSLLDNFEWSSGYTERFGIVYVDRENGCERTMKRSARWLQEFNGAAKKVENNKILTPAGQLN

SEQ ID NO: 5938 - protein, 565 aa, Sorghum bicolor
MALLLASAINHTAHPAGLRSHPNNESFSRHHLCSSPQNISKRRSNLSFRPRAQTISSESAGIHRLSPWEIPRRDWFPPSFLFGAATSAYQIEGAWNEDGKGPSTWDHFCHNFPEWIVDRSNGDVAADSYHMYAEDVRLLKEMGMDAYRFSISWPRILPKGTLAGGINEKGVEYYNKLIDLLLENGIEPYITIFHWDTPQALVEAYGGFLDERIIKDYTDFAKVCFEKFGKTVKNWLTFNDPETFCSVSYGTGVLAPGRCSPGVSCAVPTGNSLSEPYIVAHNLLRAHAETVDIYNKYHKGADGRIGLALNVFGRVPYTNTFLDQQAQERSMDKCLGWFLEPVVRGDYPFSMRVSARDRVPYFKEKEQEKLVGSYDMIGINYYTSTFSKHIDLSPNNSPVLNTDDAYASQETKGPDGNAIGPPTGNAWINMYPKGLHDILMTMKNKYGNPPMYITENGMGDIDKGDLPKPVALEDHTRLDYIQRHLSVLKQSIDLGADVRGYFAWSLLDNFEWSSGYTERFGIVYVDRENGCERTMKRSARWLQEFNGAAKKVENNKILTPAGQLN

SEQ ID NO: 5939 - protein, 477 aa, Listeria monocytogenes
MTESKFPKDFLWGGAVAANQCEGAYLEDGKGLSLVDILPTVEDGRWEALFNPSKALATDYGFYPSHESIDFYHRYKEDIKLMAEMGFKCFRMSISWPRIFPNGDETTPNEKGLAFYDAVFDECHKYGIEPVVTINHFDTPLEVFKKYGGWKNRKCIDFYLNFCEAIFTRYKDKVKYWMTFNEINMILHLPYIGGGLDVTKEDNPEEVKYQAAHHQLVASALATKLGHEINPENQIGCMLAAGNTYPMTCNPKDVWKSIEADREGYFFIDVQARGYYPSYTKRFFKEHNINIKMEDGDLDALRDHTVDYVAFSYYSSRLTSADPEKNKETEGNVFATLKNPYLKASEWGWQIDPLGLRITMNTIYDRYQKPLFIVENGLGAVDTVEEDGSITDDYRIDYMREHVREMGEAIEDGVELLGYTPWGCIDLVSAGSGEMKKRYGFIYVDRDNKGNGTLNRSKKKSFDWYKKVIETNGKDID

SEQ ID NO: 5940 - protein, 668 aa, Zea mays
MTASQSSMSGGGEPGVRTVVWFRRDLRVEDNPALAAAARTAGEVVPAYVWSPEEDGPYYPGRVSRWWLSQSLKHLDASLRRLGACRLVTRRSSDAVVALIDLVRSTGATHLFFNRLYDPLSLVRDHRVKEQLSAEGITVQSFNADLLYEPWEVLDDDGFPFTMFAPFWNRCLCMPDPAAPLLPPKRINSGDLSRCPWDELIFEDESEKGSNALLARAWSPGWQNADKALTAFLDGPLVDYSANHKKADSASTSLLSPYLHFGELSVRKVFHQVRMKQLMWSNDGDRAGEESCTLFLRAIGPAGVLEVWRQGRTGYPLVDAGMRELWATGWVHDRIRVVVSSFFVKVLQLPWRWGMKYFWDTLLDADLESDALGWQYISGSLPDGRELDRIDNPQFEGYKFDPHGEYVRRWLPELARLPTEWIHHPWDAPESVLQAAGVELGSNYPRPIVELDAANSRLQGALSEMWELEAASCAAIENGMEEGLGDSTDEPPIDFPQELRMEVDRQPAQPAIIHTPVVAGWRREDQRVPSMTSSLIRAETELTADFGNTSEDSRPEVPSNIHLQARAEREETVDGATGNTVRVNGNQQQQNLQNNMHRVLGIAPSISEASSSWTGREGGLVPVWSPPAASVHSDPYTADEADISSRSYLDRHQQSNTMMNWSQLSQSL

SEQ ID NO: 5941 - protein, 512 aa, Zea mays
SARVGSQNGVQMLSPSEIPQRDWFPSDFTFGAATSAYQIEGAWNEDGKGESNWDHFCHNHPERILDGSNSDIGANSYHMYKTDVRLLKEMGMDAYRFSISWPRILPKGTKEGGINPDGIKYYRNLINLLLENGIEPYVTIFHWDVPQALEEKYGGFLDKSHKSIVEDYTYFAKVCFDNFGDKVKNWLTFNDPQTFTSFSYGTGVFAPGRCSPGLDCAYPTGNSLVEPYTAGHNILLAHAEAVDLYNKHYKRDDTRIGLAFDVMGRVPYGTSFLDKQAEERSWDINLGWFLEPVVRGDYPFSMRSLARERLPFFKDEQKEKLAGSYNMLGLNYYTSRFSKNIDISPNYSPVLNTDDAYASQEVNGPDGKPIGPPMGNPWIYMYPEGLKDLLMIMKNKYGNPPIYITENGIGDVDTKETPLPMEAALNDYKRLDYIQRHIATLKESIDLGSNVQGYFAWSLLDNFEWFAGFTERYGIVYVDRNNNCTRYMKESAKWLKEFNTAKKPSKKILTPA

SEQ ID NO: 5942 - protein, 664 aa, Clostridium perfringens
MGGKEMRNCKELKHEKNGNVTEKVGKNKGKSKKVSKDESLLSFDLFLEGKEHSAYKFMGAHFITENRKRGVRFTTWAPRASKIYVIGDFNNWELKEEYSMKKINERGIWSLFLPKLEEGIKYKFAVVNECGNNTVYKADPYAFKSELRPNTASVLTKIKSFRWGDKRWLNKREKEGLDNKPMNIYELHLGSWKRKDGEFMTYEEISEVLVEYIKEMGYTHVEFMPINEHPLDASWGYQGVGYYSVTSRYGDLNGLKTLINKLHKNNIGVLLDWVPSHFCKDEHGLFMFDGSPTYEYEAWWKANNEGWGTCNFDLGRPEVKSFLFSNAMYWINEFHVDGLRVDAVSNMLYLDYGREYGEWEPNIYGGNGNLEAIAFLKELNTIIKKEGKGAITVAEESTSWEGITKPVEEDGLGFDYKWNMGWMNDTLSYIELDPIYRKYHHNKMNFSMMYNYSEKFILPISHDEVVHGKKSLINKMWGDDWKKYAGLRVYASFMMGHPGKKLMFMGCEFGQFVEWREWEELQWNVIEEFDIHRKTKEYFKALNKFYLENSSLWSLDYEEEGFKWIDADNSEESVLSFIRIGKNKKEKLIFICNFTPEVYYDFKVGVPELGEYVEAFNSDALEFGGAGNIVGDSILKATEESFKDFDYSISVKVPPLGTLVLKVK

SEQ ID NO: 5943 - protein, 505 aa, Rhodococcus equi
MTSIQPRPTTNDFGIPVNSDNESLTAGTQGPILLHDHYLIEKLAHFNRERVPERVVHAKGGGAFGELVITGDVSKYTKAKFLQPGKKTESLVRFSTVAGEQGSPDTWRDPRGFAMKFYTEDGNYDLVGNNTPVFFIKDPIKFPDFIHSQKRLPGSGLRDHNMQWDFWTLSPESAHQVTWLMGDRGIPNTWRHMNGYSSHTYMWVNAQGERFWVKYHFKTDQGIEFFTQDEGDQMAAMDTDYHQRDLWEHIDGGDYPTWTLKMQIMPYEEAKTYRFNPFDLTKVWPHADYPLIDVGTMKLDRNPADYHCEIEQAAFEPSSSVPGTGPSPDKMLLGRWFSYPDAHRYRIGSNYKELPVNSPHAGPRNSYTKDGQLRHHNPGDPVYVPNSKGGPHADISVSGESPGWYTDGEMVHQAYTLRKDDDDWGQAGTMVRDVLDDAARERLVSNIVGHLLNGVTEPVLVRAFDYWRNVDKDLGERVEKGVRTAQNGNASSDRNPASPAAEAKA

SEQ ID NO: 5944 - protein, 382 aa, Picea glauca
MSALVLSLAFSTPARGGGESRFAEGKALRRRLNASSCNASSKNAQLMCERRILSWCYGIRRRNSAGLWGKATRVQVSAVAEEEGGRILLSDVVVKKKRKPFLLELREWSLGDIGAAGTVFGMHALCLLAPFTFTWKAFGVFAVLYVVTGLLGITLSYHRNLSHRSFRLPKWLEYLFAYCGVQAVQGDPLDWVSTHRYHHEYCDSVKDPHSPNEGFWYSHMSWMFDEKTMFDRVGTRNNVSDLEMQPFYRFIRDTYIIHPIAMGLLLYALGGPPFVIWGMAVRIVWVYHITWLVNSAAHVWGYQAWNTGDLSRNNWWVAALAFGEGWHNNHHAFQYSARHGLEWWQFDPTWYVIKILEALGLAKDVRAPLEQHKTRMSSKPGL

SEQ ID NO: 5945 - protein, 462 aa, Cytophaga hutchinsonii
MILSEPKASLEKDASTLYAYKKQLDASFVWGVSASAYQTEGAYNIDGKGPSIWDTFTNENKNKIKDRKNANIACDFYSRYEDDLKLMQSLGINHFRFSISWSRILPSGTGEINPAGIAFYDRLIDTCLRYGITPWVTLYHWDLPQALEKRGGWTNREVVNWFTGYVAICVKHFGDRVQHWMVMNEPMVFVGAGYFLGLHAPGRRGMKNFLPAIHHAVLSMCEGARAIKSIYPNATVGTTFSCSHIEPYRNIEKDHLAAYKVDALLNRMFIEPTLGMGYPIDTLKPLQNIHQYILPGDEYKMKYDFDFIGVQNYTREFVKHSWFTPYLNARLITAPNRKVPHTLMNWEVYPESIYHMIRKFDAYPGIKKILITENGAAFEDTHHESLISDHLRTTYLQDHIEQVLRARAEGSKVDGYFVWTWTDNFEWAEGYHPRFGLIYTDFKNQNRIVKESGLWYGSFIRE

SEQ ID NO: 5946 - protein, 412 aa, Trichodesmium erythraeum
MKKRFLQIPLLLILPILLSWGLWISSATALTEEQGLLGEAWRIVNLAYVDDSFNHQNWWFVRQNLMKKPLTTREETYSTIQEMLASLEDPFTRLLKPQQYRNLQVDTSGELTGVGLQIALDSQTGELIVISPLEGSPAETAGIQAGDRVVKIDGHPTTEFSLDEAANRMRGTVGSPVILTILKESRDQPQDITIIRDQIEINPVYAKLKSNSQAGPIGYIRLSQFNANATAEISQVIESFEQKGAIGYILDLRNNPGGLLQAGVGIARLWLDDGTIVYTVNRQRVLGSFEAVGIAITNAPLVVLTNKGTASASEILAGALQDNGRAMLVGEKTFGKGLIQSLFDLSDGSGLAVTVAKYETPNHIDINKQGIIPDVVIKQDPILPNQITTEADKQYQAALELITSQFVLTNAA

SEQ ID NO: 5947 - protein, 661 aa, Candida glabrata
MATIPKRHTYGGGPEVHYTRNPYSAAPRNSMSSRGKKHVTFGPYIVGSTLGEGEFGKVKLGWTRTPSTGPEQRPAVSKQVAIKLIRRDTIVKNSEKEIKIYREINALKHLTHPNVVRLEEVLQNSKYIGIVLEYASGGEFYKYIQRKRRLKESTACRLFAQLISGVTYMHSKNLVHRDLKLENLLLDKNENLVITDFGFVNEFLPDNEYMKTSCGSPCYAAPELVISTRPYVARKADVWSCGIILYAMLAGYLPWDDDSTNPEGDDIGKLYQYITRTPLKFPEYITPIPRDLLRKILVPDPNKRVNMQYIHRHEWLKPHRPFLAVSTSQWDKLIKNSANVQLDHTKRVSRTSQHFETEQENSSVNQPVRSDMVNKAMDTSNTTDDAQHSIPNRQPLANVFINSRTYSARSASYAPRHSMSDDPNAIESARHAVQNKHESNLATVMGSPNKDKDDTTEDNNLETVARTSSHHRKPRPTSYYPVDINRSANNFSPIVLNLTNSDENDNSKHPYSTSTSNNPVAPTPQRDQSQVVTDEHGLQLEKNRVREQPLTSDKSRMSSLRSNATAKSSDSKKNKRFSLLSFYTNNGSKTSLHNDSKVSVTPSSKEESATVPPSIPSVVHHTDTTENKRNHRASMMGPSAGGDKSTARRVIDFFKRRSMRM

SEQ ID NO: 5948 - protein, 629 aa, Hypocrea lixii
MLARSVYTVTRSQITSTSYLPSLSSYSKFLQPKFTFSTMPPKGSKRETASPVGKANGVETKRVKHEANQDELHQPHPFAKDAEEHGIVLRRFYPHEMSTSRAYAYNSNEIERPMEGLVAALEETAGARKQAKVRHAVVHWFKMDLRHSDNRSLALASAKAKEAGVPLICVYIISPQDFEAHLTSPVRVDFMLRTLSVLKDDLAALDIPLHVETVDKRKDIPRRILELMEEWGSNHLFANMEYEVDELRRETRMIRQFAENNMSFEVVHDTCVVPPGELHSGTGKQYAVYTPWYRAWMAHIHENLDLLEIYDRPEKNPGATRRTFKTLFDCPIPDAPKNKQLNDEEKKRFHGLWPCGEHEAMSRLEKFCDEAVTSYHDRRNIPGDNGTSCLSVHLASGTISSRTCVRTARDRNKTKRLDGGHQGIHVWISEVAWRDFYKHVLVNWPYVCMNKPFKPEYANIEWSYNMDHFEAWCEGRTGFPIVDAAMRQLNHMGYMHNRCRMIVASFLSKDLLIDWRMGEKYFMEHLVDGDFASNNGGWGFSASVGVDPQPYFRVFNPLLQSEKFDPNGEYIRKWIPELKALSDKEIHDPYNRGAGTKAKKQGYPKQIVDHKGARERALSAYKDGLERGI

SEQ ID NO: 5949 - protein, 443 aa, Arabidopsis thaliana
  misc_feature (159)..(159): Xaa can be any naturally occurring amino acid
MANDYVSTVLLLLSLLIFLSQRTDSASIVKSLPGFDGPLPFELETGYIGVGEEEEVQLFYYFIKSERNPQEDPLLLWLSGGPGCSSISGLLYENGPVNVKIEVYNGTLPSLVSTTYSWTKVSSIIYLDQPVGTGFSYSRTKLVNKPSDSGEAKRKEKPXRIHEFLEKWLGKHQVFSSNPFYVAGDSYSGLVVPATVQEISKGNYECCNPPINLQGYVLGNPLTDYTTGSNSRIPFAHGMALISDELYESLKKTCKGEYTNVHPRNTQCLKFVEEFNKCTNRIFQQLILDPLCETETPDCYIYRYLLTTYWANDATVREALQINKESIGEWVRCYYSIPYNNDIKSSMPYHVNNSISGYRSLIYSGDHDFEVPYLGTQAWIRSLNYSIIDDWRPWMVKNQIAGYTRTYANKMTFGTIKGGGHTAESKPEEASIMFQRWINGQPL

SEQ ID NO: 5950 - protein, 421 aa, Aspergillus nidulans
MTSKQIPDIEVKPAPGISYFTPAQEPPAGLAADPQSDGAPIPKLFQPLKVRGITLHNRIGLSPLCQYSADDGHMTAWHMAHLGGIAQRGPGFLMVEATAVEPEGRITPQDLGLWKDSQIEPLKGVIEFAHSQNQIIGVQIAHAGRKASTVPPWLSSGDTATEKVGGWPDRVKGPSNVPFTSRFPVRKQMTRDDIENLKTAWVAAVKRAVRAGADFIEIHNAHGYLLMSFLSPAVNTRTDEYGGSFENRIRLSMEIAKLTREAVPDHLPVFLRVSATDWLEESRPDLPSWRLEDTVKFAKALAESGYIDVLDVSSGGTHADQHIHAKPGFQAPFAAAVKKAVGDKLLVGTVGMIDSAHLANSLLEKEGLDLTLVGRGFQKNPGLVWAFAEELGVEIGMANQIRWGFASRGGGPYLRKRSGKI

SEQ ID NO: 5951 - protein, 195 aa, Triticum aestivum
  misc_feature (132)..(132): Xaa can be any naturally occurring amino acid
  misc_feature (168)..(168): Xaa can be any naturally occurring amino acid
  misc_feature (174)..(174): Xaa can be any naturally occurring amino acid
TDLSLSLVPTATPALNKDDYFAICLAALVATDKEQQASAWNPSPAPAQELRFSCAVCGTAFASYQALGGHKSSHRKPPPTGERCVAVAQASAGAGSEASAAASSGGSSGGPHQCTVCGRGFATGQALGGHKXCHYWDGTSVSMSMSVSVSASSAVLRNFDLNLLPMPXNKAGVXKWAEEEEGAKPSPHQNLKLLL

SEQ ID NO: 5952 - protein, 441 aa, Methylococcus capsulatus
MVKVTGMRALKIGLLVGVVSAASWAEDKPTSAGAVNIPFEGLKTFSEVYGRIQQDYVEPVPDDKLLEDAIRGMLSGLDPHSTYLDQEQYNELKVGTTGQFGGLGIEVGMENGFVKVIAPIDDTPAFHAGIKAGDLIIRLDDKPVKGMSLNDAVKMMRGEPGSPIVLTVVREGVEQPLKITITRDIIKIKSVKSRILEDGYGYLRITSFQSKTGDNVIEAIDEMKKKGALKGLVLDLRNNPGGVLNAAVAVSDAFLESGLIVYTDGRVEDAKMRFSATPNDVIGGAPMVVLINGGSASASEIVAGALQDHKRAVIMGEKTFGKGSVQTILPTSNGGAVKLTTARYYTPSGRSIQAEGITPDVPISRVKLEMAAKSEFAPIKEADLTGHLSNDKAKKGGEAKDAKDKESDKVDDTLALQDYPLNEALNLLKGINIVHKNGVKN

SEQ ID NO: 5953 - protein, 294 aa, Listeria innocua
MTKTLQDRMILPGNETIPYIGLGVFQVTEQEFIAGAVEKAIEVGYRLFDTAAVYNNEAIVGQAILDSAVPREELFISSKVWNGDLGYDETLFAFERTLRNLKLDYLDLYLIHWPVAGKYRDSWRAMERLHDEKLIKSIGVANFKQHHLSDLLVAANEKPVLNQVETHPLLPQNDLRKYLAEQNIAHAAWSPLAKGILMQNPVITEIAKKHQASVDQVILQWHLNRNTIIFPKSITSSRIEENSRLSYFQLDASDMEKIDRLETGKRVGPDPDDLEYFLSSIERERAYLTGGEKE

SEQ ID NO: 5954 - protein, 150 aa, Oryza sativa
MSLVRRSNVFDPFSLDLWDPFDSVFRSVVPATSDNDTAAFANARIDWKETPESHVFKADLPGVKKEEVKVEVEEGNVLVISGQRSKEKEDKNDKWHRVERSSGQFMRRFRLPENAKVDQVKAGLENGVLTVTVPKAEVKKPEVKAIEISG

SEQ ID NO: 5955 - protein, 469 aa, Arabidopsis thaliana
  misc_feature (210)..(210): Xaa can be any naturally occurring amino acid
MEESNRSSTVLFDKYNIGRLLGTGNFAKVYHGTEISTGDDVAIKVIKKDHVFKRRGMMEQIEREIAVMRLLRHPNVVELREVMATKKKIFFVMEYVNGGELFEMIDRDGKLPEDLARKYFQQLISAVDFCHSRGVFHRDIKPENLLLDGEGDLKVTDFGLSALMMPEGLGGRRGSSDDLLHTRCGTPAYVAPEVLRNKGYDGAMADIWSXGIVLYALLAGFLPFIDENVMTLYTKIFKAECEFPPWFSLESKELLSRLLVPDPEQRISMSEIKMIPWFRKNFTPSVAFSIDETIPSPPEPPTKKKKKDLNEKEDDGASPRSFNAFQFITSMSSGFDLSNLFEIKRKPKRMFTSKFPAKSVKERLETAAREMDMRVKHVKDCKMKLQRRTEGRKGRLSVTAEVFEVAPEVSVVEFCKTSGDTLEYYLFCEDDVRPALKDIVWSWQGDDDEDDVTTNDNVDTNDNKINNVS

SEQ ID NO: 5956 - protein, 210 aa, Unknown
  Carmichaelia sp. 'Lavin 6201'
YDRVMAYKFHEDDHGEVIAEVKKPGLEPYLGLHYPATDVPQAARFLFMKNKVRIIVDCSAKRVKVIQDKNIPFDLTLCGSTLRAPHNCHLQYMDNMKASASLVMAVVVNDSNEDGDSSDAVQPQKRKRLWGLVVCHHITPKFVPFPLRYACEFLAQVFAIHVNKEIELEYQVIERNILRTQTLLCDMLMRDAPLGIISQSPNIMDLVKCD

SEQ ID NO: 5957 - protein, 468 aa, Lactococcus lactis
MTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYCDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 5958 - protein, 188 aa, Unknown
  Carmichaelia sp. 'Lavin 6201'
YDRVMAYKFHEDDHGEVVSEIRRSDLEPYLGLHYPSTDIPQAARFLFKQNRVRMICDCHAKPVKVIQSEELRQPLCLVNSTLRSPHDCHTQYMANMGSIASLVMAVIVNGNDSTRLWGLLVCHHSSPRYVPFPVRYACEFLMQAFGLQLYMEIQLASQMAEKRILKTQTLLCDMLLRDAPFGIVTQSQ

SEQ ID NO: 5959 - protein, 146 aa, Glycine max
  misc_feature (34)..(34): Xaa can be any naturally occurring amino acid
  misc_feature (43)..(43): Xaa can be any naturally occurring amino acid
  misc_feature (123)..(123): Xaa can be any naturally occurring amino acid
MVQAKKFRGVRQRQWGSWVSEIRHPLLKRRVWLXTFETAECSXQGAYDQAAILMNGQNAKTNFPTSKNQAEADHDNNNTFLSPKALSELLSTKLRKYCKDPAPSLTCLRLDADNSHIGVWQKXGSDHILAPTVVMRVELGKKQIIT

SEQ ID NO: 5960 - protein, 414 aa, Arabidopsis thaliana
MENGATTTSTITIKGILSLLMESITTEEDEGGKRVISLGMGDPTLYSCFRTTQVSLQAVSDSLLSNKFHGYSPTVGLPQARRAIAEYLSRDLPYKLSQDDVFITSGCTQAIDVALSMLARPRANILLPRPGFPIYELCAKFRHLEVRYVDLLPENGWEIDLDAVEALADENTVALVVINPGNPCGNVYSYQHLMKIAESAKKLGFLVIADEVYGHLAFGSKPFVPMGVFGSIVPVLTLGSLSKRWIVPGWRLGWFVTTDPSGSFKDPKIIERFKKYFDILGGPATFIQAAVPTILEQTDESFFKKTLNSLKNSSDICCDWIKEIPCIDSSHRPEGSMAMMVKLNLSLLEDVSDDIDFCFKLAREESVILLPGTAVGLKNWLRITFAADATSIEEAFKRIKCFYLRHAKTQYPTI

SEQ ID NO: 5961 - protein, 417 aa, Oryza sativa
MSSGGGRPPAAQHIVRSVRQRFVPLPPPLARAPFAAAPGDYHRFAAASRGGEIEEGIVIRRTPLKRKTPCGESEAAESSERMMTSPGFTEGVGSPLMTPVSGKTSRTTKSMAKFNKAGPQTPISNAGSPGNPSTPASSRYDNSLGLLTRKFINLLKQTQDGILDLNDAAKILDVRKRRIYDITNVLEGTGLIEKKLKNRIRWRGSDDSGTNLDSDISCLKTEVENLYIQEQALDRSISEIREKMEELTEDESNHRWLFVTEDDIKGLPCFQNEALIAIKGPRGTTVEVPDPDEAGDYLQRRYRILLRSTMGPIDIYLVSQYKKMEELGETATPPRHASVVEPPSIATEAGHSSKQTMPLNVQQDIQETPELNASRAFGRMKKITPSDVDTDADYWLLTDDDISITHMWTTACILDEI

SEQ ID NO: 5962 - protein, 460 aa, Oryza sativa
MAAGRKKRVGRYEVGRTIGQGTFAKVKFAVDADTGAAVAMKVLDKDTILNHRMLHQIKREISIMKIVRHPNIVRLNEVLAGKTKIYIILELITGGELFDKIARQGKLRENEARKYFQQLIDAINYCHSKGVYHRDLKPENLLLDSRGNLKVSDFGLSTLAQKKCSDWDFFFEGFQGVGLLHTTCGTPNYVAPEVLSNNGYDGSAADVWSCGVILYVLMAGYLPFEEDDLPTLYDKITAGQFSCPYWFSPGATSLIHRILDPNPKTRITIEQIREDTWFKKTYVAIKRGEDENVDLDDVQAVFDNIEDKYVSEQVTHNDGGPLVMNAFEMITLSQGLDLSALFDRQQEFVKRQTRFVSRKPAKTIVATIEVVAETMGLKVHSQNYKLRLEGVSSNRMSPFAVVLQVFEVAPSLFMVDVRKVAGDTLEYHRFYKNLCNKMESIIWRPIEVSAKSALLRTATC

SEQ ID NO: 5963 - protein, 375 aa, Bacillus cereus
MTSSRNKATSFYEGTNVNAGGFFENVEETKLFYPIQVGGWSLRNRIAMAPMTRCFADNETGVVGADVVEYYRKRAADGIGLIITEGIVISPRAKGNPGVPGIYTQEQIDSWKPVTEAVHKEGGTIIAQIWHVGRMSHHEIIGGQMPQAPSAIAAEGNVPRFRKPFDMPEAMTLEEIQEVIDQYAQAAKNAIEAGFDGVEIHGAHGYLIDQFTYEFANKRTDKYGGDLKQRLTFMKEVTAAVIEAVGANKTLLRFSAFKGDNPTYMWENPEFAIETFINMFKEVGLTMIHPSTMNYTQEIADGKNFHQLVRKYWDGTIVGVGNLNPKEAEEALQEGTIDVAAFGRPLIANPDFVHRIKHAESLVEYDAKEHLVTLV

SEQ ID NO: 5964 - protein, 352 aa, Pseudomonas syringae
IKFPDMVRAFKPDPRTNLDNDSRRFDFFSRVPEATRTLTLLYSNEGTPAGYRFMDGNGVHAYKLVNAKGEVHYVKFHWKSLQGLKNLDPKEVAQVQSKDYSHLTNDLVGAIKKGDFPKWDLYVQVLKPEELAKFDFDPLDATKIWPDVPEKKIGQMVLNKNVDNFFQETEQVAMAPANLVPGIEPSETACCRPCVSYADTQMYRLGANGLSLPVNQPKVAVNNGNQDGALNTGHTTSGVNYEPSRLEPRPADDKARYSQLPLSGTTQQAKITREQNFKQAGDLYRSYSAKEKTDLVQSFGESLADTDTESKNIMLSYLYKADPDYGTRVAEVAKGDLSRFSSLAASLKELMI

SEQ ID NO: 5965 - protein, 333 aa, Phytophthora infestans
MANQVDHSNPITLSRFILAEKEIQGNADLSVLFTSIELACKVIASSVRRAGLTGLYGLDGSENSTGDQVKKLDVLANDIFINSLKFSTKIEVMVSEEEEKPIVVQNDSSGTKYCIAFDPLDGSSNIDCNVSTGTIFAIYQRDASSEGGYKDILQPGSKLVSAGYCMYGSSTQLVLTWGKGVHCFTLDPTIGAFMLSHQDIRIPDEPKAIYSCNEGNYAQWDSATKAFVDECKTGSKAYAARYVGSMVSDIHRTILYGGIYLYPGSTKAKDGKLRLLYECNPMSFIVEQAGGMATTGTERILDLVPTDIHQRSPIFLGCKRDVERVIALYKEHN

SEQ ID NO: 5966 - protein, 363 aa, Pseudomonas putida
MSALFEPYTLKDVTLRNRIAIPPMCQYMAEDGMINDWHHVHLAGLARGGAGLLVVEATAVAPEGRITPGCAGIWSDAHAQAFVPVVQAIKAAGSVPGIQIAHAGRKASANRPWEGDDHIAADDARGWETIAPSAIAFGAHLPKVPREMTLDDIARVKQDFVDAARRARDAGFEWIELHFAHGYLGQSFFSEHSNKRTDAYGGSFDNRSRFLLETLAAVREVWPENLPLTARFGVLEYDGRDEQTLEESIELARRFKAGGLDLLSVSVGFTIPDTNIPWGPAFMGPIAERVRREAKLPVTSAWGFGTPQLAEAALQANQLDLVSVGRAHLADPHWAYFAAKELGVEKASWTLPAPYAHWLERYR

SEQ ID NO: 5967 - protein, 343 aa, Oryza sativa
MFNCAAREKAMVINLEFIRAIVTADEILLLDPLTIDVIPFVARGTHHLPLKNLVCGNGQPGGDDHGEKHDDSHGDQVPRLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWYARWKKLLGP

SEQ ID NO: 5968 - protein, 499 aa, Zea mays
  misc_feature (101)..(101): Xaa can be any naturally occurring amino acid
  misc_feature (116)..(116): Xaa can be any naturally occurring amino acid
  misc_feature (167)..(167): Xaa can be any naturally occurring amino acid
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPXVIVRFSTVIHERGSXPETIRDPRGFAVKFYTREGNWDLLGNNFPVFFIRDGIKFPDVIHAFKPNPXGRHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMEPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 5969 - protein, 257 aa, Unknown
  Nostoc sp. PCC 7120
MQVIRLAALSDNYIFLLHDSHKNIAAVVDPAEAEPVLKQLAQLKAELVAIFNTHHHNDHVGGNQKLIQKFPQVKVYGGAKDQGRIPGQQVFLQPGDRVQFADRVAEVIFVPGHTRAHIAYYFPPQTDDTPGELFCGDTLFAGGCGRLFEGTPAQMVESLTKLRSLPENTRVWCAHEYTLKNLQFALSVDSKNTELQKRLDEVKTKRSQGIATVPSLLGVEKLTNPFLRWEQPSLQLAVNSNDPVQTFARIRGLKDKF

SEQ ID NO: 5970 - protein, 661 aa, Bacillus thuringiensis
MEQLEHHVTDNQRKHALTTNQGVKIAEDEFSLKMGLRGPTLMEDFHFREKMTHFDHERIPERIVHARGVGAHGYFQLYESLEAYTKADFLTNPSKKTPVFVRFSTVQGSKGSNDTVRDVRGFATKFYTDEGNYDLVGNNMPVFFIQDAIKFPDFVHAVKPEPHNDIPQGASAHDTFWDFVAHNPESTHMVMWQMSDRAIPRSLRMMEGFGVHTFRLINAEGKAHFVKFHWKPALGVHSLVWDEAQKIAGKNPDFHRQDLYEVIEKGDYPEWELGLQLIPEEDEHAFDFDILDPTKLWPEEEVPVKLVGKMTLNKNVDNFFAETEQVAFHPGHVVPGIDFSNDPLLQGRLFSYTDTQLSRLGGPNFHQIPINQPVCPFHNNQRDGMHQMQIHRGQTSYHPNGLNDNQPATVQAEQGGYEHYQEKIDGHKIRGRSKSFLNFYSQAKLFYNSMSPIEKQHIKEAFCFEVGKCKSDMVKANVIALLNHVDRQLAQEVANMIGAPLPKENREVNSDAKSPALSMSNTIFKADSKNVAIVLNGDPSVSLLSEWIQAFAQHRINYSIIDNKIYQFNDSIKVTDTYTTTDSSLFDAVLVFSSESVIHPPVLEFAETTFKHFKPIAYVLSNPHSLDNSKIKLDGAGIYNLANTSIKSFIEGIAQGRFWNR

SEQ ID NO: 5971 - protein, 469 aa, Streptococcus pyogenes
MVSVMWFRRDLRIDDQKALAHAIASQSPTLCVFQFNNEQLNLLHSRNQSSFITSVLAFRKLLKCEGIDLYLMYGDLMTCFEQLLTQLKDWTDVYFNYDESGYGRLRDQKAAQFFKKNGIAVHTYQDHYLHGSQEIINQSGQPYKVFTPYYRIWQNYPKETPIKVELSQGRWLNLETPDDVLRTVESFKDEKYQDVATFDEASKQLNRFIQDQLAAYHANRDFPAQLGTSRLSPFLRIGAIGIRTVYHAVRQAPNSLGQATFLKELAWRDFYNMVYVAYPDQKTQPIQKAFSQIEWVNNPDWFQLWKEGKTGYPIVDAAMLQLQKTGWMHNRLRMIVASFLTKDLLCDWRLGEQYFQQQLIDYDAASNIGGWQWAASTGTDAVPYFRIFNPVTQGKRFDPKGEFIKAYLPQLEHVPEKYLHEPWKMPKYLQESVSCIIGTDYPQPIVDHAKQREQAIAKYEWAKEKAKIE

SEQ ID NO: 5972 - protein, 215 aa, Arabidopsis thaliana
  misc_feature (9)..(9): Xaa can be any naturally occurring amino acid
  misc_feature (80)..(80): Xaa can be any naturally occurring amino acid
  misc_feature (98)..(98): Xaa can be any naturally occurring amino acid
  misc_feature (111)..(111): Xaa can be any naturally occurring amino acid
  misc_feature (160)..(160): Xaa can be any naturally occurring amino acid
  misc_feature (180)..(180): Xaa can be any naturally occurring amino acid
  misc_feature (182)..(182): Xaa can be any naturally occurring amino acid
  misc_feature (186)..(186): Xaa can be any naturally occurring amino acid
EFGENEWYXFSPRERKYPNGVRPNRAAVSGYWKATGTDKAIHSGSSNVGVKKALVFYKGRPPKGIKTDWIMHEYRLHDSXRKASTKRNGSMRLDEWVXLCRIYKKRGASKXLLNEQEGFMAEVLMEDETKVVVNEAERRTEEEIMMMTSMKLPRPCSLAXHLLEMDYMGPVSHIDNFSQXRXIFIXPDSESSWFGDLQFNQDEILNHHRQAMFKF

SEQ ID NO: 5973 - protein, 565 aa, Methanosarcina mazei
MKGDNCKNPMDKNQLGEPLPSRNQTVGDTPELTTVAGAPVESNQDSMTSGRRGPLMLQDIWFLEKLAHFDREVIPERRMHAKGSGAFGTFTVTHDITSYTKAAIFSEIGKQTKMFARFSTVAGERGAADAERDIRGFALKFYTEEGNWDMVGNNTPVFFFRDPLKFPDLNHAIKRDPRTNMRSPNTNWDFWTSLPEALLQLTIIMGDRGLPSSFRHMHGFSSHAYSLINKNNERVWVRFHFRSQQGIRNLTDQEAVIVVGMDRESHQRDLYEAIEKGMFPKWKMYIQVMTEEQANSMKNNPFDLTKMWHKKDFPLMPVGEFELNKNPENYFADVEQAAFSPANVVPGISFSPDRMLQGRLFSYGDAHRYRLGVNHHQIPVNSPQGVKNYHSFHRDGQMRVDGNRGSQLHYEPNSYGNWKDQPQYALPVEKTGSTDILRYDFREDDSDYYTQPGELFRAMTPDQQQVLFENTARNMGDSTLQIKHRHIYNCYQADPKYGEGVAKALEIDISTVDLNLPARTSRKANYEANNKHPELNQPTMKKDSGREIDTNGDPYIEPENDPWLL

SEQ ID NO: 5974 - protein, 709 aa, Xanthomonas campestris
MRHPASAAYATPSRIRQGRPFPRGAIFDGKGTNFALFSAHATRVELCLFDEQGNESRVDLPEYTNEIWHGYLPDVKPGQRYGYRVHGPYAPTEGHRFNHNKLLLDPYARELDGDLVWADELYGYTVGHPDGDLSFDERDSAPFMPKCVVVEDTYDWEDDARLLKPWNETVIYETHVRGYTMRNAQVPEAVRGTFAGLAQPSVLQYIKDLGITAVELLPVHAYLDDQHLLDKGLRNYWGYNTISFFALKSRYLSSGHRDEFRDMVKAMHKQGLEVILDVVYNHTAEGSELGPTLSFKGIDNASYYRLAEDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRSGRRPWASVNFITAHDGFTLRDLVSYNEKHNIDNGEDNRDGSSNDGSCNYGEEGETDNAEILQLRERQMKNLLATLLLSQGTPMILAGDERAQSQGGNNNTYCQDNEITWLEWENDPTDGRLTDFVKSLTALRKRYPILSRGRFLNGQYNEEAGLRDLTWLNPGGTEMDDAHWTDAGARSVGLLLEGKAQTSGVKERGNDATLLIVINAYHEGVTFTLPSSDEPVHWKLALSTDEALEVDSMPAGASEFLAPPRSITVFECKVG

SEQ ID NO: 5975 - protein, 547 aa, Bacillus subtilis
MKDDHQNKQHQSNAQGSEEAFSHKTSGKNESEDTLTNRQGHPVTDNQNVRTVGNRGPTTLENYDFLEKISHFDRERIPERVVHARGAGAHGYFEAYGSFGDEPISTYTRAKLFQEKGKKTPAFVRFSTVNHGKHSPETLRDPRGFAVKLYTEDGNWDLVGNNLKIFFIRDPLKFPDLVHAFQPDPVTNIQDGERIFDFISQSPEATHMITFLFSPWGIPANYRQMQGSGVHAYKWVNEEGKAVLVKYHFEPKQGIRNLTQKEAEEIQGKNFNHATQDLYDAIENGDYPEWEVYAQIMSDDEHPELDFDPLDPTKLWYKDDFPWKPIGKLVLNKNPENYHAEVEQASFGTGVLVDGLDFSDDKLLQGRTFAYSDTQRYRVGANYLQLPINSPKKHVATNQEGGQMQYRVDRAEGQNPHVNYEPSIMGGLKEAKQDGKDHTPHVEGDVKREAIDRTNNFGQAGETYRRFTEFERNELITNLVNTLSTCRKEIQDQMIENFTKADPDYGKRVAEGLKKVSENNSNGPIGTTETEQAAKQAEQESHPSDPY

SEQ ID NO: 5976 - protein, 613 aa, Anaerobranca gottschalkii
MENMIRAINLFHQGENFEAYKFFGAHLNGEGVTFTLWAPRARAVEVVGNFNNWDGNNHKMNKISEGVWQIFIPGLKEWEIYKYKILTEDGNTILKADPFAFYSELRPNTASVIVNWKNYQWGDGRWQERKNKIDVYQGPLSIYEVHLGTWRTKNGNLMNYREIAHELVPYVKEMGYTHIELMPVMEHPFDGSWGYQVTGFFSPTSRYGSIKDLKYFIDYCHQNELGVILDWVPSHFCRDDHGLRMFDGSPCFENENPKKADNPQWGTSNFDYGKGEVVSFLISNALYWLKEFHADGLRVDAVANILYLDFCKGPQDFIPNKYGSNENLEGIEFLKKLNTVVKNHSPNSLMIAEDSSTFPKVTGTVEEGGLGFTYKWNLGWMNDTLNYMAHPWPRKAEKHHQMTFSLTYSFFEKFLLPLSHDEVVHCKKSLIDKMDGDYWQKFAALRTYYGFQYTHPGKKLLFMGGEFGQFIEWRDYEELEWHLLRFDLHRKLQIYVKDLNHFYQKEKTLWELDYGWDGFQWLEADDKENSIYVYQRRDLEGNVLVVICNFTPIVHHSYSFGVITNGVYEEEFNSDLEKYGGSNLYNGIPLTTSNNILTALIPPLAIICLKLKK

SEQ ID NO: 5977 - protein, 245 aa, Eucalyptus globulus
MGRGRVQLKRIENKINRQVTFSKRRCGLLKKAHEISVLCDADVALIVFSTKGKLFEYATDCCMERILERYERYSYAESQVLTNNAETNGNWTLEHAKLKARMEILQKNQKNLMGEELDSLSLKELQNLEHQLDTALKNIRSRKIQLMCESISELQRKDKALQEQNNMLAKKVKEKEKALAQQTQWDNPQDDGLTSSSVILSQSLQPLNIGGPYHPSGIEEGAALGPPQHRNATLFPSWMLSHLQE

SEQ ID NO: 5978 - protein, 210 aa, Enterolobium cyclocarpum
YDRVMAYKFHEDDHGEVIAEITKPGLEPYLGLHYPATDIPQAARFLFMKNKVRMIVDCHARHVKVLQDEKLPFELTLCGSTLRAPHTCHLQYMENMNSIASLVMAVVVNDNDEDVDSSDSIQPQKRKRLWGLVVCHNTTPRFVPFPLRYACEFLAQVFAIHVNKELELENQIVEKKILRTQTLLCDMLMRDAPLGIISQSPNIMDLVKCD

SEQ ID NO: 5979 - protein, 443 aa, Zea mays
  misc_feature (136)..(136): Xaa can be any naturally occurring amino acid
MEDAMAADGKSVLQGRYELGRVLGHGNFGRVHAARDLRTGRSVAVKVVAKDKLERAGMAEQIKREIAVMKMVSHPNIVELHEVMATRSKIYLALELVRGGELFSRIARAGRVREDVARCYFRQLVAAVDFCHGRGXFHRDLKLENLLLDEVGNLKVADFGLSALAGHARSDGLLHTACGTPSYVAPEVLGGKGYDGAKADLWSCGVILYVLLVGSLPFHEDNLMVMYRKMQRGEFLCPPWVSADARKLIGELLDPDPSTRITVARLVETPWYRKPLPVLPPLNLKEPTPDARRATSDKEEPEVLNAFHLISFSEGFDLSPLFDQGRGGGVGRSSAGGIRFVTREAASSVVSRLESLVTGRGANMRVTKSGSRGVRLEAVSRGRSGARLAVAAEIFSVAPSVLLVDVKKDGGDTMEYRSFCSEELRPALKDIVWASSQDTPGAA

SEQ ID NO: 5980 - protein, 478 aa, Streptococcus pneumoniae
MTTFKDGFLWGGAVAAHQLEGGWQEGGKGISVADVMTAGRHGVAREITLGVLEGKYYPNHEAIDFYHRYKEDIALFAEMGFKCFRTSIAWTRIFPKGDELEPNEEGLQFYDNLFDECLKNGIEPVITLSHFEMPYHLVTEYGGWKNRKLIDFFARFAEVVFKRYKDKVKYWMTFNEINNQANYQEDFAPFTNSGIVYEEGDNREAIMYQAAHYELVASARAVKIGHEINPDFQIGCMIAMCPIYPVTCNPKDILMAMKAMQKRYYFADVHVLGKYPEHIFKYWERKGISVDFTAQDKEDLLGGTVDYIGFSYYMSFAIDSHRENNPYFDYLETEDLVKNNYVKASEWEWQIDPEGLRYALNWFTDHYHLPLFIVENGFGAIDQVAADGMVHDDYRIEYLGAHIREMKKAVVEDGVDLMGYTPWGCIDLVSAGTGEMRKRYGFIYVDKDDNGKGSYNRSPKKSFGWYKEVISSNGESVE

SEQ ID NO: 5981 - protein, 319 aa, Phytophthora infestans
MDSRGEMKALDAQIDRLRRAENLTETEIYELCQKAKEILAGESNVQPVKCPVTVCGDIHGQFYDLLELFRIGGACPDTNYLFMGDYVDRGYYSLESVALLVALKVRHRERITILRGNHESRQITQVYGFYDECLRKYGNANVWKYFTDLFDHLPMTALIENRVFCMHGGLSPSIDTLDHARALDRVQEVPHEGPMCDLVWSDPDDRCGWGISPRGAGYTFGQDITEQFKRSNGLTFIARAHQLVMEGYQWTHNRGVVTIFSAPNYCYRCGNQAALMEIDEVMADRNGDKVYETCKFIQFDPAPRDSNFNEKKRTPDYFL

SEQ ID NO: 5982 - protein, 457 aa, Staphylococcus aureus
MAIAVLLNRMFRMEHNPLFEYIYQQKEDIDACYFIIPEEDMSSASDLKAQFYRGTLQRFYQSLHAEKLTPYVMSYDDIISFCKENNISEVVIAGDIMSYHLEEYDILHQRSLFNEARIAVTLIRGNHYFKASKTMNQQGEPYKVFTSFSKKWRPYLRHRDVYHYDLKSFEDFVIASPDDLVFDDIAFGSSQIIEQNKWQHFLDQDIQNYESGRDYLPEVLTSQLSVALAYGLLDIIEIFNDLLARYDEDEANYEAFIRELIFREFYYVLMTQYPETSYQAFKSKYRQIKWSQNEADFNAWCEGQTGFPIIDAAIMELTQTGFMHNRMRMVVSQFLTKDLFIDWTWGEKFFRKHLIDYDAASNIHGWQWSASTGTDAVPYFRMFNPIRQSERFDPKALYIKTYLPIFNQIDAKYLHDTQRNESNLFELGIELGRHYPRQMVDHQEKRTQVLAAFKALD

SEQ ID NO: 5983 - protein, 248 aa, Gibberella zeae
MSDSPQSPPKEVDQGAPSPDDEAQMNEQQDPQSANAAGYEFEGVKEQDRWLPIANARSAVHIWIPLMSCDSSSKSPKASRASKADRADELDANIRNFAPVARIMKNALPDNAKIAKEAKECMQECVSEFISFITSEASEKCQQEKRKTVNGEDILFAMTSLGFENYAEALKVYLSKYREQQNQSNRERVNMDNGQWGSGTMMGDAKAESGAVGDFGHDGNSVESGADPNYMYGSQPGHNGNAPEARER

SEQ ID NO: 5984 - protein, 193 aa, Enterolobium cyclocarpum
YDRVMAYKFHEDDHGEVVSEIRRSDLEPFFGLHYPATDIPQAARFLFKQNRVRMICDCHANPVKVIQSEESRQPLCLVNSTLRSPHQCHAQYMENMGSIASLVMAVIVNGNDTTKLWGLLVCHHTSPRHVPFPLRYACEFLMQAFGLQLYMEMQLASQMAEKRTLKTQTLLCDMLLRDALFSIVTQSPNIMDL

SEQ ID NO: 5985 - protein, 170 aa, Brassica napus
  misc_feature (77)..(77): Xaa can be any naturally occurring amino acid
GLLRDNRFASIALSPNVSAQIFMGLMVNPPKPGDISYAKFTRESKGILESLRRRAKIMTDGFNSCKNVVCNFTKGAXMYSFPQIRLPPGALQAAKQAGKVPDVFYCLKLLEATGISTVPGSGFGQKEGVFHLRTTILPAEEEMPEIMDSFKKFNDAFMTQYDNNFGYSRM

SEQ ID NO: 5986 - protein, 637 aa, Caulobacter crescentus
MAATDCLRSGWGGHLSLLLGRHRDSDDLRSPAINPAAIRVRILRAVPAVCLIVGVAMAMDYIVTILLLNEPAAYVPIATLVISTIIAVPLAYWLAGQRLRLETMHAELKASLDAKQDAIEDAEVALAKYREVDRLYRLLGDNLTDHVALWSPLGERLYSSPSIERITGYTLEEFMALPPAALVGEADFRRVQGIIRSLEPGGEPVSADYESLCKDGSRIWVESTYSLLGDGSGILLVTSRDITERKRLELDIAKALQMAEAASAAKSDFLANMTHELRTPLTAIIGFAEVLRRSRNLNKTAARQVGHILDASNTLLSVVNDVLDFSRLEAGGLELDPAPFDPAAMASSCAGLVAERAEAKGLAVEVRAPRGLKPMNLDGPRLSQVLLNFLSNAVKFTSHGAITVALRQTIDGDQAVLRGEVTDTGIGIAPEHRENIFDRFSQADAAVSRRFGGTGLGLAISRRIIERMDGRIGVDSVEGQGSTFWFEVRGPLADLPTQEAVETSPLDADAGVRLLLVEDNAVNRELICAILEPFGVAIETANDGVAGVEAMRQGHYDLVLMDVQMPMMDGLTATREIRAMEGARGASTPIIAMTANVLPEQVANCMAAGMDDHLGKPISPAKLLEAVARWSGRSHAA

SEQ ID NO: 5987 - protein, 101 aa, Cucumis sativus
HIQENWRILDFFSHHPESMNMFTFLFDDIGIPQDYRHMDGSGVNTYTLINKAGKAHYVKFHWRPTCGVKSLLEEDAIRVGGSNHSHATQDLYDSIAVETYP

SEQ ID NO: 5988 - protein, 177 aa, Zea mays
MQTKPIREMAAVSSTATASSQPELPTSTAHPTANAAAISRLARRPRRNNSFVMVEEASYASGGGDGGVARTKSLTEDDLEELKGCVDLGFGFAYSEIPELCGTLPALELCYSMTRRFLDEQRAPGQDEEEEEPASPPLPNWRIFAPASVLAGDDPEEVKARLKYWAQAVACTVKLCS

SEQ ID NO: 5989 - protein, 341 aa, Pisum sativum
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSFNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIESMVANVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 5990 - protein, 489 aa, Unknown
  Exiguobacterium sp. 255-15
MSEKRLTTNQGVPIGDNQNSRTAGRRGPTLLEDYQLIEKMAHFDRERVPERVVHARGFGAHGVFTVKNSMKKYTKAAFLQNEGTEVPVFARFSTVIHGTHSPETLRDPRGFSVKFYTEEGNWDFVGNNLPVFFIRDSMKFPDMVHSLKPDPRTNIQDPDRYWDFMTLRPESTNMLMHLFTDEGIPASYRKMRGSSVHAFKWVNAHGNTVYVKLRWVPKVGVHNLSADEATEIQGKDFNHASNDTYQAIEDGEFPEWDLFVQVLDPADVDNFDFDPLDATKDWFEDVIPFQHVGTMVLNKNVDNYFAETESVGFNPGVLIPGMLPSEDKLLQGRLFSYSDTQRYRIGTNYQQLPINCPFAQVNNYQRDGAMPVGQQTSPVNYEPNRYQDEPKQTPEYTEENQPLYDDIHGRLEIEKTNNFGQAGEVYRRMTEEEQTALLNNLVDDLKQVRHENTVLLAICNFYRADESLGKKLSEALQVDIQPFLQQMQK

SEQ ID NO: 5991 - protein, 489 aa, Nicotiana glutinosa
MGFENEKNNSILSKLATNEEHGENSPYFDGWKAYDNDPFHPLKNPNGVIQMGLAENQLCFDLIEEWIKRNPNASICTTEGIKSFRAIANFQDYHGLTEFRRAIAKFMEKTRGGRVTFDPERVVMAGGATGANETIIFCLADAGDAFLVPSPYYPAFNRDLRWRTGVQLIPIPCDSSNNFQITTKAVKEVYENAQKSNIKVKGLILTNPSNPLGTTLDRDTLKNLLTFTNQHNIHLVCDEIYAATVFSTPQFVSIAEIVNDEMRHCNKDLVHIVYSLSKDMGLPGFRIGIVYSFNDTVVSCARKMSSFGLVSTQTQYLLAEMLSDEKFVSNFLTESSKRLAKRHKHFTNGLEQVGIKCLRSNAGLFCWMDLRPLLKESNFDAEMSLWRVIINDVKLNVSKGSSFDCQEPGFFRVFFANMDDETVDIALRRIRRFVSVKRTGDETTAMERKQQWKKNNLRLSFSKRMYDESVNLSPLSSPIPHSPLVRART

SEQ ID NO: 5992 - protein, 342 aa, Bordetella pertussis
MNLLSPIDIAGIALRNRIAVAPMSRTQADAHGHPAAETAAYYARYARHGAGLVITEALYTAGPAARAYFNQPGLASEAQAEHWRAAVRAVHQEGGRVIAQLQHAGKLAEPGLHARPLGLVDGAAQGLSWQTQQPNAPAHAATAEEIERIIEGFALSARLAHYAGFDGVEIHGARGYLVNDFLSAYNVRDDEWGADRARIAEAVLRAVRQACPLPIGFNYSIYKMDEYRYQPPGGGAEIAALLARLCQAGADILHISSRRVLKPEPWGGLLAQLARAAAPKALMVNGGLATLQDCETVLAATQADLVSLARPFLANPDWLARSLAGEPLRAYEPGMEQRPLLD

SEQ ID NO: 5993 - protein, 242 aa, Glycine max
MEFPNEAIPEGCSQKKTGRGKIGIKRIENTTNRQVTFCKRRNGLLKKAYELSVLCDAEVALVVFSSRGRLYEYANNSVRGTIDRYKKACAASTNPESVSEANTQFYQQEASKLKRQIRDIQNLNRHILGEALSSLSLKELKNLESRLEKGLSRVRSRKHETLFADIEFMQKREIELQNHNNFLRAKIAEHEKAQQRQQDMIPGNVCESTIPPQSYDRNFFPVNLIDSNNQYSNQDQTALQLV

SEQ ID NO: 5994 - protein, 538 aa, Staphylococcus aureus
MVKQLKFSEDARQAMLRGVDQLANAVKVTIGPKGRNVVLDKEFTAPLITNDGVTIAKEIELEDPYENMGAKLVQEVANKTNEIAGDGTTTATVLAQAMIQEGLKNVTSGANPVGLRQGIDKAVKVAVEALHENSQKVENKNEIAQVGAISAADEEIGRYISEAMEKVGNDGVITIEESNGLNTELEVVEGMQFDRGYQSPYMVTDSDKMVAELERPYILVTDKKISSFQDILPLLEQVVQSNRPILIVADEVEGDALTNIVLNRMRGTFTAVAVKAPGFGDRRKAMLEDLAILTGAQVITDDLGLDLKDASIDMLGTASKVEVTKDNTTVVDGDGDENSIDARVSQLKSQIEETESDFDREKLQERLAKLAGGVAVIKVGAASETELKERKLRIEDALNSTRAAVEEGIVAGGGTALVNVYQKVSEIEAEGDIETGVNIVLKALTAPVRQIAENAGLEGSVIVERLKNAEPGVGFNAATNEWVNMLEEGIVDPTKVTRSALQHAASVAAMFLTTEAVVASIPEKNNDQPNMGGMPGMM

SEQ ID NO: 5995 - protein, 929 aa, Pectobacterium carotovorum
MTKYSLRARMLILILAPTLMIGLLLSSFFVIHRYNQLQSQLADSGASIIDAAGNHQRYAITHRQMDTIPALINTLHRRHSAIIRTISVFDARNQLLATTKLRNKRTLQCLSNDVLAHNKLHLHHTNDALILHMPIVTDSEFMAGTTPVLPGTATPLGYLVIELDTSTIRLQQYQEIFIAALLLLLSLGAAVIFAYRLMRDVTTPIRNMVDTVDRIRRGQLDSRVEGYMLGELDMLKNGINSMAMSLTAYHEEMQQNIDQATYDLRETLEQMEIQNVELDLAKKRAQEAARIKSEFLANMSHELRTPLNGLIGFTRQTLKTPLNTTQTDYLLTIERSANNLLNIINDVLDFSKLEAGKLVLEDIPFSLHNTLDDVVMLLAHTAHEKGLELTLSIQNDVPEQFVGDPLRIQQIITNLLGNAIKFTEQGNIDIRVEKRRQELHQVLLEVQIRDTGIGIAELQQSQLFQAFRQADTSISRRHGGTGLGLVITQRLVKEMGGDISFQSELSKGSTFWFHITLPLNPHAIPTEPAYTMLQGKHLAYVEYHPIAAQATLDILSQTPLIVSYSPTFEQLPEGEFDILLLGIPVQYRNTLLDYTPRLRDICRRSPCVILALPSLAQMDAEQLKTFGVHACLSKPLAASRLLPLLQDSTLFQFSFLPDDTASHQSAVRHLARLPLRVMAVDDNPANLKLIGTLLEEQVETIILCESGQDAIAQAELNQCDIILMDIQMPGMDGICASELIRQIPHHATTPIIAVTAQTMTGEREHLLRSGMDDYLAKPIDEQMLKSVLTRHARQDPLKRNRGEMTGLLNEHDDSQLSLDWALAQQQAANKPELGRDLLQMLLDFLPEVQRKIENVLKGQTDDDIIELVHKLHGSCSYSGVPLQPICRYLEQQLRKGVHASDLEPEWLELLDEIDNVNRAAQPHINPRLP

SEQ ID NO: 5996 - protein, 1313 aa, Geobacter metallireducens
MNRRELMAGVLLGSAGFLVNWFKLSLFFNVDFLFGSVFSMFALLRFGPATGLLAAVIAAGCTWLQWHHPWAIVIFGCEALCAGWLRNRKRMDLMLGDIIYWFSGGLVLVWLFYHQVMGFNAGATLLVALKQGMNGIINTLIAEALFLLSWRLRGGTELPSLRKWLGVILEGVVLVPAFVFAFLDTSWYFRQQMTRLQESTARTAEVGNLTISSWLDEEQHKLGMLVKLVGDPDHNPSQEMQRLLERYHAAHGSDTYRLGVMDRNHVTRAFSPRVDEKGVSTIGVWLGDRPYIAELNDPSHPIVFDAFMGKIGVPGPRLIMLAPCMVGGEYRGAVFSVVSLGHPAALLKGIVGKRDVNLTLLDRHRRVVASTDSGKKFLEQFALPKGGQLHSVGSNVSQWVPDPQPGGGPMKRWNRSFYMTEIALEPKSGFRLVVQSSLAPSLKEINNRASILLGVLAILTLVVVGLSRYFSRRLLAPFAMLGKVTSQLPVRIAQGEQISWRPAEVREEQELQDNFRLMENALQNSFSELTAINEELEHRVTERTAELRIAKEAAENSELQLRSITNSAHDAILMMDHQGSISYWNPAAEQILGYSAAEALGKNLHDLLTPERYLADHLTAFSEFQQTGSGNAVGKTLELFARRKDGQEIEVALSLSAVFLNGAWNAVGLLRDITEQKRINASLRMLSAAVEHSPVSIIITDRDGRIEYVNPKSCQMTGYAFEELRGQNPRIMKGPTHPPEFYKNLWETILSGREWYGEFHNRRKDGSLVWVMASISPIYDEKGEITHFVGVREEIEKQKKLQEELANIAQLEKVARDRAEQANRAKSEFLAGMSHEIRTPLNAIIGMSDLLAETRLDGEQSGYLSVVHSAGETLQGLINDILDLSKIEAGMLQLDSVPFSLRDCIRQLTDITSVKASSKGVTYSFSVKSAVPDWLMGDSLRLRQVLINLVGNAVKFTDSGGSVLLEVEPVQQSDAEVLIRFSVADTGIGIAPEKLDTIFESFSQADSSTTRRYGGTGLGLAISRHLAGMMGGEIGVESTVGKGSCFRFTVPFAISRRTEEPLPKEQLPGDKLGRPLSILVVDDNLANRTVLTAYFRRTEHTVECAVNGEEALAKIKGGGYDVVFMDMEMPVMDGYTAVRLVREWERETGRAPLPVIALTANALKEDQLRSLDAGCTAHLTKPIKKDKLLEIVGEYQQRPRTNGKQGTNMDRDNVPDKIVVVCDPDLEDIIPAYLEGRKTEGSVIRELAVNGQFDEVRTIAHGLKGSGGCYGFSRITEIGRDMELAANDGNLVEVLKQLDTLEAYLQAIEVRYE

SEQ ID NO: 5997 - protein, 457 aa, Bordetella bronchiseptica
MSKSPEQMTPYDQFNIEVPEDHFPVEGMSARAAQALVLSDEWTDTNPMLNMSSFVTTFAEPEAVRIAEKNMYKNYIDHDMYPQLFAMEQRMVRWLHQLWNGPKDAEPYGTATVGSSEACMLAGLAHKWNWRQRREREGKDATRPNMVTGGNVQIVWKKFLRYFDVEPRIVPLKPGQYCLTAEDLDKYVDENTIAVVAIAGQTFTGEDDDIQGIHDWLDAYEKKTGVSVPMHIDGASGGFVNPFLYPDYKWDFRLPRVQSINASGHKYGLTPPGLGWVIFRERKVFNEDLVFYVNYLGGEMPTATLNFSRNSFQVAVQYYQFLRLGFDGFKRVMQRTLDNAIALRQHLVDSGYFTIMNDTQRIPVVAVTLDPKVKKFNEFDVSNKVRERGWVISAYTMPPDAESVRSLRVVVRPHINRNVALLLAEDIVKACKYLEQHGGTATPPALHDTHKSSPAKC

SEQ ID NO: 5998 - protein, 544 aa, Chlamydophila abortus
MAAKNIKYNEDARKKIHKGVKTLAEAVKVTLGPKGRHVVIDKSFGSPQVTKDGVTVAKEIELEDKHENMGAQMVKEVASKTADKAGDGTTTATVLAEAIYSEGLRNVTAGANPMDLKRGIDKAVKVVVDQIKKISKPVQHHKEIAQVATISANNDAEIGNLIAEAMEKVGKNGSITVEEAKGFETVLDVVEGMNFNRGYLSSYFTTNPETQECVLEEALVLIYDKKISGIKDFLPVLQQVAESGRPLLIIAEDIEGEALATLVVNRLRAGFRVCAVKAPGFGDRRKAMLEDIAILTGGQLISEELGMKLENTTLSMLGKAKKVIVSKEDTTIVEGLGNKEDIEARCENIKKQIEDSTSDYDKEKLQERLAKLSGGIAVIRVGAATEIEMKEKKDRVDDAQHATLAAVEEGILPGGGTALVRCIPTLEAFIPVLTNEDEQIGARIVLKALSAPLKQIAANAGKEGAIICQQVLARSSNEGYDALRDAYTDMIEAGILDPTKVTRCALESAASVAGLLLTTEALIADIPEEKSSSVPAMPGAGMDY

SEQ ID NO: 5999 - protein, 279 aa, Staphylococcus aureus
MLNEIQILNNGYPMPSVGLGVYKISDEDMTKVVNAAIDAGYRAFDTAYFYDNEASLGRALKDNGVDREDLFITTKLWNDYQGYEKTFEYFNKSIENLQTDYLDLFLIHWPCEADGLFLETYKAMEELYEQGKVKAIGVCNFNVHHLEKLMAQSSIKPMVNQIEVHPYFNQQELQEFCDRHDIKVTAWMPLMRNRGLLDDPVIVKIAEKYHKTPAQVVLRWHLAHNRIIIPKSQTPKRIQENIDILDFNLELTEVAEIDALNRNARQGKNPDDVKIGDLK

SEQ ID NO: 6000 - protein, 233 aa, Dianthus caryophyllus
MGRGRVELKRIENKINRQVTFAKRRNGLLKKAYELSVLCDAEVALIVFSNRGKLYEFCSTSCMNKTLERYQRCSYGSLETSQPSKETESSYQEYLKLKAKVDVLQRSHRNLLGEDLGELSTKELEQLEHQLDKSLRQIRSIKTQHMLDQLADLQKKEEMLFESNRALKTKLEESCASFRPNWDVRQPGDGFFEPLPLPCNNNLQIGYNEATQDQMNATTSAQNVHGFAQGWML

SEQ ID NO: 6001 - protein, 627 aa, Pseudomonas aeruginosa
MCGIAGFWNITGTLLGDNARVARQMAAAIHHRGPDESGIWYEAPRAPILVHARLAVLELSPAGSQPMHSDCGRYVLIYNGEIYNHLALRARLSEAGVTHSWRGGSDTETLLACFAQWGVESTLKLTVGMFALALWDRQEKTITLARDRMGEKPLYWGWQNGVLFFASELKALKEHPLFRGDIDRDALALFLRYGYVPAPYSIYKGIGKLRAGSYLVLSERSLNETCEPAAYWSANAAIEEALSNPFQGTDAEAVDLLESQLRTSISDQMVSDVPLGAFLSGGVDSSTVVALMQQQSSRPIRTFSIGFDEPGYDEAVYAKAVAEHIGTDHTELYVNSKDALDVIPSLPKIYCEPFGDSSQIPTLIVSGLARQQVTVALSGDGGDELFGGYNPYQFTPRVWRMLERFPHSMRRFASAFAQDLPLPDKLGKLRDVFASRTAEELFYRLNSHWRNHEYPVIGAKGHTALLDTPERWPRVDSFQHWMMAMDVQGYMPDDILVKVDRAAMANSLETRVPLIDHRVFELAWRMPLHMKIRNGKGKWLLREVLYRHVSRELIERPKKGFSVPVSDWLRGPLKEWAESLLDERRLQQEGYLDSRLIRRIWNDHLAGRRDHSRRLWSVLMFQAWLES

SEQ ID NO: 6002 - protein, 1000 aa, Methanosarcina acetivorans
MCGLKKRLFIDCYEGESIEEIRGKKRADREETEVQEKSHLEEKLVRLEWQADSAVTGLITMDFDGTLSYVNPFFVRMWGYGSAEEPPGRQVSELWASPAEFLQAERECREKGEWIGELQARRRDGTFFYVHTSLSLIRNREGLPLGISGSFVDITRLKQVEEELRNRTLELSEAKARLDLALEATEMGTWDWDVLTNGMTWDDNLFRLVGISREEFLQTHDSLLELSNRILSPEDNRRMLEVMQAVADGKTDSYEFEHDVLRPDGTVRHFLVKGRAHRDSEGKLLRVTGTTTDITDQKIAEDALRRSEANLARSQAMAHLGSYSFDAHTGEIYWSEELKTIWDYDPGPNYSFETVISRIHPEDRKRILEALKNAGQGKHPFNSEYGILKPDGSIRYVHDQGEISLDGNGVPVRMFGTLQDITHRKLMEEQLLKAKEAAESANKAKGDFLANMSHEIRTPMNAVLGMLEMLLETSLTDEQREYLQLAHASAESLLSIIDDVLDFSKIEQNKLELEQISFELESLISHIINLLSGKAGSKGLKLAFHIEKDLPSTFIGDPVRLKQVLFNILGNAIKFTKKGEIALSVEVYMPSERNSGLSNSDFPEEVALLFKVKDTGIGIPPEKLSQIFDPFIQADASVTREYGGTGLGLAISSQLVELMEGRIWVESEVGKGCTFYFTVRVKRGESSENYGQGNNIPEESLLVCMEAKESYGNGITSGESLNVLFAEDHPINQKLILGLLEKKGHKLTLVTSGKDALDALSRRDFDAVLMDIQMPGMDGLEATRRIRDPSSGVRRHNIPIIAFTARALKEDREKCFEAGMNYYISKPLKKEKLLNILEDIRVGKNTREKTARERTVQDRIVQEKNIQERAATPLDLESIAFDFPEDQVFNLEEVLERTEGDEVLLKEMVKIFLGMAPELLDSINSALRKGEAEALRENAHILKSAAGSIGANRVFRVAYYLEQVGRRDRMELASDKFEEIKARFKELEPVLVRYLEKQIC

SEQ ID NO: 6003 - protein, 548 aa, Anaplasma ovis
MANVVVTGEALDKSIREVVRILEDAVGCTAGPKGLTVAISKPYGSPEITKDGYKVMKSIKPEEPLAVAIANIITQSASQCNDKVGDGTTTCSILTAKVIEEVSKAKAAGADIISIKNGILKAKEAVLTALLSMKREVASEDEIAQVATISANGDKNIGSKIAQCVREVGKDGVITVEESKGFKDLEVERTDGMQFDRGYLSPYFVTNAEKMLVEFENPYIFLTEKKINLVQNILPVLENVARSGRPLLIIAEDVEGEALSTLVLNKLRGGLQVAAVKAPGFGDRRKDMLGDIAVIAGAKYVVNDELAVKVEDITLEDLGTAKTVRITKDTTTIIGSVDSNADSITSRISQIKSQIEVSSSDYDKEKLKERLAKLSGGVAVLKVGGSSEVEVKERKDRVGDALHATRAAVEEGVVPGGGAALLYTLASLDGVKGKNDDEQLGVNIIKRAVCAPIKRIIKNSGSEEAPCVIQHLLKQNDKELIFNVDTMNYANAFASGVMDPLKVVRIAFDLAVSLAAVFMTLNAVVVDVPNKEDAAGGAAGGMGGMGGF

SEQ ID NO: 6004 - protein, 852 aa, Manihot esculenta
MLGSLGLFPAPDFGSLSPSLAKNSKRAVERNCQIVKQNQIELTGCRKLPGGPRSLFLPRISIDKRVKQGLAISAAVADEKKTITSFEEDMEITGLLSIDPGLESFKDHFRYRMQRFTNQKQLIEKYEGGLEEFSKGYLKFGFNREAGGIVYREWAPAAQEAQVIGDFNGWIGSNHRMEKNEFGVWSINIPDSGGNPAIHHNSRVKFRFKHGDGVWVDRIPAWIRYATVDPTKFGAPYDGVYWDPPPPERYQFNYPRPPKPQAPRIYEAHVGMSSSEPRINTYREFADDVLPRIRANNYNTVQLMAVMEHSYYGSFGYHVTNFFAVSSRSGTPEDLKYLIDKAHSLGLRVLMDVVHSHASNNITDGLNGFDVGQSTQDSYFHTGDRGYHKLWDSRLFNYANWEVIRFLLSNLRWWLEEYKFDGFRFDGVTSMLYHHHGINMAFTGDYNEYFSEATDIDAVVYLMLANSLIHNILPDATVIAEDVSGMPGLGRSVSEGGIGFDYRLAMAIPDKWIDYLKNKSDEEWSMKEISWSLTNRRYTEKCVAYAESHDQAIVGDKTVAFLLMDKEMYYGMSCLTDASPMVDRGVALHKMVQLLTMAFGGKGYLNFMGNEFGHPEWIDFPREGNGWSYDKCRRQWNLVDTEHLRYKFMNAFDRAMNLLDEKYSFLASTKQIVSSTNEEDKVIVFERGDLVFVFNFHPENTYDGYKVGCDLPGKYRVALDSDAWEFGGRGRVGHDVDHFTSPEGIPGVPETNFNNRPNSFKILSAARTCVVYYRVEEKEGNHNSSDIGAANETLTDIAKLGDFEGINETSPADAVAKQEDLKAAQPSLIADDIATKANTETEEIEEETSDDK

SEQ ID NO: 6005 - protein, 210 aa, Myrospermum sousanum
YDRVMAYKFHEDDHGEVVAEITKSGLEPYLGLHYPATDIPQAARFLFMKNKVRMIVDCHAKHVKVLQDEKLPFDLTLCGSTLRAPHSCHLQYMANMDSIASLVLAVVVNDSDEDGDSSDAVQPQKRKRLWGLVVCHNTTPRFVPFPLRYACEFLAQVFAIHVNKEFELEYQIIEKNILRTQTLLCDMLMRDAPLGIVSQSPNIMDLVKCD

SEQ ID NO: 6006 - protein, 355 aa, Kluyveromyces lactis
MAGIKHRRDSAESINTDIITLSRFILDQQHLSAKNATGEFSMLLNSLQFAFKFISQTIRRAELVNLIGLAGASNSTGDQQKKLDVLGDEIFINAMKASGNVKVLVSEEQEDLIVFRNSPGKYAVCCDPIDGSSNLDAGVSVGTIVSLFKIHENQNGNSGEEDSEGTINDVARCGREMVAACYTMYGASTHLVLTTGAGVNGFTLDNNLGEFILTYPELRLPEQKSIYSINEGNTCYWEPTIADFIAKLKENSEENNGKPYSARYIGSMVADVHRTLLYGGLFSYPGDKKNPNGKLRLLYEAFPMAFLVEQAGGKAVNDRGERILDLVPQHIHDKSSIWLGSSGDVDKYLKHIGKL

SEQ ID NO: 6007 - protein, 216 aa, Ophioglossum pedunculosum
SKRRNGLLKKAYELSVLCDAEVAVIVFSGTGKLSEFASSSMMRRILEKHRQVVEGSQSIKPTSQDVVEYWRHEATRLKHQLGVVQETQRHMLGESLETLTYRDLQKLESKLNGALNQVRGRKNQIISERLVYLQEKEDLLNAENIMMRAKLAEIMAGGVPLMSQSMQDPAARESFLNESSTQPNPPIMKNQNGEETNLQLGLELFPTTSFGDGAST

SEQ ID NO: 6008 - protein, 478 aa, Prochlorococcus marinus
MNNPRILFWHRKDLRIFDNQALIKAFSLSNAITSTYILDRNYTHDFSANSRAWFLGDSLQELGNNWEKMGSRLVIEEGDPVLIIPQLAKTIDAKFVIWNKTIEPYEINRDLQIKKNLKEKNIQVIESWDHLLVEPLKIFSGNNKPYSVYGPFYKNLKSKMNLLGLYDQDKVIFQFKDIDNKLKENKLINSSDSTLKKFLKNIKFSGSNICPCRPGENGAEILLEKFINEKNIYSYNSARDLPSHNGTSFLSASLRFGTISIRKVWNATLDLNSDFESHENSLSIETWQKELVWREFYQHCLFHFPELEKGPYRKKWGQFPWQNNNEWFQHWSNGETGVPIVDAAMRQLNSTGWMHNRCRMIVASFLVKDLICSWQMGEKKFMETLVDGDLAANNGGWQWSASSGMDPKPLRIFNPYTQAKKFDPICEYIKSWIPELSKVSNSDLLNGEISNLEKNNYSTPIVDHNIQQRLFKSLYAEI

SEQ ID NO: 6009 - protein, 564 aa, Zea mays
  misc_feature (303)..(303): Xaa can be any naturally occurring amino acid
MAPLVATATMNHAVAHLLGPNHESFSRHHLSSSLQQNSKRRCNLSFRPRAAESQNGSQTLSPSEVPKRDWFPSDFIFGAATSAYQIEGGWNEDGKKPSTWDHFCHTFPDWIADHSNGDVAADSYHMYKEDVRLLKEIGMDSYRFSISWSRILPNGTLEGGINPYGIKYYKNLINLLVENGIEPFVTIFHWDTPQALVDKYGGFLDERIVKDYTDFAKVCFENFGDKVNNWLTFNEPQTFSSFSYGTGLCAPGRCTPGQKCANPIGNSLTEPYTVGHNLLRAHAEAVDLYNKYYKGENGRIAPXDHWQGGLAFDVMGRVPYEKSAFTDQQAEQRSWDINLGWFLEPVVRGDYPFSMRSLARERLPFFTDKEQEKLVGSYDMLGLNYYTSRFSKNIDISPNYSPVLNTDDAYASQETNGPDGNPIGPWMGNSWIYLYPEGLKDLLMIMKNKYGNPPIYITENGMGDVDHGDLPMEVALDDHKRVHYLQRHIATLKESRDLGANVQGYFAWSLLDNFEWFSGYTERYGIVYVDRNDGCKRYMKRSAKWFKEFNAAKKAAAKKILTPA

SEQ ID NO: 6010 - protein, 541 aa, Oryza sativa
MDPYKHRPSSSFNGPLWSTNSGAPVWNNNNSLTVGSRGPILLEDYHLVEKLANFDRERIPERVVHARGASAKGFFEVTHDITHLTCADFLRAPGVQTPVIVRFSTVIHERGSPETLRDPRGFAIKFYTREGNWDLVGNNFPVFFIRDGMKFPDMVHSLKPNPKSHVQENWRILDFFSHHPESLHMFTFLFDDIGIPADYRHMDGSGVNTYTLVNRAGKSHYVKFHWKPTCGVKSLLDDEAVTVGGTNHSHATQDLYDSIAAGNFPEWKLFIQTIDPDHEDRFDFDPLDVTKTWPEDIVPLQPVGRMVLNRNIDNFFSENEQLAFCPGIIVPGIYYSDDKLLQTRIFSYSDTQRHRLGPNYLLLPPNAPKCAHHNNHYDGFMNFMHRDEEVDYFPSRYDPAKHAPRYPIPSATLTGRREKVVIAKENNFKQPGERYRSWDPARQDRFIKRWIDALSDPRLTHEIRSIWLSYWSQADRSLGQKLASRLSAKPSMAQVHEDITDGLTEGDDEVVRSRRGVRWWMLWRRRRLGRNGIAVGRKEIK

SEQ ID NO: 6011 - protein, 423 aa, Saccharophagus degradans
MTLPKDPESSTVKPVKKDKRKNIIKSEKLLGVCYDIRGPVLEHANRLEEEGHRILKLNIGNPAPFGFEAPDEIITDVVYNIREAQGYTASRGLFPARKAIMHECQRQEIPNVEIEDIFLGNGVSELIVMANQALLNNGDEVLVPSPDYPLWTAAVNLAGGKAVHYMCDEQSDWFPDIDDMRSKITSRTRAIVVINPNNPTGAVYSQELLEQIVALAREHQLVIFADEIYSKILYDDAEFVPMGRIAKDVLCVTFNGLSKSYRLAGFRSGWIILSGAKHLAKDYIRGIDMLASMRLCANVPAMLAVQTALGGYQSINELILPGGRLLEQRDAAIEELAKIPGVSCVVPKGAIYLFPKIDRTMYDFDDDQQLILDFLIQEKILLVQGTAFNWKQPDHFRIVFLPQADQLRQAIIKFGEFLQQYRI

SEQ ID NO: 6012 - protein, 136 aa, Zea mays
  misc_feature (75)..(75): Xaa can be any naturally occurring amino acid
MDARMFGLENPLVAALHHLLDARAMAATPADVKELAGAYAFVVDMPGLSTGDIRVQVEDERVLVISGERRREERXDAKYLRMERRMGKFMRKFVLPDNADVDKVAAVCRDGVLTVTVEKLPPPEPKKPKTIEIKVA

SEQ ID NO: 6013 - protein, 917 aa, Pseudomonas syringae
MLTKLGIKGRELLLTILPASLMAAMLGGYFTWMQLSELQSQLLLRGEMIAQDLAPLSASALGRKDKVLLSRIATQTLEQPDVRAVSFLDVDRSPLAHAGPTMISPTPIGNSSQLLNSTGTDATRYLLPVFGNQRHLTSPIIPAEADTLMGWVDVEISHNGTLLRGYRSLFASLLLIFTGLAITAVVAVRLSRTINGPMSQIKQAVSQLKDGNLETRLPPLGSRELDELASGINRMAATLQNAQEELQMSIDQATEDVRQNLETIEIQNIELDLARKEALEASRIKSEFLANMSHEIRTPLNGILGFTHLLQKSELTPRQFDYLATIEKSADNLLSIINEILDFSKIEAGKLVLDNIPFNLRDLLQDTLTILAPAAHAKHLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNLPLEGLRAAVLEHHDLARQALEHQLEDCGLHTVVFTNLENLLNGVTAAHETPAAIDLAVLGVTTLEISPERLRQHIWDLENLNCKVMVLCPTTEYALFQLAVHDVYTQLQAKPACTRKLQKALSELIAPRAIRADIAPPLSSRAPRVLCVDDNPANLLLVQTLLEDMGAEVMAVEGGYAAVNAVQQEAFDLVLMDVQMPGMDGRQATEAIRAWEAERGQSSLPIVALTAHAMANEKRSLLQSGMDDYLTKPISERQLAQVVLKWSGLALRNPAPERQNESLEAHVGPLVLDPEEGLRLAAGKADLAADMLAMLLASLDADREAIRVARASQDVQALIERIHRLHGATRYCGVPQLRTACQRAETLLKQDAPHTGDALDDLDKAIVRLETEARVTA

SEQ ID NO: 6014 - protein, 349 aa, Pseudomonas fluorescens
MTTLFDPIKLGDLELSNRIIMAPLTRCRADAGRVPNALMAEYYVQRASAGLILSEATSVTPMGVGYPDTPGIWSNDQVRGWANVTKAVHGAGGKIFLQLWHVGRISHPSYLNGETPVAPSALQPKGHVSLVRPLADFPTPRALETAEIADIVDAYRVGAENAKAAGFDGVEIHGANGYLLDQFLQSSTNQRTDQYGGSLENRARLLLEVTDAAIEIWGAGRVGVHLAPRADSHDMGDANLAETFTYVARELGKRGIAFICSREKEGADSLGPQLKEAFGGPYIANERFTKDSANAWLAAGKADAVAFGVPFIANPDLPARLKADAPLNEAHPETFYGKGPVGYIDYPTL

SEQ ID NO: 6015 - protein, 370 aa, Bordetella pertussis
MSTLFQPLNAGKLRLANRIVMAPLTRNRSPNAVPPPLTATYYAQRASAGLIITEATAISHQGQGYADVPGLYAPEQLAGWRRVTDAVHAAGGTIVVQLWHVGRISHTTLQPGQGAPVAPSAIRAQARTYLVDAQGKGQFADTSEPRALALDELPGIVEDYRRAARAAIDHGFDGVELHAANGYLLDQFLRSGSNHRDDAYGGSIENRARLLLRALDAVCAEVGADRVGIRLSPVTPANDAHDDQPQPLFEYVLRELARRGLAYVHVIEGATGGDRAYQQGPAPFDYAALKAAYRAAGGAGAWMVNNGYDISLAEQKLSSGQADLVAFGKPFIANPDLVARLRQGAALNEGDRDTFYGGGERGYTDYPALA

SEQ ID NO: 6016 - protein, 555 aa, Debaryomyces hansenii
MEPASKKTKLEELSKFGSKYYPYDIDNKTIISKYIKREDLKPINVLEAKLNDTRANRNNIDVGDSIAHLFLRDFRTIDNKGLSIASELATTTKTPLITFHIFCLEEFDAHSVSPFKLEYMLGSLDVLKKDLREMNIPLVSLQVEKRKDVPTKIAEFLEQNNTSHVFCNMEYEVDELRLLSKLVCFLLDKHISFNPVHDSCIVKPGELKTKSKGTQYAVFTPWYKAWCNYLKIEDAPFMEYPRPHANESFSDPNKLFDSEIPQVPESKRLTHDQQKEFDTCWKCGEHEAWLALSVFLESDKFKKYDESRNEISEESVSRMSCPISSGIISTRSIIRYILENKFVKKIDSGEQGTGWIRQIAWRDFYRHILCNWPYVCMFKPFLLEYDDLNWEYNSDHFYKWCQGKTGFPIVDAAMRQLNQTGYLHNRCRMIVASFLSKHLLIDWKYGEYYFMEHLIDGDFASNNGGWGFSSSTGVDPQPYFRIFNPWLQSERFDKKGTYIRTWVPELKDIQDEKGIHNPYEKGYGHIAEKNGYPKPIVDHKYCRERALNRFKDAKY

SEQ ID NO: 6017 - protein, 733 aa, Burkholderia vietnamiensis
MTDTLFDRRDIDALLGGRHPDPFACLGPHGEAGRTVVRALLPGALRVRAVTPGGDELGALACVDEAGCFAGTITHDGRYRLAIDWPDAQQVTDDAYAFGTLLDDAALARFAAGDPAAVLDCLGATPIRVDGVDGVRFAVWAPNAQRVSVVGNFNSWDGRRHPMRLRRPWGVWELFVPGIGPGEHYKYELCAADGSLLPHKADPCARATEAPPRTASVVADTAALDGFGWHDAGWIDARPDAGRRFRVPWSIYEVHAESWQRVPEEMDRSATWDELAERLIPYVKGMGFTHVEFMPISEYPFGGSWGYQPLAQFAPSARFGPVDGFARFVDRAHAAGIGVIVDWVPAHFPNDAHGLAQFDGSALYEHADPREGMHPDWNTCVFNLGRNEVSAFLIASALAWARRYHVDGIRVDAVASMLYRDYSRKEGEWVPNVYGGRENLESVAFLRTLNDALHGAAAPAGVVTIAEESTAWPGVTAPTGDGGLGFDFKWNMGWMHDTLAYLHEDPIHRRYHHDRMTFGLVYAFSERFVLPLSHDEVVHGKGSLAAKMPDDAWQRLATLRAYFGFMWAHPGKKLLFMGSEFAQWSEFAHDGTPHWDLLDAPAHRGVQRLVRDLNRAYASEPALHALDCDAAGFTWLIGDDRDNSVLAFARRDDSGRVVVAICNFTPVPRSGYRVGLPAPGQWRELMNTDAAVYGGSNAGNDGAVWAQDVPAHGQPWSATLRLPPLATLWLAPA

SEQ ID NO: 6018 - protein, 767 aa, Burkholderia vietnamiensis
MTSRSDLPPGTHAYASSFGATCVNAGHTRFRLWAPASSNAALELQGDFEGKRPGEQRIDMQPAGDGWFEVVAACGAGALYRYVLDDGFAVPDPASRFQPYDVHGPSQVVDPAAYRWRNDAWRGRPWHETVLYELHVGACGGYANVERRLPALAALGVTAIELMPINAFPGARNWGYDGVLPFAPDASYGRPEELKALIDAAHGLGLQVFLDVVYNHFGPDGNFLPRYAPEFFRADRKTAWGPAIDFSRAQPSTFFIDNALYWLDEYRFDGLRIDAAHAIDDDAWLRQLVRRVRAHVGDARHVHLVLENERNTASLLGPDGFDAQWNDDFHNSAHVLLTGERDGYYRAYADAPLRRLARTLGEGFAYQGEPSPLHDGAPRGESSAHLAPTSFVAFLQNHDQVGNRAFGERLRALANDDAVRAATALLLLAPQVPLLFMGEEDGSTQPFQFFTDYRGELADAVRDGRRREFAAFPAFADPAHRDAIPDPNDLGTFVRSSPAHAHENAHQDADTWRRLYRSALTVRAALVTPHLPGARALGVELLGAHVEEMGNGGAAGAGAGAGAGAGAGAGAGAGAGAGAAGTAARAAAGTASAAAGGADAADAGGAAAGAAGAAGAAGAAGAAGAAGAAGSGAGEAGGAGGAGGAGGAGGNGGTGDAGTDGASAPRDDSGDAGDSHGNGNPNDTPIALAARWRLGDGSTLTIAFNPGSHDAVLDTLPVGKVVFETPPRARDRLADRRLPARSCIAWRDGAVNHDALMHRANAPTANT

SEQ ID NO: 6019 - protein, 776 aa, Trichodesmium erythraeum
MTISADQVNQIAWNHHHDPFQVLGSHQIELSGKTMTVIRAYQPSAEAVSVISPIDRKEYPMQSVHNPHFFECVINTPKLANYQLKIKEGEHERVIHDPYAFRSAKLTEFDLQLFGEGNHHRIYEKLGAHITEVDGIKGVYFAVWAPNARNVSILGNFNYWDGRKHQMRKGHTGVWELFIPDIGPGESYKYEVKNWEGHIYEKSDPYGYQQEVRPKTASIVVDLDSYTWNDQEWMEKRRHTDPLTQPISVYECHFGSWIHASAHEPAKLPNGETEPVVQVSELRPDARFLTYRELADRLVSYVKDLGYTHIEMLPVAEHPFDGSWGYQVTGFFAPTSRYGSAQDFMYFVDKCHENGIGVIVDWVPGHFPKDGHGLAFFDGTHLYEHPDPRKGEHKQWGTLVFDYGRNEVRNFLAANALFWFDKYHIDGVRVDAVASMVYHNYMRPDGEWVANKYGGVEYIEAADFLRQVNHLLFSYYPGVLSIAEESTSWPMVTWPTYVGGLGFNFKWNMGWMHDMLDYFEMDPWFRQFHQNNVTFSIWYHHTENYMLALSHDEVVHCKSSILGKMPGDNWQKFANVRALFAYMFTHPGKKTMFMGMELPQWGEWDVWGDLEWHLLEFDAHQGMKRFFRDLNHLYCSEPALYEQDCNEGGFEWIDCNDNNHSVVSFIRRAKDGKDFVVTVCNFTPQPHSHYRVGVPEPGFYTEIFNSDAGNYGGSNMGNLGGKWTDDWFFHDYQQSLDLCLPPLGVVVFQLDKKKTIAMIQESEDVETVEAKAKNAS

SEQ ID NO: 6020 - protein, 540 aa, Unknown
  Frankia sp. EAN1pec
MPKIIAFDEEARRGLERGMNQLADAVKVTLGPKGRNVVLEKKWGVPTITNDGVSIAKEIELEDPYEKIGAELVKEVAKKTNDVAGDGTTTATILAQALVREGLRNVAAGANPMGLKKGIEAAVERVSEELSSVAKDVETKEQIASTASISAGDPAIGSMIAEAMDKVGKEGVITVEESNTFGLELELTEGMRFDKGYISPYFVTDTDRMEAVLDDPYILIANSKISAVKDLLPILEKVMQAGKPLAIISEDVEGEALATLVVNKIRGTFKSTAVKAPGFGDRRKAMLTDIAVLTGGQVISEDVGLKLEGTTVDLLGRARKVVITKDETTIVEGAGDADQIAGRVNQIRNEIEKSDSDYDREKLQERLAKLAGGVAVIKVGAATEVELKEKKHRIEDAVSNAKAAVEEGIVAGGGVALLQAATSAFEKLDLSGDEATGANIVRLALEAPIKQIAFNSGLEGGVVVEKVRNLPTGHGLNAATGEYVDMVATGIIDPAKVTRSALQNAASIAGLFLTTEAVIADKPEKDKAPAMPGGGGEMDF

SEQ ID NO: 6021 - protein, 777 aa, Unknown
  Polaromonas sp. JS666
MHILCLGGGPAGLYFALLMKLQNPAHQVTVVERNRPFDTFGWGVVLSDQTLGNLRVADPVSAQLIGDAFNHWDDVEVFFKGRSVRSGGHGFCGIGRKRLLNILQERCLALGVELVFETDVQDDQAIAAQYQADLVVASDGLNSRIRNRYAETFKPDVELRACRFVWLGTRKTFDAFTFAFEKTEHGWFAAHAYKFDENTSTFIVETPEAVWKAHGLDQMSQEEGIAFCERLFAKYLDGNALMNNATHVRGSAIWIRFPRVVCERWVHHETVEGKRVPIVLMGDAAHTAHFSIGSGTKLALEDAIDLANEFSASAEEFNTGHGMDEVLQAYEARRSVEVLKIQNAARNSTEWFENVNRYSGMEIEQFAYSLLTRSQRISHENLRLRDAKWIESYESWLSGGPVIPPMLTPFKVRGTELKNRIVCSPMATYSAIDGVPQDFHLVHLGARALGGAAMVMVEMTSPNPEGRITPACTGLWNDEQTAAFKRIVDFVHGQSTAKIGMQLGHSGPKGSTQVGWEEMDEPLPAGGAHANWPVVSASAVPYGERNQTPQAMTHSHMETLKQQFVDATRRAAAAGFDWLELHCAHGYLLSAFITPLTNLRSDEYGGNIENRCRYPLEVFRAMRAVWPAHLPMSVRISAHDWAPGGNTPDDAIVVARLFKDAGCDVIDVSSGQTTRQAKPVYGRMYQTPFADRIRNEVGIQTIAVGAISEVDHVNSIIAAGRADLCALARPHLADPAWTLHEAAKLQSQAVDWPKQYLSGRDQLYREISKQQALAAQS

SEQ ID NO: 6022 - protein, 841 aa, Arabidopsis thaliana
MSIEKPFFGDDSNRGVSINGGRYVQYNVYGNLFEVSKKYVPPLRPIGRGASGIVCAAWNSETGEEVAIKKIGNAFGNIIDAKRTLREIKLLKHMDHDNVIAIIDIIRPPQPDNFNDVHIVYELMDTDLHHIIRSNQPLTDDHSRFFLYQLLRGLKYVHSANVLHRDLKPSNLLLNANCDLKIGDFGLARTKSETDFMTEYVVTRWYRAPELLLNCSEYTAAIDIWSVGCILGEIMTREPLFPGRDYVQQLRLITELIGSPDDSSLGFLRSDNARRYVRQLPQYPRQNFAARFPNMSVNAVDLLQKMLVFDPNRRITVDEALCHPYLAPLHEYNEEPVCVRPFHFDFEQPSLTEENIKELIYRESVKLIFLILAILFSLQFVFYPLNFISSSSQPLIKFSVSPVVSGSGSVHEPDQTELKHVVFGIAASAKFWKHRKDYVKLWWKPNGEMNGVVWLDQHINQNDNVSKTLPPIRISSDTSRFQYRYPKGLRSAIRITRIVSETVRLLNGTELEKNVRWIVMGDDDTVFFPENLVKVLRKYDHNQFYYIGSSSESHIQNLKFSYGMAYGGGGFAISYPLAKALEKMQDRCIQRYSELYGSDDRIHACMSELGVPLTKEVGFHQIDLYGKLLGLLSAHPLAPLVSIHHLDLVDPVFPNMGRVNAMRRFMVPAKLDSPSLAQQSICYDADHRWTVSVSWGYTVQIIRGVLSAREMVIPTRTFIDWYKQADERSYAFNTRPIAKSACQRPRVYYLSNALPDLALRRTASEYVRWYDMWEPECDWDMSDPSEFERVIVYKKPDPDRWNKHRAPRRDCCRVLPTTKNGTMVIDVGACKDDEFAEFLVK

SEQ ID NO: 6023 - protein, 204 aa, Lycopersicon esculentum
MARAQQRYRGVRQRHWGSWVSEIRHPLLKTRIWLGTFETAEDAARAYDEAARLMCGPRARTNFPYNPNMPQTSSSKLLSTTLTAKLHKCYMASLQMTKTSPQGQKLAKNATNVQESVINSYKMKQQMLVPKPSVLLTHHDHHEEAKVVNLGVGVIRKVEDQVLEGIPQFVKPLEDDHIEQMIEELLDYGSIELCSNVVPSHQIQ

SEQ ID NO: 6024 - protein, 519 aa, Lycopersicon esculentum
MPADPDNSSAMNDSTGSGEASVSSSGNQVVPLKESAKKKRNLPGMPDPDAEVIALSPTTLLATNRFVCEICSKGFQRDQNLQLHRRGHNLPWKLRQRSSNEVKKRVYVCPESSCVHHDPSRALGDLTGIKKHFCRKHGEKKWKCDKCSKKYAVQSDLKAHSKICGTREYKCDCGTLFSRAFCDALAQESAKTLPEKPPSTNEEPKTQAVASSSPPPSPPAPPPATESQPPPPPPAAPKSLMTPTVPPSTAVMSFASSVQNRELRENPVTNSAGAATKQVVEEAAVVASLTGNCSSSCSNGSSSSNVFGSLFASSTASGSLPSQAPVFSDIFRAMAPEHTLEMAPPSSTEPISLGLAMSHSSSIFRPAGQERRQYAPAPQPAMSATALLQKAAQMGAAATSSSFLRGIGVMSSTSSSNGHQEWSGRPSDANGASLAAGLGLGLPCDAGSGLKELMLGTPSVFGPKHPTLDLLGLGMAASVGPSPGLSALLTSMGSNLDMVTSAGSFGSADFSGKDLGRNS

SEQ ID NO: 6025 - protein, 722 aa, Rubrobacter xylanophilus
MRREEAIRAVVAGDHPDPFSFLGPHEEAGRRVVRTFLPGAARVRVLSAAGRPLGELERVHPEGFFSGPLSGNGRYRLRVLWEGGGEDELEDPYRFPPVLSDYDLYLFGEGNNHRIYRHLGAHPAEMDGVCGTAFAVWAPNARRVSVVGDFNLWDGRRHPMRNRNGVWEIFLPGVGPGALYKYEIKDAGGSLLPLKADPYGFFAEQYPGTASIVWDLSRHRWEDGEWMERRGSRNAPDAPMAIYEVHLGSWRRRPDGSHLTYRELAEELVPYVAGLGYTHVELLPPMEHPFGGSWGYQPVGLFAPTSRFGPPEDFKHLVDAFHRAGVGVIADWVPAHFPEDAHGLARFDGTHLYEHADPRKGRHPDWGTLIYNYGRNEVRNFLISNALFWLDEYHIDGLRVDAVASMLYLDYSRKEGEWVPNEHGGNENLEAIAFLRRMNEVVYGEAPGAFTVAEESTAWPMVSRPTYMGGLGFGYKWNMGWMHDTLQYMKEDPVHRRYHHDRITFGLLYAFNENFILPLSHDEVVHGKGSLLGRMPGDRWQRFANLRAYYGFMYGHPGKQLLFMGGEFAQEREWDSGSQLDWHLLEGGENRGVRDLVADLNALYRATPALHQVDFEPEGFEWVEGGDAEQSVVSFLRRARNPEDFVLVVSNFTPVVRHGYRVGVPASGPYAEVLNTDDPRYGGSGVANGELEAEEVPWHGRPFSLRLTLPPLATVFLRPRPV

SEQ ID NO: 6026 - protein, 484 aa, Listeria monocytogenes
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRKVVEDFTNYAALLFERFNGRVKYWVTLNEQNVFISHGYKLAYHPPGVSDDKRMFAANHNANLANASAIAKFRELGTSGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 6027 - protein, 487 aa, Oceanobacillus iheyensis
MSNKRNTLTTASGAPVGDNQNSITAGHNGPTLLQDFHLLEKLAHFNRERIPERVVHAKGAGAHGYFEVTNDEISKYTKADFLSEKGKRTDMFIRFSTVAGEQGSADTVRDPRGFAVKFYTEEGNYDLVGNNTPIFFIRDAIKFPDFIHTQKRNPQTHLKDKDMVWDFWSLSPESLHQVTYLHSDRGLPATLRHMNGYGSHTFKWVNAEGEAFWVKYHFISEQGIKNLDPALADKIAGENPDYHTEDLFNAIEEGDHPAWKLYVQIMPYEDAKTYKWDPFDVTKIWSKKDYPRIEVGRMVLDRNPENYFAEVEQAAFSPGQFVPGIEASPDKMLQGRLFGYSDAHRYRLGANHHSIPVNRPKNEVNNYQRDGFMSVDGNGGNKPNYEPNSVNGPTEDSEAKINPFEIYGQADSVTYDSDDHYTQAGDLYRLMSADEKDRLVEAFVGHMTPVTKDEIKLRQIEHIYKADAEWGERVAQGLGLQVPESVK

SEQ ID NO: 6028 - protein, 163 aa, Glycine max
RGDLFVHWEKGRDVFERLLIDSDWAINNGNWMWLSCSSFFYQYNRIYSPTTFGKKYDPNGDYIRHFLPVLKDMPREYIYEPWTAPKSIQTKANCIIGKDYPMPVVSHDSASKECRRKMGEAYALNKELNGLVSEDDLKNLRRKLDESEGQEAGAKRYKQQLIG

SEQ ID NO: 6029 - protein, 549 aa, Prosthecochloris aestuarii
MTAKDILFDAEARAKLKVGVDKLANAVKVTLGPAGRNVLIDKKFGAPTSTKDGVTVAKEVELEDAFENMGAQMVREVSSKTSDVAGDGTTTATVLAQAIYREGLKNVAAGARPIDLKRGIDLAVKDVVAELREISRDITGKKEIAQVGTISANNDPEIGELIAEAMDKVGKDGVITVEEAKGMDTELTVVEGMQFDRGYLSPYFVTNSEKMDADLEDPYILIYDKKISNMKELLPVLEKTAQSGRPLMIIAEDIEGEALATLVVNKLRGTLKVCAVKAPGFGDRRKAMLEDIAILTGGTVISEEKGYKLENATISYLGQAASITVDKDNTTIVDGKGQADDIKARIGEIKGQIEKSTSDYDTEKLQERLAKLSGGVAVLNIGASTEVEMKEKKARVEDALHATRAAVQEGIVAGGGVALIRAAKALDATNPENEDQKTGVDIIRRALEEPLRQIVANTGTTDGAVVVEKVKNSEGDYGFNARTEEYMNLIEAGVVDPTKVTRTALENAASVAGILLTTEAAITDIKEDGSDMPPMPGGMGGMGGMGGMM

SEQ ID NO: 6030 - protein, 329 aa, Campylobacter coli
MKDGALTVISPIEGTPADKAGIKSGDIILKINDEATLGINLNDAVDKMRGKPKTQITLTIFRKGATKPFDVTLTRDIIKVESVYAKLIEDENILYLRVTNFDKNVVDMTSKELKKHPNVKGVILDLRNNPGGLLNQATGLVNLFVDKGVIVSQKGRVTSENQEYTANPKNKISDSSLVVLVNGGSASASEIVSGALQDLKRAIIVGENTFGKGSVQQIIPINETEALRLTIARYYLPSGRTIQAVGVKPDIEVFPGKVNTQEDGFNIKESDLKQHLESELEKLDKNEKKEDKKEQKNDKNIITQKQINDDAQLKSAIDTIKILNIKQGQ

SEQ ID NO: 6031 - protein, 547 aa, Haemophilus ducreyi
MAIKDVKFGNDARVKMLKGVNILADAVKVTLGPKGRKVVLDKAYGAPTITKDGVSVAREIELEDKFENMGAQMVKEVASKANDVAGDGTTTATVLAQSIVSEGLRAVAAGMNPMDLKRGIDKAVAAVVEELKAISKPCETSKEIEQVGTISANSDETVGKLIAQAMEKVGKEGVITVEDGTGLDDALDVVEGMQFDRGYLSPYFINKPEAGTVELDNPYIILVDKKISNIREILPVLEAVAKAGKPLLIIAEDVEGEALATLVVNTMRGIVKVAAVKAPGFGDRRKAMLQDIAILTAGTVISEEIGMELEKATLEELGQAKRVVITKDNTTIIDGIGDEAQIKARVVQIRQQIEDSTSDYDKEKLQERVAKLAGGVAVIKVGAATEVAMKEKKDRVDDALHATRAAVEEGIVPGGGVALVRAANKVSATLTGDNEEQNVGIKLALRAMEAPLRQIVENSGEDASVVARDVKDGSGNFGYNATTEEYGDMLEMGILDPTKVTRSALQFAASIAGLMITTECMITDLPKEDKLDAQAAMGGMGGMGGMM

SEQ ID NO: 6032 - protein, 550 aa, Rickettsia prowazekii
MTTKLIKHGSKAREQMLEGIDILADAVKVTLGPKGRNVLIEQSFGAPKITKDGVTVAKSIELKDKIKNAGAQLLKSAATKAAEVAGDGTTTATVLARALAREGNKLVAAGYNPMDLKRGMDLAVNAVVEEIKRSSKKINSQEEIAQVGTISSNGDKEIGEKIAKAMEEVGKEGVITVEEAKNFSFDVEVVKGMMFDRGYLSPYFVTNSEKMVAELENPFILLFEKKLSNLQPMLPILEAVVQSQRPLLIIAEDVEGEALATLVVNRLRGGLKVAAVKAPGFGDRRKAMMEDIAILTKGELITEDLGMKLENVNIKNLGTAKRVTISKENTVIVDGNGDKKNIEDRVLQIKSQIAETTSDYDKEKLQERLAKLSGGVAVLKVGGATEVEVKERKDRVEDALAATRAAVEEGVVAGGGVTLLHASQTLTKLKVENKDQQAGIEIVIEALKDPLKQIVKNAGENGGVVVGKLLEHNDKNYGFNAQDMQYVDMIKAGIIDPAKVVRTALQDAASVASLIITTETLIVDEPSDKEEPMPMRGGMGGMGGMGGMDF

SEQ ID NO: 6033 - protein, 159 aa, Zea mays
MSLIRRGNAFDPFSLDLWDPFEGFFPFGSGGVRSLVPSLPRTSSETAAFAGARIDWKETPEAHVFKADVPGLRKEEVKVEVEDGNVLQISGERNKEHEEKNDRWHRVERSSGKFLRRFRLPDNAKADQIKASMENGVLTVTVPKEEAKKADVKNVQITG

SEQ ID NO: 6034 - protein, 686 aa, Bacillus subtilis
MSDDQNKRVNEHSKDEQLEQYRTDNSGKKMTTNQGLRVSEDEHSLKAGVRGPTLMEDFHFREKMTHFDHERIPERVVHARGFGVHGFFQVYEPMTEYTRAKFLQDPSVKTPVFVRFSTVAGSKGSADTVRDARGFATKFYTEEGNYDLVGNNIPVFFIQDAIKFPDLVHAFKPEPHNEMPQAATAHDTFWDFVANNPESAHMVMWTMSDRGIPRSYRMMEGFGVHTFRFVNEQGKARFVKFHWKPVLGVHSLVWDEAQKIAGKDPDFHRRDLWETIENGGKVEYELGVQMIDEEDEFKFDFDILDPTKLWPEELVPVKIIGKMTLNRNQDNVFAETEQVAFHPGNVVPGIDFTNDPLLQGRLFPYTDTQLIRLGGPNFHEIPINRPVCPFHNNQYDGYHRMTINKGPVAYHKNSLQNNDPSPATAEEGGYVHYQEKVEGKKIRQRSDSFNDYYSQAKLFWNSMSPVEKQHIISAFCFEVGKVKSKDVQRQVVDVFSNVDADLAEEIAKGVGVAAPAKRKASKENLTSPALSQARTVKTASTRKVAVLAGNGFHEKELQTVLEALKQEGITVDIISQNLGYMTSGSGQQLEASGTFLTVDSVLYDAVYAAGGLELKDNKQAMAFIREAYNHYKAIGAANEGIDLLQSSVGTTEGLGIVTAKDEPDYTAFSKAFIDAVAAHRHWDRRI

SEQ ID NO: 6035 - protein, 481 aa, Arabidopsis thaliana
MESVPESVPSPNSNTPSIPPPVNSVPPFLSKTYDMVDDPLTNEVVSWSSGNNSFVVWSVPEFSKVLLPKYFKHNNFSSFVRQLNTYGFRKVDPDRWEFANEGFLRGRKQLLKSIVRRKPSHVQQNQQQTQVQSSSLGACVEVGKFGIEEEVERLKRDKNVLMQELVRLRQQQQATENQLQNVGQKVQVMEQRQQQMMSFLAKAVQSPGFLNQLVQQNNNDGNRQIPGSNKKRRLPVDEQENRGDNVANGLNRQIVRYQPSINEAAQNMLRQFLNTSTSPRYESVSNNPDSFLLGDVPSSTSVDNGNPSSRVSGVTLAEFSPNTVQSATNQVPEASLAHHPQAGLVQPNIGQSPAQGAAPADSWSPEFDLVGCETDSGECFDPIMAVLDESEGDAISPEGEGKMNELLEGVPKLPGIQDPFWEQFFSVELPAIADTDEILSGSVENNDLVMEQEPNEWTRNEQQMKYLTEQMGLLSSEAQRK

SEQ ID NO: 6036 - protein, 277 aa, Corynebacterium sp.
TVPSIVLNDGNSIPQLGYGVFKVPPADTQRAVEEALEVGYRHIDTAAIYGNEEGVGAAIAASGIARDDLFITTKLWNDRHDGDEPAAAIAESLAKLALDQVDLYLVHWPTPAADNYVHAWEKMIELRAAGLTRSIGVSNHLVPHLERIVAATGVVPAVNQIELHPAYQQREITDWAAAHDVKIESWGPLGQGKYDLFGAEPVTAAAAAHGKTPAQAVLRWHLQKGFVVFPKSVRRERLEENLDVFDFDLTDTEIAAIDAMDPGDGSGRVSAHPDEVD

SEQ ID NO: 6037 - protein, 252 aa, Brassica napus
  misc_feature (14)..(14): Xaa can be any naturally occurring amino acid
MGRGRVELKRIENXINRQVTFAKRRNGLLKKAYELAVLCDAEVSLIVFSNRGKLYEFCSTSNMLKTLERYQKCSYGAPRVRNKPAKELENSYREYLKLKGRYENLQRQQRNLLGEDLGPLNSKELEQLERQLDGSLKQVRCIKTQYMLDQLTDLQGKEHILLEANRALSMKLEDMIGVRSHQIGGAWEGGDQHNVAYGHHQAQSQGLFQSLECDPTLQMGYNHPVCSEQMAVTAQGQSSQPGNNGYIPGWML

SEQ ID NO: 6038 - protein, 515 aa, Aspergillus nidulans
MVHLASIKKDDDFEPVVNRVDSIKLDTIEEDDYSATVYGTRFATQQLPHAEMPDREMPREVAYRMIKDELSLDGNPMLNLASFVTTYMEDEAEKLMAESFSKNFIDYEEYPQSAEIQNRCVNMIARLFNAPTDSDTDHPMGTSTVGSSEAIMLGTLAMKKRWQNKRKAEGKDYSRPNIVMNSAVQVCWEKAARYFDVEERYVYCTEERYVIDPQQAVDLVDENTIGICAILGTTYTGEYEDVKAINDLLVERGLDCPIHVDAASGGFVAPFIHPTLQWDFRLEKVVSINVSGHKYGLVYPGVGWVVWRSPEFLPKELIFNINYLGAEQASFTLNFSKGASHVIGQYYQMIRLGKRGYRSVMVNITRIADYLADQLEQLGFIIMSQRRGRGLPLVAFRLPADRADETFDEFAIAHQLRERGWIVPAYTMAPHSNNLKLMRVVVREDFSMSRCDQLLSDIKLALKSLREMDQAMLERYTQHVRSHTTKSHRAKHTHPHYKNETHSLQGRTGKTHGVC

SEQ ID NO: 6039 - protein, 222 aa, Glycine max
MGRGKIEIKRIENTTNRQVTFCKRRNGLLKKAYELSVLCDAEVSLIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNVIQALASRNFFNPNMLEGGTVYPHSDKKILHLG

SEQ ID NO: 6040 - protein, 480 aa, Unknown
  Azoarcus sp. EbN1
MTEHSKLTTAAGCPVVDNQNVMTAGPRGPQLLQDVWFLEKLAHFDREVIPERRMHAKGSGAYGTFTVTNDITRYTRAKLFSELGKKTDLFVRFSTVAGERGAADAERDIRGFAVKFYTEEGNWDLVGNNTPVFFMRDPLKFPDLNHAVKRDPRTNLRSARNNWDFWTSLPEALHQVTIVMSDRGIPASYREMHGFGSHTFSLINANNERYWVKFHMESLQGIRNLTDAEAEAAIGKCRETHQRDLFDAIERGDFPKWKFCVQVMPEADAAKVPYHPFDLTKVWPHKDYPLIEVGILELNRNPANYFAEVEQAAFNPANVVPGIGFSPDKMLQGRLFSYGDAQRYRLGVNHVHIPVNAPRCPAHSYHRDGAMRVDANYGATLGYEPNSYGEWQEQPDFREPPLALGGAADHWDFRKDDDDYYSQPRALFRLMTPEQRQTLFENTARAMGDAPLEIKQRHVENCSRCDPAYGAGVAKALDLG

SEQ ID NO: 6041 - protein, 750 aa, Salmonella enterica
MSHNEKSPHQSPVHDTRESQPGLDSLAPSDGSHRPTPEPTPPGAQPTAPGSLKAPETANDKLTALDAFRKGSENYALTTNQGVRIADDQNSLRAGSRGPTLLEDFILREKITHFDHERIPERIVHARGSAAHGYFQPYKDLSDITKAAFLCDPQKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAISDRGIPRSYRTMEGFGIHTFRLINAQGKATFVRFHWKPLAGKASLVWDESQKLTGRDPDFHRRDLWEAIEAGDFPEYELGLQLIAEEDEFKFDFDLLDPTKLIPEELVPVQRVGKMVLNRNPDNFFAENEQAAFHPGHIVPGIDFTNDPLLQGRLFSYTDTQISRLGGPNFHEIPINRPTCPYHNFQRDGMHRMDIDTNPANYEPNSINDNWPRETPPAPKRGGFESYQERVDGNEIRERSPSFGEYYSHPRLFWLSQTPIEQQHIIDAFSFELGKVARAYIRERVVDQLAHIDVTLAQGVAHNLGFALTHEQTQIAPPPDVNGLKKDPALSLYAVPDGDVKGRVVAILLNDKVNAAELLTIFQALKAKGVHVKLLYSRMGEVTADDGSTLTIAATFAGAPSLTVDAVIVPCGNIADIESCGDARYYLLEAYKHLKPIALAGDARRFKALLNIDSQGEEGLVEADNVDHHFMDTLLTLMAAHRVWSRAGKINAIPA

SEQ ID NO: 6042 - protein, 375 aa, Psychrobacter arcticus
MPNTSTLFSSIQLGPYTLKNRIVLPPLTRCRSTQPGNIPNDLMASYYAQRASAGFMVTEGTQIEPRGQGYAWTPGIHSPAQIEGWKKVTQAVHAKGGIIFAQLWHVGRVSHTNLQPNQNQPIAPSAITANNVKVFIETGPGEGALADPSEPRALSTEEVGELVAMYAQAARNALEAGFDGVELHCANGYLVNQFISEHSNTRDDQYGGSLTNRLRFLKEVVAAVSDVVGADRLGVRFAPLFASTNETRVYLGLVEADPHHTYIEAIKVLEQAGIAYLSIAEADWDNAPDLPEPFYQAVRAEFSQRIIYAGKYTVQKSVDILSKGYGDLFAFGRPFIANPDLPERIANNWSLNEVDPATMYGGTAIGYSDYPRYQE

SEQ ID NO: 6043 - protein, 243 aa, Mycobacterium fortuitum
MNTQPNVFTDVFSEAKLGPVTLRNRIIKAATFEASTPNALVTEDLINYHRLPAAGGVGMTTVAYCAVSPGGRTDGWQIWMRPEAVPGLTKLTEAIHAEGAAISAQIGHAGPVANSRTNKAKALAPVRFFNPLSMRFAKKASIDDIRDVTEAHANAARLAIDSGFDAVEVHLGHNYLASSFLSPLINRRTDEFGGSLENRAKVARGVVRAVRDAVDKHGDRKIAVIAKLNMSDGIRGGIPIDES

SEQ ID NO: 6044 - protein, 156 aa, Prunus dulcis
MDVRIAGLDSPLFSTLQHIMDFTDEPDKSFNAPTRTYVRDAKAMASTPADVKEYPNSYVFVVDMPGLKSGDIKVQVEDDNVLLITGERKREEEKEGAKYVRMERRVGKFMRKFVLPENANVEAISAVCQDGVLTVTVEKLPPPEPKKSKTIEVKIA

SEQ ID NO: 6045 - protein, 257 aa, Trichodesmium erythraeum
MDIYRLPALSDNYIFLLHDPNQNIGAVVDPAEVRPVIDKLESLGAELVTIFNTHHHFDHVGANKQLIQKFPQLKVYGGVEDRGRIPGQQVFLQEGDRVHFADRVGEVLFVPGHTIGHIAYYFPSVAFGETGELFCGDTLFAGGCGRLFEGTPAQMVDSLNKLRNLPDNTRIWCAHEYTLKNLQFAITVDKDNTDLQSRWAEVKTARGRNEATVPSMIGVEKRTNPFLRWEQPALQLAVQSQDPVQTFARLRGRKDRF

SEQ ID NO: 6046 - protein, 229 aa, Arabidopsis thaliana
  misc_feature (198)..(198): Xaa can be any naturally occurring amino acid
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRRKMMGEELSGLTVKELQNLENQLEISLHGVRMKKDQLLMGEIQELNRKGNLIHQENVELYKKVYGTQDDNETNRDSVLTNGLGIGEDLQXACESPAKPATATATTLQGIFRNYKIGIAIAL

SEQ ID NO: 6047 - protein, 257 aa, Magnetospirillum magnetotacticum
MAKIIVEQIPVLSDNYVYLAHEPLGGVTAAIDPAVSEPVLERLAARGWTLTHILNTHHHGDHTGANLDLARRTGCAVVGAARDSGRIPGITLEVSDGETFMLGHAAVTVLDVPGHTSGHVAYWFADSHVLFCGDTLFSLGCGRLFEGSAEEMWASLKKLRDLPSDTMAYPAHEYTAANGRFAKLVERDNQALKARLDEVERLRAGNRPTVPVRLAEERAVNPFLRADTASVARAVGMEPGADPAQVFAELRRRKDVF

SEQ ID NO: 6048 - protein, 727 aa, Xylella fastidiosa
MRLRILNSLKVALLTLAITTAPALMAKSDSASPQVATPDQTTATKLVYGLLSDSRYAYRLRPLDEAMSKDIFKRYLEALDSNKQFFTEADIDNFSAFKAEIPDSIRNGNLKPAFSIFAVYKKRVAERVTYANQLLKQNFDFSGQEKYEYDRSKAPWPASPQDLDDIWRRSTMNDWLRLKLAGKKPEDIRKTLKKRYANLLKTVNELKGEDVFQLYLNAYTNSIDPHTDYFTPRTADAFNQQMSLSLEGIGAQLQKQEDMVIIREVIPGGPTALDGTLKPGDRIVGVGQGKGGPIEDVIGLRIDDVVSKIRGKKDTQVRLEYIPAESGIDGAHRIVTLTRQKVRLAEQAAKGETITIEGSNGDAQRRIGIIKLPTFYEDFEGRRRNVANYTSATRDVAKLLTNFKTDKVDGVVLDLRNNGGGSLDEAIQLTGLFIEQGPVVQVRESGGRVTVNGDRDDKVTWDGPLAVLINRGSASASEIFAGAIQDYGRGLVIGETSFGKGTVQNIVDLDRWPANESRRFGQVKLTIAQFFRISGSSTQHKGVLPDIAFPASVGATEFGESTYENALPWTQIASLQHTQYGNFSPILSKLKKIHISRTANDIEFKWWQEDVHNFSLEKEKKYVILNEAKRLAERRKQETQHRERQTIRKNLGLQLDPLSEESDDGLIGNERDIAKDTAREKLADKRPDPLLHESAAILTDTINLLEKDQILSAQVLLQSTTPGHWAN

SEQ ID NO: 6049 - protein, 420 aa, Zygosaccharomyces rouxii
MATHEEFIRTQVFGTVFEITNRYTDLNPVGMGAFGLVCSATDTLVGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKDHVHQFSIITDLLGSPPRDVINTICSENTLKFVTSLPHRDPVPFQERFKTVEPDAVDLLRRMLVFVPKKRITAADALVHPYLAPYHDPTDEPTAEAQFDWDFNDADLPVDTWRVMMYSEILDFHKIGGGDGQIDTNAAFDDQVAAAHAAAMAQHHHQTQQQSSGKHTNPTTSSSAATITVTVPIAITMPSLIMVIKRFTT

SEQ ID NO: 6050 - protein, 375 aa, Bradyrhizobium japonicum
MKFPALFKPLQVGPYELAHRVAMAPLTRMRAERDSFSPRPLNAEYYGQRATPGGLLIAEASPVLSHGRGNPATPGIYSEAQIAGWRKVTDAVHAKGGIIFLQLWHVGRVSHSSFHGGELPVSASAIAIKAEGMKAMTAEGKIADYETPRALETDEVKGIVEAFRQGAKNALAAGFDGVEIHGANGYLLEQFLQSRSNQRTDQYGGGIENRARLLLDVTQAAIDVWGANRVAVRLSPHGIANDSGEPDPMPLYTHVVKALDKLGLAYLHFIEPRSSGAGRADVHWENVPSAMVLFRPLYSGVLMTAGGFTGETANAAIADGHADIIAFGRIFISNPDLPRRLRHDYPITPYNRATFYGGEEKGYTDYPAYDELTPA

SEQ ID NO: 6051 - protein, 448 aa, Zea mays
MSAAATKVKRRVGKYELGRTIGEGTFAKVRFAKNTETGEPVAVKILDKEKVLRHKMAEQIKREISTMKLIKHPNVVRIYEVMGSKTKVYIVLEYVTGGELFDTIANQGRMREGEARSYFQQLINAVDYCHSRGVYHRDLKPENLLLDSYGNLNVSDFGLSALSQQIKDDGLLHTTCGTPNYVAPEVLEDQGYDGAMADLWSCGVILFVLLAGYLPFEDSNLMTLYKKISNAEYTFPPWTSFPAKRLLTRILDPNPMTENSCDFRITIPEILEDEWFKKGYKRPEFDEKYDTPLDDVDAVFNDSEEHHVTEKKEEEPVALNAFELISRSAGLNLGNLFDSEQEFKRETRFTSKCPPKEIIRKIEEAAKPLGFGVQKKNYKLRLEKVKAGRKGNLNVATEILQVAPSLHMVQVRKAKGDTLEFQKFYKNLSKTLKDVVWKSEDLQMRAAS

SEQ ID NO: 6052 - protein, 453 aa, Magnetospirillum magnetotacticum
MTIAKAADAAPKGGRQFPKDFFWGASTAAYQIEGAYDTDGRGMTIWDKFTADGKIMDGSSAKVACDHYHRYPEDIALMKAAGFNAYRFSLAWPRIIPAGTGAINPKGLDFYDRLVDKILEAGIKPMACLYHWDLPQPLEDKGGWQGRDIVGPFAEYARIATKRLGDRVKDWYMLNEPNVVAIIGYGIGEHAPGYKLGEDGILKALHHQNLAQGTALRAIRAEHSDAVLGTVINLQPCRSEDDDPKNRAAAIRWDAVWNRVPLDGVMRGAIPDVLAEKMKHIVKPGDLETIKFPIDMLGINYYSRMTMKHEEGHPFDVFWGDAHCDRWTAMAWPVQPDGLYDLLREFKELYGNPAVFIAENGAAYDDVVAPDGQVHDAERVAFLKDHVSEVARAVKDGCNVKGYLAWSLLDNFEWAYGLSKRFGLVRVDYDTLKRTPKDSYKWFAEVIKSGRVD

SEQ ID NO: 6053 - protein, 321 aa, Parasitella parasitica
MVVDYLTLDRTEDKMPLRGFGCWKIEKKDAENTIYQAIKIGYRLFDGACDYGNEVEVGRGINKAIKEGLVKREELFIVTKLWNTFHSKQHVRTAFDRQLKDWGLEYFDLYLIHFPIPLQYVDPAVSYPPEWYVPHADKLNFERSPIHECWAEMEKLVQAKLTRNIGVANFNCQAILDLLSYAKIKPAVLQIEIHPLLPQERLVKWVQEQGIQVTAYSSFGPTSYVDLCESGKTYSSLLANADVKSIANKHNANTGQILLRYALDRNIAVIPKSVHEDRMKSNLDILNIQLDQDDRKILNSLKTNQRFNDPMIFGFGLPLFD

SEQ ID NO: 6054 - protein, 485 aa, Nitrosomonas europaea
MDDAKKKLTTSAGAPVADNQNVMTAGPRGPMLLQDIWFLEKLAHFDREVIPERRMHAKGSGAYGTFTVTHDITRYTRANIFSQIGKKTDLFVRFSTVAGERGAADAERDIRGFAIKFYTEEGNWDLVGNNTPVFFLRDPLKFPDLNHAVKRDPRTNLRSARNNWDFWTLLPEALHQITIVMSDRGLPATYRHMHGFGSHTFSFINARQERYWVKFHFRTQQGIKNLTDAEAEALVGKDRESHQRDLYESIENGEFPRWTLFVQIMPESDAASLPYNPFDLTKVWPHKDYPLIEVGVMELNRNPENYFAEVEQAAFNPASVVPGISFSPDKMLQGRLFSYGDAQRYRLGVNHYQIPVNAPRCPFHHYHRDGAMRVDGNQGSTLGYEPNSYQEWQQQPEYAEPPLTLEGAAAHWNHRVDEDYYIQPGNLFRLMNSSQQQVLFDNTARSIGEAPREIQIRHITNCLKADRAYGEGVARALGIALSEVD

SEQ ID NO: 6055 - protein, 76 aa, Zea mays
RSTLPALELCYSMSQRLQLDDEKPPQQHEGAAPDAATPSPPVTNWKISSPGDSPDEVKARLKYWAQAVACTVRLCS

SEQ ID NO: 6056 - protein, 254 aa, Cucumis sativus
MSCYEEEDEESGVVGLRRSSSSSRTGRGKIEIKRIENTTNRQVTFCKRRNGLLKKAYELSVLCDAEVALIVFSSRGRLYEYANNSVRATISRYKKAYSDPSTAMTVSEANTQFYQQESAKLRAQIGNLQNLNRHLLGESISSLSVKDLKSLEVKLEKGISRIRSRKNELLFSEIEYMQKREIELHTNNQLIRAKIAETERSQQNTNASNNNGIATRRGEEGSMGTNLEDNNHHQYDSTNYFDPHHNHPISLQLV

SEQ ID NO: 6057 - protein, 2471 aa, Candida albicans
MSMNFFNSSEPARDHKPDQEKETVMTTEHYEFERPDVKAIRNFKFFRSDETETKKGPNLHISDLSPLESQSVPPSALSLNHSIIPDQYERRQDTPDPIHTPEISLSDYLYDQTLSPQGFDNSRENFNIHKTIASLFEDNSSVVSQESTDDTKTTLSSETCDSFSLNNASYLTNINFVQNHLQYLSQNVLGNRTSNSLPPSSSSQIDFDASNLTPDSIPGYILNKKLGSVHQSTDSVYNAIKIPQNEEYNCCTKASASQNPTNLNSKVIVRLSPNIFQNLSLSRFLNEWYILSGKHSSKEHQIWSNESLTNEYVQDKTIPTFDKESARFRPTLPINIPGILYPQEIINFCVNSHDYPLEHPSQSTDQKRFAMVYQDNDYKTFKELSMFTLHELQTRQGSYSSNESRRKSSSGFNIGVNATTTEAGSLESFSNLMQNHHLGATSTNGDPFHSKLAKFEYGVSKSPMKLIEILTDIMRVVETISVIHELGFVHNGLTSSNLLKSEKNVRDIKITGWGFAFSFTENCSQGYRNKHLAQVQDLIPYMAPEVLAITNSVVDYRSDFYSLGVIMYELVLGILPFKNSNPQKLIRMHTFENPIAPSALAPGWISEKLSGVIMKLLEKHPHNRYTDCHSLLHDLIEVKNMYISKLLDSGETIPNSNLNLSDRQYYLTKENLLHPEKMGITPVLGLKESFIGRRDFLQNVTEVYNNSKNGIDLLFISGESGRGKTIILQDLRAAAVLKQDFYYSWKFSFFGADTHVYRFLVEGVQKIITQILNSSEEIQNTWRDVILTHIPIDLSILFYLIPELKVLLGKKYTSIYKHKIGMGMLKRSFKEDQTSRLEIKLRQILKEFFKLVAKQGLSIFLDDVQWCSEESWRLLCDVLDFDSSGEVRESYNIKIVVCYALNADHLENVNIEHKKISFCRYAKQSHLNLREFSIPHIPLEDAIEFLCEPYTRSHDHECNSKKSDVIANLNCTNEYPQNTCKVIPSIIQELYQSSEGNVLLLIFLTRMTKLSGKVPFQRFSVKNSYLYDHLSNSNYGTTRKEILTNYLNMGTNSDTRALLKVAALISNGSGFFFSDLIVATDLPMAEAFQLLQICIHSRIIVPTSTYYKIPMDLIASDQTPFDLTDDNIWKLATLCSYKFYHDSICTHIIKELNASGEFKELSRLCGLRFYNTITKERLLNIGGYLQMATHFRNSYEVAGPEENEKYVEVLVQAGRYAISTYNMKLSQWFFNVVGELVYNLDSKTQLKSVLTIAENHFNSREFEQCLSVVENAQRKFGFDRLIFSIQIVRCKIELGDYDEAHRIAIECLKELGVPLDDDDEYTSENSLETCLGKIPLSVADIRGILKIKRCKNSRTLLMYQLISELIVLFKLQGKDKVRRFLTAYAMSQIHTQGSSPYCAVILIDFAQSFVNETTTSGMLKAKELSIVMLSLINRAPEISLSYVQSIYEYYFSCHAVFFESIEKMSDLIHPGNASSHCTRSSYYSSFHLIVNVSKIFFSCMNGESFKMFSTFKCKSYLTGDPQMPEMDNFLYDSEMLLAGHSELNEFMRKYQSFNQTSVGKFCYYLIVLLVMSREHRFDEAADLVLKVLEDLSEKLPVSFLHHQYYLICGKVFAYHQTKTPESEEQVERILARQFERYELWASTNKPTLLPRYLLLSTYKQIRENHVDKLEILDSFEEALQTAHKFHNVYDMCWINLECARWLISINQKRHRISRMVKQGLKILRSLELNNHLRLAEFEFDEYIEDEDHRNKWAGLTNNPTLDTVTTWQQQNMPDKVSPCNDKQLVHGKQFGKKEFDSHLLRLHFDGQYTGLDLNSAIRECLAISEALDENSILTKLMASAIKYSGATYGVIVTKKNQETPFLRTIGSQHNIHTLNNMPISDDICPAQLIRHVLHTGETVNKAHDHIGFANKFENEYFQTTDKKYSVVCLPLKSSLGLFGALYLEGSDGDFGHEDLFNERKCDLLQLFCTQAAVALGKERLLLQMELAKMAAEDATDEKASFLANMSHEIRTPFNSLLSFAIFLLDTKLDSTQREYVEAIQSSAMITLNIIDGILAFSKIEHGSFTLENAPFSLNDCIETAIQVSGETILNDQIELVFCNNCPEIEFVVGDLTRFRQIVINLVGNAIKFTTKGHVLISCDSRKITDDRFEINVSVEDSGIGISKKSQNKVFGAFSQVDGSARREYGGSGLGLAISKKLTELMGGTIRFESEEGIGTTFYVSVIMDAKEYSSPPFSLNKKCLIYSQHCLTAKSISNMLNYFGSTVKVTNQKSEFSTSVQANDIIFVDRGMEPDVSCKTKIIPIDPKPFKRNKLISILKEQPSLPTKVFGNNKSNLSKQYPLRILLAEDNLLNYKVCLKHLDKLGYKADHAKDGVVVLDKCKELLEKDEKYDVILMDIQMPRKDGITATRDLKTLFHTQKKESWLPVIVALTANVAGDDKKRCLEEGMFDFITKPILPDELRRILTKVGETVNM

SEQ ID NO: 6058 - protein, 39 aa, Zea mays
YHVTNFFAPSSRFGTPEELKSLIDRAHELGLLVLMDVVH

SEQ ID NO: 6059 - protein, 495 aa, Zea mays
MTMDPTKFRPSSSHDTTVTTTNAGAPVWNDNEALTVGPRGPILLEDYHLIEKVAHFDRERIPERVVHARGASAKGFFESTHDVTSLTCADFLRAPGVRTPVIVRFSQVIPEPGSGRTIRDARGFAVKFYTREGNWDLLGNNFPVFFIRDGIKFPDVIHAFKPNPRSHVQEYWRVFDFLSHLPESLHTFFFLFDHVGVPSDYRHMEGFGVNTYTFVSAAGKAQYVKFHWKPTCGERSILTDEEARVGGRNHSHTQDLYDSIAAEGSFPEWTLYVQVMDPAQQEQYDFDPLDDTKTWPEDLLPLRPVGRLVLDRNVDNFLNENEQLAFGPGLVVPGIYYSDDKMLQCRVFAYADTQRYRLGPNYLMLPVNAPRCGTHNNHYDGAMNLMHRDEEVDYYPSRHARRCGRAAPTPLPPRPVAGRREKATIRKPNDFKQPGERYRSWDADRQDRFVKAIRRLARTPKRQPELRSIWIDLLAKVDASLGMKIATRLNMKANM

SEQ ID NO: 6060 - protein, 359 aa, Kineococcus radiotolerans
MDLFSPVALGDLQLSNRLVMAPLTRMRSGSEGVPGPLVAEHYAQRASLGLIVTEGTYLNGESQGFVGQPGIVTDAQQEGWRAVAEAVHAGGGKIVMQVMHAGRVTHPETTGGDRIVGPSAIAIQGETHTPTGKQPYPVPHALTTEEVAGVVADFVAASRRAVDAGLDGVEIHSANGYLLHEFLAPSSNHRDDQYGGSPENRARLVVEIATAVAAEIGAGRVGVRISPEHNIQDALETDPADVEATYSALVEGLRPLGLAYLSVLHADPSGGLVQGLRKQFEGHLMVNSGFGVVTSRQDALDLVAEGTADSVAVGRMAIANPDLVRRWQEDLPENEPNPATFYADGAEGYTDYPFVDAPA

SEQ ID NO: 6061 - protein, 246 aa, Cucumis sativus
MAPREKAVAVKPSVGNVKEVHFRGVRKRPWGRYAAEIRDPSKKSRVWLGTFDTAEEAARAYDSAARDFRGVKAKTNFPLPSDDQLLNLNNKINNINNNQSPSQSSTVESSSREQALMVDSSPLNLNLGHGIGGLTNAGPISFPFQRYQIPMIGEVFTRGIPPSNHVLYFDAALRAGMINSHPNQRLHFDRIREAVSDFRREFAGSGVQSDSDSSSVVDMNGQDLKPRGGSGGRLDLDLNFPPPESA

SEQ ID NO: 6062 - protein, 496 aa, Zea mays
MTMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKANM

SEQ ID NO: 6063 - protein, 360 aa, Methanococcoides burtonii
MLFEPITMAGLTVKNRFVRSATNEGMAELDGTVTKGIGDMYEDLAREDVGLIITGYSYVDVKGQSDERQQGIYDDRFIGPYREIVSRVHKYDSKIFLQIVHGGRQSIVKEGVALLAPSAVEDPASGKVPVEMTEEDIFDTIENFAEAARRSKEAGFDGVQIHCAHGFLLSSFISPYTNHRTDKWGGSVENRARIVTEIVKRIQEKVGKDFPVMVKMNATDGFDVFSGKIGLDAPECVEIASLLEKAGICAIEVSGGIFEAGPVMSQNGIDSEDKEAYFRRYSKMILDTVKIPVILVGGIRTKAVMESILRGYADMISLSRPFIAEPDLVVKLKEGSDRVKCVSCNGCFRTDGVSCTYNFD

SEQ ID NO: 6064 - protein, 510 aa, Oryza sativa
MDGNAKGGGHSEALKNYNLGRTLGIGSFGKVKIAEHKLTGHRVAIKILNRRQMRNMEMEEKAKREIKILRLFIHPHIIRLYEVIYTPTDIYVVMEYCKFGELFDYIVEKGRLQEDRVALRIFSQIISAVEYCHRNMVAHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVDPMKRITIREIRERQRFQIRLPRYLAVPPPDTAQQAKMIDEDTLQDVVNLGYGKDHVCESLRNRPQNEATVAYYLLLDNRFRATSGYLGADYQESLERNFNRFASSESASSNTRHYLPGSSDPHASGLGPHYPVERKWALGLQSRAQPREIMIEVLKALQDLNVSWKKNGQYNMKCRWSVGYPQATDILDVNHSFVDDSIIMDNGDVNGRLPAVIKFEIQLYKSRDEKYLLDMQRVTGPQLLFLDFCAAFLTKLRVL

SEQ ID NO: 6065 - protein, 190 aa, Cucumis sativus
NSLVIGAYGIVCSVLNSETNEMVAVKKIANAFDNHMDAKRTFREIKLLRHLDHENVIGIRDVIPPPLRREFNDVYISTELMDTDLHQIIRSNQSLSEEHCQYFLYQILRGLKYIHSANVIHRDLKPSNLLLNANCDLKICDFGLARPTSENECMTEYVVTRWYRAPELLLNSDYTAAIDIWSVGNRIPAA

SEQ ID NO: 6066 - protein, 182 aa, Cucumis sativus
YRGDWHGSEVAVKILTEQDFHPERVNEFLREVAIMKSLRHPNIVLFMGAVTKPPNLSIVTEYLSRGSLYRLLHKSGVKDIDETRRINMAFDVAKGMNYLHRRDPPIVHRDLKSPNLLVDKKYTVKVCDFGLSRLKAHTFLSSKSAAGTPEWMAPEVLRDEPSNEKSDVYSFGVILWESNSRG

SEQ ID NO: 6067 - protein, 206 aa, Pisum sativum
MPSRRRTLLKVIILGDSGVGKTSLMNQYVNKKFSNQYKATIGADFLTKEVQFEDRLFTLQIWDTAGQERFQSLGVAFYRGADCCVLVYDVNSVKSFDNLNNWREEFLIQANPSDPENFPFVVIGNKIDIDGGNSRVVSEKKARAWCAAKGNIPYFETSAKEGINVEEAFQTIAKDALKSGEEEELYLPDTIDVGNSSQPRSTGCEC

SEQ ID NO: 6068 - protein, 272 aa, Griffithsia japonica
RFVQACTRRLMSDVPVGVFISGGLDSSLVASIAKKHLPDGYVFHSFSCGLEGSPDVRAAQKVADYLGTKHHVLTFTVEDGISALRDVIYHLETYDVTTIRASTPMYLLSRLCKQYVKVVLSGEGADEVYGGYLYFHNAETERDFHEETVRRVKLLYTSDVLRGDRSTAAQSLELRVPFLDRDFLDVSMSFSAQDKVTQKGKRIEKWPMRQAFAKEFCGEEFLPDDILWRSKEQFSDGVGYNWIDGLKEFCDKEVSDKLLANASDKFPHQPPK

SEQ ID NO: 6069 - protein, 238 aa, Prunus tomentosa
AHYKSEADVGNAIAEAIQSGLVKREELFITSKASNHGHVVEACKSSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNIERGTPVIPKSSKVERLKENLEILNFKLEKEDI

SEQ ID NO: 6070 - protein, 252 aa, Prunus padus
AHYKSEADVGNAIAEAIQSGLVKREELFITSKASNHGHVVEACKNSLKKLQLDYLDLYLVHYPLATKHNGVGTTASLLDENKVLDIDVTVSLETTWHDMEKTVSLGLVRSIGLSNYELFLTRDCLSYAKIKPQVSQFETHPYFQRESLVRFCKKHGVIPMAHTPLGGATANVKAFGSISPLEDPVLLGLAKKYQKSVAQIALRWNIERGTPVIPKSSKVERLKENLEVLNFKLEKEDIELIDTIDKKSRTTL

SEQ ID NO: 6071 - protein, 252 aa, Prunus caroliniana
AHYKSEADVGNALAEAFETGLVKREELFIISKASNHGHVVEACKDSLKKLQLDYLDLYLVHYPLATKHSGVGTTASLLDKNKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSMSPLEDPVLHGLAKKYKKSVAQIALRWNIERDTPVIPKSSKVERLKENLEVLNFKLEKEDIELINTIDKKSRTTL

SEQ ID NO: 6072 - protein, 559 aa, Sulfolobus solfataricus
MTFAYKIDGNEVIFTLWAPYQKSVKLKVLEKGLYEMERDEKGYFTITLNNVKVRDRYKYVLDDASEIPDPASRYQPEGVHGPSQIIQESKEFNNETFLKKEDLIIYEIHVGTFTPEGTFEGVIRKLDYLKDLGITAIEIMPIAQFPGKRDWGYDGVYLYAVQNSYGGPEGFRKLVDEAHKKGLGVILDVVYNHVGPEGNYMVKLGPYFSQKYKTPWGLTFNFDDAESDEVRKFILENVEYWIKEYNVDGFRLDAVHAIIDTSPKHILEEIADVVHKYNRIVIAESDLNDPRVVNPKEKCGYNIDAQWVDDFHHSIHAYLTGERQGYYTDFGNLDDIVKSYKDVFVYDGKYSNFRRKTHGEPVGELDGCNFVVYIQNHDQVGNRGKGERIIKLVDRESYKIAAALYLLSPYIPMIFMGEEYGEENPFYFFSDFSDSKLIQGVREGRKKENGQDTDPQDESTFNASKLSWKIDEEIFSFYKILIKMRKELSIACDRRVNVVNGENWLIIKGREYFSLYVFSKSSIEVKYSGTLLLSSNNSFPQHIEEGKYEFDKGFALYKL

SEQ ID NO: 6073 - protein, 222 aa, Picea mariana
MGRGKIEIKRIENTTNRQVTFCKRRNGLLKKAYELSVLCDAEVALIVFSSRGRLYEFANHSVKRTIERYKKTCVDNNHGGAISESNSQYWQQEAGKLRQQIEILQNANRHLMGDGLTALNIKELKQLEVRLEKGIGRVRSKKNEMLLEEIDIMQRREHILIQENEILRSKIAECQNSHNTNMLSAPEYDALPAFDSRNFLHANLIDAAHHYAHQEQTTLQLG

SEQ ID NO: 6074 - protein, 222 aa, Picea mariana
MGRGKIEIKRIENTTNRQVTFCKRRNGLLKKAYELSVLCDAEVALIVFSSRGRLYEFANHSVKRTIERYKKTCVDNNHGGAISESNSQYWQQEAGKLRQQIEILQNANRHLMGDGLTALNIKELKQLEVRLEKGIGRVRSKKNEMLLEEIDIMQRREHILIQENEILRSKIAECQNSHNTSMLSAPEYDALPAFDSRNFLHANLIDAAHHYAHQEQTTLQLG

SEQ ID NO: 6075 - protein, 218 aa, Picea mariana
KIEIKRIENTTNRQVTFCKRRNGLLKKAYELSVLCDAEVALIVFSSRGRLYEFANHSVKRTIERYKKTCVDNNHGGAISESNSQYWQQEAGKLRQQIEILQNANRHLMGDGLTALNIKELKQLEVRLEKGIGRVRSKKNEMLLEEIDIMQRREHILIQENEILRSKIAECQNSHNTNMLSAPEYDALPAFDSRNFLHANLIDAAHHYAHQEQTTLQLG

SEQ ID NO: 6076 - protein, 271 aa, Cicer arietinum
RSLRVDQFCSVVSISSSLMIELVPCLRDNYAYILYDVDTGTVGVVDPSEAAPIIEALTKKNLNLTYILNTHHHNDHTDGNAELKERYGAKVIGSDLDKERIPGIDIYLSDGDKWMFAGHEVHIMATPGVTRGHISFYFPGSGAIFTGDTLFSLSCGKLYEGTPEQMLSSLKKIMSLADDTSIYCGHEYTLNNSKFALSIEPENKELQSYASHVAHLRNKGLPTVPTTLKMEKACNPFLRTWSTEIRQKLKVAATAEDAEALSVIRQAEDTF

SEQ ID NO: 6077 - protein, 356 aa, Oryza sativa
  misc_feature (49)..(49): Xaa can be any naturally occurring amino acid
MGRDKARRLSGSRHFRQRVVLATLTSTAITIDDIRSGGAAPGLRPHEGXKLRYKPGVIVGGRDLEHDCGVHRGIGYFLEPLILLGLFARAPISIRLKGITNDTKDPSVDTFRMVTLHMLKQFGVPLEGLELKIESRGAPPLGGGEVFLRVPNIKSTLKAANWADEGMVKRIRGVSFSTRVSPQIENRIIYAARGIFNRFIPDVHIFTDHRSGSAGGRSAGYGVSVVAETTTGCLLSADATVSYPNVDEMNEESENLELTSPEDLGVQVASMLLEEVAQGGVVDSAHQGLLFILCALSPPDVSKVRVGQLTPYAIETLRNIRDFLDVKFIIKPDPNSNTVTLKCVGAGVKNLARKTS

SEQ ID NO: 6078 - protein, 450 aa, Oryza sativa
MAAAAEEGEGKKGGGTVLQGRYEMGRVLGHGNFGRVHVARDLRTGRSVAVKVVAKEKVVRAGMMEQIKREIAVMKRVSHPNIVELHEVMATRSKIYLALELVRGGELFGRIVRLGRVREDAARHYFRQLVSAVDFCHSRGVYHRDLKPENLLLDEAGNLKVVDFGLSALADHARADGLLHTLCGTPGYAAPEVLRDKGYDGAKADLWSCGVILYVLLAGSLPFPDDNIVTLYRKAQRGDYRCPAWLSTDARRLIPRLLDPNPTTRISVAQLVETPWFKKTSISRPVSIELPPAFADPAPAKEEAEKDEPETLNAFHLISLSEGFDLSPLFEGDSAKGRRDGGMLFATREPASGVISRLEGVAARGGGRMRVTKSGARGVRLEGAERGGAKGRLAVAADIFSVAPSVLVVDVKKDGGDTLEYRSFCSEELRPALQDIVWGAAADPTPTAAV

SEQ ID NO: 6079 - protein, 226 aa, Corynebacterium efficiens
MGRNETNESNTFEHTNEERNFATLACMTNELKLHRISVSKMDNNCYLLTSGDKGLLIDAADDAPAILKMAEDAGVTITTVLTTHRHADHVRALKEVLQATGATHYAPFLEVPALPAPVDVELEHGDIIEFEGHQFPIAILRGHTPGGAALAAEIDGRVNLFVGDSLFPGGLGKTSSEGDFIRLFNDVKQRLFDVYPDDSIVWPGHGRETTLGNERPELEVWWERRW

SEQ ID NO: 6080 - protein, 235 aa, Brassica rapa
MALETLNSPTSATASARPLLRYREEMEPENLEQWAKRKRTKRQRFDQSRLNQETAPSEEEYLALCLLMLARGSAVQSPLPPSSSSDHRGYKCTVCGKSFSSYQALGGHKTSHRKPASNVNVPINQEQSNNSHSNSNGGSVVINGNGVSQSGKIHTCSICFKSFSSGQALGGHKRCHYDAGNNGNGNGSSSNSVEVVGGSDGSYVDDERSSEQSATGDNRGFDLNLPADQVAVVIS

SEQ ID NO: 6081 - protein, 237 aa, Brassica rapa
MALETLNSPTSATASARPLLRYREEMEPENLEQWAKRKRTKRQRFDQSRLNQETAPSEEEYLALCLLMLARGSAVQSPLPPSSSSDHRGYKCTVCGKSFSSYQALGGHKTSHRKPASNVNVPINQEQSNNSHSNSNGGSVAINGNGVSQSGKIHTCSICFKSFSSGQALGGHKRCHYDAGINGNGNGSSSNSVEVVGGSDGNYVDDERSSEQSATGDNRGFDLNLPADQVAVVISKR

SEQ ID NO: 6082 - protein, 448 aa, Arabidopsis thaliana
  misc_feature (62)..(62): Xaa can be any naturally occurring amino acid
  misc_feature (94)..(94): Xaa can be any naturally occurring amino acid
  misc_feature (113)..(113): Xaa can be any naturally occurring amino acid
  misc_feature (129)..(129): Xaa can be any naturally occurring amino acid
  misc_feature (144)..(144): Xaa can be any naturally occurring amino acid
  misc_feature (207)..(207): Xaa can be any naturally occurring amino acid
  misc_feature (218)..(218): Xaa can be any naturally occurring amino acid
  misc_feature (230)..(230): Xaa can be any naturally occurring amino acid
  misc_feature (240)..(240): Xaa can be any naturally occurring amino acid
  misc_feature (282)..(282): Xaa can be any naturally occurring amino acid
  misc_feature (293)..(293): Xaa can be any naturally occurring amino acid
  misc_feature (299)..(299): Xaa can be any naturally occurring amino acid
  misc_feature (316)..(316): Xaa can be any naturally occurring amino acid
  misc_feature (346)..(346): Xaa can be any naturally occurring amino acid
MELTLKMLVLMSLKIKFLLLLVLYHHVDSASIVKFLPGFEGALPFELETWYIGIGEDENISXIFYYFFKSLKTIQKKMLFLYRLNGGPGCSSLXCLLFLKKGPVGFEFFRFSXELLSSLFSTTYSWTKXANLIFLVQPVRSAYXTQKHQLIKLMTISEVNRTHEFLQKWLSSYTQYFSNPLYVVGDSYSGMIVPALVQEISQGNYIXCETPINLQGYXLGNPVTYMDFEXNFRIPYVYGXGLISDEIYEPMKRICNGNYYNVDPSNTQCLKLTKEYHKCIAXINIHHILTPDXDVTKVXLLICYYYPYHLIECWAXTTKSVRVALHIEKGSKGKWARCNRTIPYKXDIESSIPYHMNNSISGYRSLIYSGDHDIAVPFLATQAWIRSLNYSPIHNWRPWMINNQIAGYTRAYSNKMTFATIKGGGHTAEYRPNETFIMFQRWISGQPL

SEQ ID NO: 6083 - protein, 492 aa, Oryza sativa
MVLSKAVSESDMSVHSTFASRYVRASLPRYRMPENSIPKEAAYQIINDELMLDGNPRLNLASFVTTWMEPECDKLIMAAINKNYVDMDEYPVTTELQNRCVNMIAHLFHAPLGEDETAVGVGTVGSSEAIMLAGLAFKRRWQNKRKAEGKPFDKPNIITGANVQVCWEKFARYFEVELKEVKLRDGYYVMDPEKAVDMVDENTICVAAILGSTLNGEFEDVKLLNDLLDKKNKETGWETPIHVDAASGGFIAPFLYPELEWDFRLPWVKSINVSGHKYGLVYAGIGWCIWRNKEDLPEELIFHINYLGTDQPTFTLNFSKGSSQVIAQYYQLIRHGFEGYRNIMENCHENAMVLKEGLVKTGRFDIVSKDEGVPLVAFSLKDRSRHDEFEISDMLRRFGWIVPAYTMPPDAQHVTVLRVVIREEFSRTLAERLVLDIEKVMYQLDALPSRLMPPVPPAPLLVVAKKSELETQRSVTEAWKKFVLAKRTNGVC

SEQ ID NO: 6084 - protein, 39 aa, Zea mays
YHVTNFFAPSSRFGTPEDLKSLIDRAHELGLLVLMDVVH

SEQ ID NO: 6085 - protein, 526 aa, Oryza sativa
  misc_feature (214)..(214): Xaa can be any naturally occurring amino acid
MATCSRPLFVPASAAAASPSPAASRRGAPLVRLHAVAIVSIWEPRRHLRAHMSLCCKATRRSSGGLTTGHPISALPRAIKRILSSYPSLLTSLGGNLARGYKAAKPFLSIGFGRVVLGMVLVMSVSAATYTAPSSLALTEENLLFLEAWRAVDRAYYDKSFNGQSWFRYRENALRNEPMNTREETYAAIKKMLSTLDDPFTRFLEPEKFKSLRXPGSQGTLTGVGLSISYPMALNGSPSGLSVMSATPGGPAENSGILPGDVILAIDNRSTEDMDIYDAAQRLQGPEGSSVDLDIRSGSNTRHVVLKRQTVTLNPVRSRMCEIPGAKDNSKVGYIKLTTFNQNAAGSVKEALQKLRENNVKSFVLDLRNNSGGLFPEGIEIAKIWMDKGVIVYICDSQGVRDIYEADGISTVAASEPLVVLVNKGTASASEILAGALKDNKRAVIYGEPTYGKGKIQSVFALSDGSGLAVTVARYETPAHTDIDKVGVIPDRPLPASFPTDEDGFCSCLRDSNSACNLNAAQLFTR

SEQ ID NO: 6086 - protein, 227 aa, Zea mays
MPSSTASWSRYGAVPTSPPSPPPPPPQLRPEDDAAGGEAAPSPSVSATAAEAGVAFFSRARAFAGAGRPRAWREVLDPTAFSRPESCGEARARARRNLAYFRANYALAALALVFLGLVYRPVSMLVFLALFVAWLGLYFGRGDRGPLVCLRREVDDRAVLAALSAATALAVALTRAGINLLVSLAVAAVAVGLHAAFRVNLYVDETDAFDVAGTSFTDSRYGYALPR

SEQ ID NO: 6087 - protein, 169 aa, Listeria welshimeri
VPERVVHARGAGAHGKFVTKKSMKKYTIANFLQEEGTETEVFARFSTVIHGQHSPETLRDPRGFSVKFYTEEGNYDFVGNNLPVFFIRDAIKFPDVIHSLKPDPRTNIQDGNRYWDFFSLSPEATTMIMYLFSDEGTPASYREIRGSSVHAFKWINEEGKTVYVKLRWI

SEQ ID NO: 6088 - protein, 122 aa, Triticum aestivum
MVGFFRSGNLASRVFDRQFLSPRPGATVNTVRQFYENLVPSYTIYDIDCPDYSFRKFTDDERFESFFKQLYSISLASSNEYICEDFFLYMECHQYGLFATSTARSNESSVTEGAIYGVPSIE

SEQ ID NO: 6089 - protein, 254 aa, Oemleria cerasiformis
SEADVGQAFAEAFKTGLVKREELFITSKANHGHVVEACKNSLKKLQLDYLDLYLVHYPLATKHSGVGTTASLLDENKVLDIDVTVSLEETWRGMEKAVSLGLTRSIGLSNYELFLTRDCLSYAKIKPAVSQFETHPYFQRESLVRFCQKHGVVATAHTPLGGATANTKYFGSISPLGDPVLHDVAKKYQKSVAQICLRWNIERNTPVIPKSSKVERLKENLQVLEFKLEKEDIELINGIDKKSRSTLPSLSWGL

SEQ ID NO: 6090 - protein, 328 aa, Yarrowia lipolytica
MGNNPNEVIQRLLDAGYSGKITKAVCLKNSEIALICRRARSILLSQPTLLELLPPVKIVGDVHGQFGDLIRMFDMCGFPPAANYLFLGDYVDRGKQSLETILLLLCYKIKYPENFFILRGNHECAKVTRVYGFYDECKRRCNIKTWKTFVDTFNTLPIAAVVAQKIFCVHGGLSPSLSSMSEIRSIVRPTDVPDYGLINDLLWSDPADTQNEWEDNERGVSYCFSKVAINKFLTKFSFDLVCRAHMVVEDGYEFFNDRSLVTVFSAPNYCGEFDNWGAVMSVSEELLCSFELLKPLDSAALKQEMKKGKHQRRLSLETRSAPATPQSV

SEQ ID NO: 6091 - protein, 264 aa, Sorbus aucuparia
AHYKSEADVGEALTEAFKTGLVKREELFITTKIWNSDHGHVVEACKNSLEKLQLDYLDLYLVHYPMPTRHNAIGKTASLLGEDKVLDIDVTVSLQQTWEGMEKAVSLGLVRSIGLSNYDLFLTRDCLAYSKIKPAVSQFETHPYFQRDSLIKFCIKHGVLPTAHTPLGGAAANKDMFGSVSPLDDPVLNDVAKKYGKSVAQICLRWGIQRKTAVIPKSSKIQRLKENLEVLEFQLSDEDMQLIYSIDRKYRTSLPSKTWGLDVS

SEQ ID NO: 6092 - protein, 127 aa, Oryza sativa
KHIFNFDKDIMSLDGKERLISGGSPICHHSDDTSMIISFTRGPFLFVFNFNPDASYQLYSVGVDEAGEYQLILNTDETRYGGRGELTSNQYMKRTSDNRVGGCRNSLELTLPSRSAQVYKLVRILRI

SEQ ID NO: 6093 - protein, 388 aa, Aspergillus nidulans
MGSLSPLEPLFTPLRIGAFALQHRVVQAPCTRMRSTKESDGIWVPNDLNVEYYAQRASKGGLMLSEATPISRDAAGYPGVPGIFTPSQIEGWRKVTNAVHTKGGLILCQLWHVGRATTPGFLGGKTPLAPSDIPISGKALDGNVYADAPPRPMTVDEIKEVVLEYAAASKRAIEAGFDGVEIHGGNGYLLDQFLHDNVNNRTDAYGGSIENRSRIVLEIISAVTEAIGAERVGIRLSPYNYFQDTRDSNPQKHWGYLCTQIASLPESSRPAYVHMIEPRFDEILDESEKISALETMQEVVKPSLDGLRSSLKKGGVSFIAAGNFKPENAGEKLITDSADAIAFGRLFISNPDLPRRLKEGIELTKYDRSTFYGATPPEKGYTDYPFAQ

SEQ ID NO: 6094 - protein, 265 aa, Kageneckia oblonga
AHYKSEADVGEALAEAFKSGLVKREELFITTKIWNSDHRYVAEACKNSLEKLQLQYLDLYLVHYPLPTRHNAIGKTASLLGEDKVLDIDVTIPLQQTWEGMEKTVALGLVRSIGLSNYDLFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLEFQLSDEDMQLIYSIDKKYRTSLPSKTWGLDVYA

SEQ ID NO: 6095 - protein, 433 aa, Lophopyrum elongatum
MQCFRFASWEKEREEELQGPARSQSALSNSSMSTDRDARRSGSECCSLTVSSEISVDSFGRYRQLSLPHRPNNDLRIFTFQELKSATRSFSRALMIGEGGFGCVYRGTIQSTLEPRRSLDVAIKQLGRKGLQGHKEWVTEVNFLGVVDHPNLVKLIGYCAEDDERGIQLLLVYEFMPHGSLADHLSTRSPKPASWAMRLRVALDTARGLKYLHEDSEFKIIFRDLKPSNILLDENWNAKLSDFGLARLGPQEGSHVSTAVVGTIGYAAPEYIHTGRLSSKNDIWSYGVVLYELLTGRRPLDRNRPRGEQNLVEWVKPYSSDTKKFETIMDPRLEGNYNLKSAARIASLANKCLVRHARYRPKMSEVLEMVQKIVDSSDLGTPERPLISHSKKLASDEKKRKGLNLKRRIADIKAGDGRWFRWHKWTPKLVRTQ

SEQ ID NO: 6096 - protein, 340 aa, Bacillus clausii
MPNLMDSFQLKELTLKNRVVMSPMCQYSATGKDGMPTDWHLHHYTSRAIGGVGLIIVEMTNVEPNGRISDYCLGLWSDAHRDAFKPIVDAAHQYGAKIAIQIAHAGRKAEDAPEPVAPSAQAFDETYKTPRALSENEIAEMVQTFKAAARRAVEAGFDAIELHGAHGYLIHQFLSPYTNTRTDRYGKDRTLFAKEVIRAVKSVIPDSMPLLMRISATEYVDGGYDIEEAIRFSQILKDEGVDVFDVSSGGEGPIGSRGLPGSHAGYQTPLAKQIKQALSVPVIAVGRLENPVLANAVIGNEEADLVAVGRGLLANPYWALGAASELQLPVEAPTQYKAGF

SEQ ID NO: 6097 - protein, 265 aa, Vauquelinia californica
AHYKSEADVGEALAEAFKTGLVKREELFITTKIWNSDHGHVVEACKNSLEKLQLDYLDLYLVHYPMPTRHNAIGKTASLLGEDKVLDIDVTISLHTTWEGMKKAVSLGLVRSIGLSNYDLFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLKFQLSDEDMQLIHGIDRKYRTSLPSKTWGLDVYA

SEQ ID NO: 6098 - protein, 545 aa, Arabidopsis thaliana
MMSFEMNDRKKIGLGLTGFGVFFSFLGIVFVFDKGLLAMGNILFISGVSLTIGFKSTMQFFMKRQNYKGTISFGVGFFFVIIGWPILGMMLETYGFFVLFSSLTSTGASVCRSSLPSRVERRFTELDAAEQAIKISGEVIHWREMKSSRMKFAKKLKSIRAGEYLNQDRILQVLSAADEFLPKISNHIPQITSAASIWRTPQKSENQIANVTELLENVRRGEEEASGNFVGDEENVRPPVNQIPRVPCDRKESKLAVSCGSDTGIGRKSFGSGFRRPDLNSTTLFDPKLLEAFELAALCFRKIKDFSREARVNDEDDIVFPEEEEIRKDGNSIPPVISVVEYRRKDENVVILHKDDGNALQIVNAIREEVIGEEDIGKDGNTLMDPLLEFEERCPPGGEESVVFYTTTLRGIRKTFDDCNMIRFLLDSFKVKYYERDVSMHREYREELRRISAAETEVLPPVLFVKGRCIGGAQRVLGLHEQGKFKILFEGIPITGDERCRRCDGFRFLMCDGCRGSRRIISGDGSRIQCLICNENGLIVCVGCS

SEQ ID NO: 6099 - protein, 378 aa, Oryza sativa
MALDGKPPVPPPSTPPMDSWACGGRRSKRRGGGGGSSGSSGSSGGGGGGESEEEYLAACLLMLAHGVRDEAEVVGVAAATAKPQHGYECSVCGKVYGSYQALGGHKTSHRKPPSPAAEPAAGEEPSSGGVAGEAKVHRCSICLRTFPSGQALGGHKRLHYEGGAVGDAVKEKNSLKTKAAVATAVLKDFDLNLPAAATTAGDEAESSPPEAKRALHFWLGDGDGWHDKHAVFRWLASSSGGNNIMGPHDSPARCVEYSYSPTCRYGTFATGGCDSFMAFGMALAKVPQPSNTHVTSLLVFQQGWPSASLSHPGARSISLTFLLRYQSYETHWVSTGYTIPNGYGHGYEFLPANSIGYQSGGQKRVRHKPDAIFICNVN

SEQ ID NO: 6100 - protein, 423 aa, Unknown
  Synechocystis sp. PCC 6803
MLKQKRSLILGTTALLLTTVAVTGVGLRLARSQGYLQDNPKELVDEVWQIVNRTYVDGTFNGEDWVAVRQDYLTRDYKNQEEAYTAIREMLEKLNDPYTRFMSPDEFQSMRIDTSGELTGVGIQITQDQDTKKIVVVAPIEDTPAYNAGILSKDVITKIDGKSTDGMEVDDAVKLIRGKPGTSVVLTIEREGQAIEYPLTRTLIEIHPVRAQVEDINGARVGYIRLNQFSAQASEEMRQAVQKLEKENVVGYIFDLRSNPGGLLYSSVDIARIWLDEGGIVSTVDRRGEVEQQSANKRQLSNRPLVVLVDGGSASASEIVSGALQDNQRAVIVGTKTFGKGLVQSVRELGDGSGMAVTIAKYLTPNGRDINKHGIDPDVEVELTDAQRKELQQNREKVGTLEDPQFARAYEVLMQQVNKTASK

SEQ ID NO: 6101 - protein, 265 aa, Amelanchier alnifolia
AHYKSEADVGEALAEAFNTGLVKREELFITTKIWNSDHGHVVEACKNSLEKLQLDYLDLYLVHYPMPTRHNAIGKTASLLGEDKVLDIDVTISLQQTWEGMEKAVTLGLVRNMGLSNYDLFLTRDCLAYSKIKPAVSQFETHPYFQRDSLVKFCIKHGVLPTAHTPLGGAAANKDMFGSVSPLDDPVLNDVAKKYGKSVAQICLRWGIQRKTAVIPKSSKIQRLKENLEVLEFQLSNEDMQLINGIDRKYRTSLPSKTWGLDVYA

SEQ ID NO: 6102 - protein, 611 aa, Candida glabrata
MENKEHHHHHHHHHHHHSNGSYVSNKVSSLADGSRVGNYQIVKTLGEGSFGKVKLAYHVTTGQKVALKSINKKVLAKSDMQGRIDREISYLRLLRHPHIIKLYDVIKSKDEIIMVIEYAGNELFDYIVQRNKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGASDLIKRMLIVNPLNRISIHEIMQDEWFKVDLAEYLVPQDLKQQEQFNKKSGNEENVEEIDDEMVVTLSKTMGYDKDEIYEALESSEDTPAYNEIRNAYILIKDNKSLIKDMKQDNNVTQELDTFLSQSPPTFQQNGDGMKASEDQKKKHSGRRLASSVTQQRTFHQPPFMDQSKEEDSTISIPTSLPQIHRANMLAQGLPAASKISPLVTKKSKTRWHFGIRSRSYPLDVMGHIYIALKNLGAEWANPSEEDLWTIRVRWKYDSDESRLIEDGVKKIPNLMKIVIQLFQIETNNYLVDFKFDGWESTYGDSTISTNMSEDEMSTFSAYPFLHLTTKLIMELAVNSQGN

SEQ ID NO: 6103 - protein, 632 aa, Solibacter usitatus
MCGIVAVYDAEGAGASAEVAAGLKTLRHRGPDAQHVWLSPDGAICLGHARLSIIDLAHGDQPLANEDESIHCVVNGEFYDFERIRRGLEGRGHRFRTHSDSEILLHLYEDLGVECLRELRGEFAFVLWDGRRRVLMAARDRFGIKPLFYSRTGERLLFASEVKALHAAGVPAAWDEQGFLETFSAMYASSPTLFRHVSAIPPGHYLLSRDLGCSLHKYWDFEFPAEGNLPERRDEECVAEFGAVLDEAVRLRLRADVPVGCYLSGGIDSCSVLALMAKHAPGRVRAFSLSFDHELYDEGPIAREMAQRTGAEFTMIPVSHAGMAADLSDALWHNESFFLNAGSAAKFALSRAVRDAGYKVVLTGEGSDEVLAGYAFFRQDMIRHASNNGGAAEAIERLRAANPASGGLMFTTKQVTPVAGYVDRLGYFPSFLEARKAGLEALRALLTIAYETDEVLTRLLNRVDIAGQLTGRHVLNQSLYLNNKTILPGYILSALGDRVEMAHSIEARLPFLDHHVVEYTRRIPVDLKIRGTVEKYILREAMKPMLTTTVYKRQKHPFLSPPALLKPDEPLHALLQDTLRGRALDRVPYLRRTEVAGFLDRAGGLDVAGKIAAEFPLMMMLSACLVAERFGL

SEQ ID NO: 6104 - protein, 305 aa, Triticum aestivum
  misc_feature (292)..(292): Xaa can be any naturally occurring amino acid
WIPRAAGIRHQFGLDTDVDAVVYLMLANHLMHKLLPEATVVAEDVSGMPVLCRSVDEGGVGFDYRLAMAIPDRWIDYLKNKDDLEWSMSGIAHTLTNRRYTEKCIAYAESHDQSIVGDKTMAFLLMDKEMYTGMSDLQPASPTIDRGIALQKMIHFITMALGGDGYLNFMGNEFGHPEWIDFPREGNNWSYDKCRRQWSLADIDHLRYKYMNAFDQAMNALDDKFSFLSSSKQIVSDMNEEKKIIVFERGDLVFVFNFHPSKTYDGYKVGCDLPGKYKVALDSDALMFGGQXRAHDNDHSWYSFR

SEQ ID NO: 6105 - protein, 468 aa, Lactococcus lactis
MTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITCNGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 6106 - protein, 462 aa, Geobacter metallireducens
MSRLGVIIDLAICCHRHKEPAHPLQAKYSASRGTPTVTQTGTTAVTDADRIVELEHLLVELKAELAERKNIERDLKRAKVSAEAACHSKEDLLALVSHEIRSQIQMLTGAVELLRETPLDKKQTEYLNAFNHAGEFLLSLVNDLLDNSRLDAGRIHLDQIEFPFRELLERTAQLIAWQAGRKGLELEYHLSPDIPAQLVGDPKRLQQVILNLAGNAIKFTEQGKIIITVEPEASSLASQEMQLIFTIQDTGIGIPGDKLEEIFERYAQASPATFRTYGGTGLGLNIAKRLVGLMGGTIRVTSKEGKGTSFVFNARLGVTPPLLSSAVERRKSKSLPERSLRILLAEDAAEIRMLLGAFLGTTSHAVDMAHNGEEALKKFTSSNYDVIIMDIQMPVMDGLSATRKIREWERTHDRTPVPVVALTAGPERSDYLRAREAGCTTHLAKPIKKELLLNTISAVVLQ

SEQ ID NO: 6107 - protein, 79 aa, Glycine max
GNLLLYSRKLPFDITIIGDEPLLLANTSAILPYPHQAPTKTLGPTAFFCYHDIYDAETSVDHLSCFNPANRYLILLYYQ

SEQ ID NO: 6108 - protein, 374 aa, Unknown
  uncultured archaeon GZfos17F1
MDEKTIGSTLYDLKSKDTPYERVLSSMCTYPHPVAVAAHQQFIETNLGDPGLFAGTAEIEHEVVRMMGTLFGNPDAHGYVTTGGTESNIQAIHAIKTARKVRDPNIIVPASAHFSFDKVADILGIDVLKADLDPEFRADISSVEDLINETTIGIVGIAGTTEFGQIDPIKELSDLALSKNIFLHVDAAFGGFVIPFLTEKYEFDFTLPGVTSIGADPHKMGFATIPSGGLLFQDSSYLNRLSVDTPYLTVNSQQTLSGTRSGASAASAYAVFKHLGRTGYERIVQRCMELTYELVARASESGIEPLIDPVTNVLVLDVPDADSVRSALKKRGWDVSITRDPRALRLVIMPHISSENLNLFADDLADVVKWMSAN

SEQ ID NO: 6109 - protein, 260 aa, Camellia sinensis
TREGNFDLVGNNFPVFFVRDGMKFPDMVHALKPNPKSHIQENWRILDFFSHHPESLHMFTFLFDDAGVPQDYRHMEGSGVNTYTLINKAGKAHYVKFHWKPTCGVKCLLEEEAIKVGGANHSHATKDLYDSIAAGNYPEWKLFIQIIDPDHEDRFDFDPLDVTKTWPEDIIPLQPVGRLVLNKNMDNFFAENEQLAFCPAIIVPGVYYSDDKLLQTRIFSYADTQRHRLGPNYLQLPANAPKCAHHNNHHEGFMNFMHRR

SEQ ID NO: 6110 - protein, 265 aa, Amelanchier alnifolia
AHYKSEADVGEALAEAFNTGLVKREELFITTKIWNSDHGHVVEACKNSLEKLQLDYLDLYLVHYPMPTRHNAIGKTASLLGEDKVLDIDVTNFLQQTWEGMEKAATLGLIRNIGLSNYDLFLIRDCLAYSKIKPAVSQFETHPYFQRDSLVKFCIKHGVLPTAHTPLGGAAANKDMFGSVSPLDDPVLNDVAKKYGKSVAQICLRWGIQRKTAVIPKSSKIQRLKENLEVLEFQLSNEDMQLINGIDRKYRTSLPSKTWGLDVYA

SEQ ID NO: 6111 - protein, 621 aa, Listeria innocua
MCGFVGCVHDRITEITGADKETFRQMNSMITHRGPDDEGYFTDDHVQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDGKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPGVFKSMLNSVARIMPEGMRGKSFLERGTTPMEERYIGNAKMFTEKEKQILLPKYQSGHDYTNITDPFYAETKNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLGLLDDHCAGKFDYSRKIWTVVIFMIWYDVYVADKYDFGK

SEQ ID NO: 6112 - protein, 265 aa, Gillenia stipulata
AHYKSEADVGEVLAEAFKTGLVKREELFITTKIWNSDHGHVVEACKNSLEKLQLDYLDLYLVHYPMPTKHNGVGKTASLLGEDKVLDIDVTISLQQTWEGMEKTVSLGLVRSIGLSNYELFLTRDCLAYSKIKPAVSQFETHPYFQRDSLVKFCLKHGVLPTAHTPLGGAAANKDMFGSVSPLDDPVLNDVANKYGKSVAQICLRWGIQRKTAVIPKSSKIQRLKENLEVLEFQLSEEDMQLIYSIDRKYRISLPSKTWGLDVYA

SEQ ID NO: 6113 - protein, 417 aa, Malus micromalus
MAAKESNSAAAAASSDGKIKRMLTHGGRYAQYNVFGNLFEVSSKYVPPIRPIGRGAYGIVCAAVNAEAREEVAIKKIGNAFDNRIDAKRTLREIKLLRHMDHENVIATKDIIRPPQKENFNDVYIVYELMDTDLHQIIRSNQPLNDDHCRYFLYQLLRGLKYVHSAGVLHRDLKPSNLFMNANCDLKIGDFGLARTTSETDFMTEYVVTRWYRAPELLLNCSEYTAAIDIWSVCCILGEIMTRKPLFPGKDYVHQLRLITELLGSPDDSSLGFLRSDNARRYVRELPQYPKRSFSLGFPNMSPSSIDLLEKMLIFDPNRRITVDEALSHPYLAPLHDINEEPVCPMPFNFDFEQPSFTEENIKELIWRESVRFNPESHFSMDHDIICCILLQTNLKTDCNDMFVDTVIVECVKGVDS

SEQ ID NO: 6114 - protein, 171 aa, Triticum aestivum
HEAEALRRMKESLQNKEWVAKFEKPKGDPSAFLKPSTTVLSPYLKFGCLSSRYFYHCIQDVYKSVRNHTKPPVSLIGQLLWRDFFYTVSYGTPNFDRMKGNKICKQIPWSENEELFVAWRDGQTGYPWIDAIMIQLRKWGWMHHLARHSVACFLTRGDMVSNKNSVGNYLH

SEQ ID NO: 6115 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 6116 - protein, 57 aa, Zea mays
MAMQAAKRANMLLPPEVNRILYIRDFPYKITAEDMYDIFGRYGPIRQIRVGNTPDTR

SEQ ID NO: 6117 - protein, 318 aa, Triticum aestivum
  misc_feature (151)..(151): Xaa can be any naturally occurring amino acid
  misc_feature (157)..(157): Xaa can be any naturally occurring amino acid
  misc_feature (212)..(212): Xaa can be any naturally occurring amino acid
  misc_feature (268)..(268): Xaa can be any naturally occurring amino acid
  misc_feature (279)..(279): Xaa can be any naturally occurring amino acid
  misc_feature (289)..(289): Xaa can be any naturally occurring amino acid
  misc_feature (308)..(308): Xaa can be any naturally occurring amino acid
  misc_feature (313)..(313): Xaa can be any naturally occurring amino acid
MCGILAVLGCADDTQGKRVRVLELSRRLKHRGPDWSGMHQVGDCYLSHQRLAIIDPASGDQPLYNEDKSIVVTVNGEIYNHEKLRAQLSSHTFRTGSDCEVIAHLYEELGRLHRLLMGFSSLVIHATQFLCRDAGSTPLWIAVEAKPLYIXWGIDGXSVGISSEVKGLNDDCGHFEIFPPGHLFSQQAGKASRDGDPPTLGSPEVIPSGAYXPTCSQEGFRKGLSPRGLMTDLPCGVLPSGGPGSSLVAAVTVRHLAGTKAAKRWGTXLHSFCVGLEGXPDLKAAKEVXNYLGTMPMSSPSCSDGIDXIEDVXYHPNI

SEQ ID NO: 6118 - protein, 510 aa, Saccharomyces cerevisiae
MPTSGTTIELIDDQFPKDDSASSGIVDEVDLTEANILATGLNKKAPRIVNGFGSLMGSKEMVSVEFGKKGNEKKSNLDRLLEKDNQEKEEAKTKIHISEQPWTLNNWHQHLNWLNMVLVCGMPMIGWYFALSGKVPLHLNVFLFSVFYYAVGGVSITAGYHRLWSHRSYSAHWPLRLFYAIFGCASVEGSAKWWGHSHRIHHRYTDTLRDPYDARRGLWYSHMGWMLLKPNPKYKARADITDMTDDWTIRFQHRHYILLMLLTAFVIPTLICGYFFNDYMGGLIYAGFIRVFVIQQATFCINSLAHYIGTQPFDDRRTPRDNWITAIVTFGEGYHNFHHEFPTDYRNAIKWYQYDPTKVIIYLTSLVGLAYDLKKFSQNAIEEALIQQEQKKINKKKAKINWGPVLTDLPMWDKQTFLAKSKENKGLVIISGIVHDVSGYISEHPGGETLIKTALGKDATKAFSGGVYRHSNAAQNVLADMRVAVIKESKNSAIRMASKRGEIYETGKFF

SEQ ID NO: 6119 - protein, 105 aa, Solibacter usitatus
MTSLKRENELVLKADLPDVDLKDIDVRVENQTLTIEGERKFEQTSNAKGYHRMERSYGRFVRSFAVPNTFDTEKINAAYKNGLLTVTLVKKEAAKPRQIKVEAAG

SEQ ID NO: 6120 - protein, 325 aa, Schizosaccharomyces pombe
MSIKEFAKNAREAYFTLPNGDKIPSIGLGTWRSGKDETKNAVCAALKAGYRHIDTAHIYGNEKEIGEGIRESGVPRTDIWVTSKLWCNAHRAGLVPLALEKTLQDLNLEYIDAYLIHWPFALLSGPEELPRNEKGELIYEDVPIEETWQAMEELLETGKVRYIGISNFNNEYLDRVLKIAKVKPTIHQMELHPYLPQTEYLEKHKKLQIHVSAYSPLANQNDAYNSDISKLIEHKTLVDIANARGEGITPANIAISWAVKRGTSVLPKSVNESRIVSNFLYIPLTDKEMEAINNIGVVRRFSHGKFAPKPMFVGLQDGTPKQTHA

SEQ ID NO: 6121 - protein, 293 aa, Gibberella zeae
MAPDVCTFTLNTGDEMPAVGFGTWNIPRSQAAKAVETALRAGYRHIDTALAYGNEKEVGAGIRASGVPREEIWVSGKLRNNWHKHARKCLQTSLKNLGVGYLDLYLIHWPCSRDADNPAICYEDWDYVDTWMEMEELLDEGKVLNIGVSNFGIQQLERLLTSTEIVPAVNQIELHPCNPSPKLVAYCNNRGIHSEGYSCLGSGHSALHRNKTLRDIADAKEKTVQQVLLQWGIEKGWGVVCKSVTPSRIKSNFELSGWELTDDDMEAIDGIKKRFKAVGDGFLPHRVFFGDDE

SEQ ID NO: 6122 - protein, 304 aa, Guillardia theta
MNENTKFLEEVIKKLTQSKKIKNIFLTEKEIGKLCYLSRKVFNNENSMLYLNSPIKICGDIHGQFYDLLRLFEFNGYPPTEKYLFLGDYVDRGKQSIEVISLLFAFKVRYPTKIFILRGNHESSKINRIYGFYDECKKKYNIKIWKIINETFNYLPLAAIIEKKIFCIHGGLSPFLNSIKQIEDIARPVEIPEKGLLCDLLWSDPNEDKQGWNLSDRGISYTYGDNIVKEFIEKFDFDLICRAHQVVDKGYKFFSNRMLVTIFSAPNYCGEFSNAGAVMNVDKLLVCSFQILKPYFGKKINSSK

SEQ ID NO: 6123 - protein, 451 aa, Zea mays
MVGGGGGGPLRRVGKYEVGRTIEEGTFAKVKFAQNTETGESVAMKVLDRSSILKNKMAEQIKREISIMKLVRHPNVVRLHEVLASRKKIFIILEFITGGELFDKIIRHGRLSEADARRYFQQLIDGVDFCHKKGVYHRDLKPENLLLDSQGNLKISDFGLSAWPAQGSFLLRTTCGTPNYVAPEVLSHKGYNGALADTWSCGVILYVLLAGYLPFDEVDLTTLYGKIESAEYSFPAWFSGGAKSLIRRILDPNPETRIRIEEIRSDEWFQKNYEPIKEIENEEVNLDDVNAAFDDPEDDNEDAFEDETGPLTLNAFDLIILSQGLNLAALFDRRQDCDKLQNRFLSRNPAKVILSSMEVVAQSMGFKTHIRNYKMRVEGLNADKTSHLSVMVEVFEVAPSIFMVELQRAAGDTSEYNTFVNNYCSKLDDIIWKFPTEKGKSRIPRLSKSHS

SEQ ID NO: 6124 - protein, 564 aa, Xanthomonas oryzae
MCSIFGIFGLQPGDDLQALRRQALECSQRQRHRGPDWSGVYVDAGAILVHERLAIVDPAGGSQPLLSEDGQLALAVNGEIYNHRELKAELLQPYAFQTGSDCEVINALYREDVPALYLNRLNGIFAFALWDKTEGRVIIARDPIGVVPLYWGHDREGRLRVASELKSLVDDCADAAQFPPGHWYDSATGALSRYYERAWREYAEVEGVQVQLQELREAFERAVHRQLMTDVPYGVLLSGGLDSSLVAAVAARYARHRVEENDTTEAWWPRLHSFAIGLKGSPDLAAAEVAAAALGTVHHGFEYTFEEGLDALPDVIRHIETYDVTTIRASTPMFLLARRIKAMGVKMVLSGEGSDEIFGGYLYFHKAPNAREFHEELVRKLDALNNYDCLRANKSMMAWGVEPRVPFLDREFLDVAMRMDASFKMIDKTSSGAARMEKGVLREAFAGYLPESILWRQKEQFSDGVGYGWIDGLKAHAAANVSERELAAADRRYPVNPPQTKEAYFYRTLFEQFFPGQSAAETVPGGKSIACSSPTAIAWDASFAAMADPSGRAIAGVHAQAMDS

SEQ ID NO: 6125 - protein, 500 aa, Oryza sativa
RVACTDGAEMGKEASAMVARRSTSRRDWRRWWWWLLPLACCFVCWVASSAATVAPAAGVAVTSLPGFDGPLPFSLETGYVEVNESTGVRLFYYFVQSEKDPDVDPLLLWLSGGPGCSSLSGLTHEIGPFQFAAKRYYSGGLPKIIYQPETWTKVSNIIFVDSPVGAGFSYAATQEGSKTSDTKTVKQLVIFLRKWLHDHPQFLLNPLYIGGDSYSGYIVPTLALAIDESNDSGDKPILNLMGYVAGNPRTERQFDEGGKIPFLHGMGLISNELYEHAKETCRGKYNAPGNARCEQSMKVIHDCTKDINMLHVLEPFCEDVGSPGIHNNEATDGMIRLMLESASAANDDIIEFKCRKASYVVLQIWANDKTVRESLGVHKGTVGEWIRCNFDVDYIADVYSTVEYHLTLMRKGYRALIYSGDHDCQVPFTGTQAWIRFLNLSVIDDWRPWYAAGQVAGFTRSYANNNLIYATVKGAGHTAPEYKPKECLEMFARWISGNTL

SEQ ID NO: 6126 - protein, 328 aa, Zea mays
RTLSLRLKVKIIRYAPCGEIVKHASVPYNLTEDNGWGLEIFEVKRCLEEARSAGLTVRAMVVINPGNPTGQVLSVTNQEEIVEFCRKEGLVILADEVYQENIYAENKKFHSFKKVARSLAYDENDLTLVSLHSVSMSYGESGRRGGYMEVSGVAANVKDQIYKVASLTLCPNIAGQILVSLAMDPPKLGDESFESFDKEKEQIRSSFCKRAKTLEKAFSGLEGVTCNKLEGALYLFPRLHLPSAAIRAADFEGVSPDIFYAHRLLDATGIAVVPGSGFHQASGTIHIRCTILPDERKIEAMVARLRAFHKAFMNEFRGSQQVMNDLRR

SEQ ID NO: 6127 - protein, 443 aa, Zea mays
MESTGKILMERYEVGRLLGKGTFGKVHYAKNLESNESVAIKMMDKDKVLKAGLSEQIRREITTMRLVAHKNIVELHEVMATRNNIYFVMEYVKGGELFDKIGKSGKLTEAAAHKYFQQLIGAVDYCHSRGVYHRDLKPENLLLDENENLKVSDFGLSALSESKGQDGLLHTTCGTPAYVAPEVISKTGYDGAKSDIWSCGVVLFVLVAGYLPFRAPNMMEMYRKIQNGDFRCPSWFSHKLKKLLYKILDPSPDTRISVQKIKESTWFRKGPVETRTVKEKILSENDTTNAAPAVAMRRKKNVHEDVKPPTVTSLNAFEIISFSTGLDLSGLFIRKECKKETRFTSDKGAVSIISKLEDVAKALNLRVRKKDNGVVKIQGRKVGRKGVLEFDTEIFEITASYHLIEMKQTGGDSLEYKKLLEEDIRPALKDIVWAWHGDDQQQK

SEQ ID NO: 6128 - protein, 491 aa, Oryza sativa
MDPCKFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPLRHAPPTPITPRPVVGRRQKATIHKQNDFKQPGERYRSWAPDRQERFIPLRRRVAHPKVSPELRAIWVNYLSQCDESLGVKIANRLNVKPSM

SEQ ID NO: 6129 - protein, 400 aa, Saccharomyces cerevisiae
MPFVKDFKPQALGDTNLFKPIKIGNNELLHRAVIPPLTRMRAQHPGNIPNRDWAVEYYAQRAQRPGTLIITEGTFPSPQSGGYDNAPGIRSEEQIKEWTKIFKAIHENKSFAWVQLWVLGWAAFPDTLARDGLRYDSASDNVYMNAEQEEKAKKANNPQHSITKDEIKQYVKEYVQAAKNSIAAGADGVEIHSANGYLLNQFLDPHSNNRTDEYGGSIENRARFTLEVVDAVVDAIGPEKVGLRLSPYGVFNSMSGGAETGIVAQYAYVLGELERRAKAGKRLAFVHLVEPRVTNPFLTEGEGEYNGGSNKFAYSIWKGPIIRAGNFALHPEVVREEVKDPRTLIGYGRFFISNPDLVDRLEKGLPLNKYDRDTFYKMSAEGYIDYPTYEEALKLGWDKN

SEQ ID NO: 6130 - protein, 343 aa, Oceanobacillus iheyensis
MTQLDKQYKIKGLSLKNKIVMAPMCQYSVDAKDGIPNDWHFVHYVSRAVGGAGLIIVEMTDVDPDGRITDYDLGLWSDEHVPAYRRIVDEVHRYDAKIGIQIAHAGRKAEDAEPPVAPSAIPVTAESKVPRALTTEEVKQTVKQFQDAAKRAVEAGFDTIEIHGAHGYLIHQFHSPLINKREDRYGEDLSLFGVEVIQAIKEVIPEDMPLLMRISAMEYMDEGYDLNHSVDIAKKYQEAGVDVFHISSGGEGPPGKRKPANHPGYQIRFARTFRQELNVPIIAVGVLEHPKVAEAALGNEDADLIAIGRGMLKDPYWAIHAIEEITGIAVPPKQYERAFPRKK

SEQ ID NO: 6131 - protein, 117 aa, Emericella nidulans
LYTHHGIETGFSGGYHEYFGPAVDDDGVMYLALANEMLHRLYPDCITVAEDVSGMPALCLPHGLGGVGFDYRLAMAIPDMYIKLLKEKSDNDWDIGNLAFTLTNRRHGEKTIAYAES

SEQ ID NO: 6132 - protein, 131 aa, Zea mays
QSDEAWKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 6133 - protein, 483 aa, Arabidopsis thaliana
MSGVVRSSPGSSQPPPPPPHHPPSSPVPVTSTPVIPPIRRHLAFASTKPPFHPSDDYHRFNPSSLSNNNDRSFVHGCGVVDREEDAVVVRSPSRKRKATMDMVVAPSNNGFTSSGFTNIPSSPCQTPRKGGRVNIKSKAKGNKSTPQTPISTNAGSPITLTPSGSCRYDSSLGLLTKKFVNLIKQAKDGMLDLNKAAETLEVQKRRIYDITNVLEGIDLIEKPFKNRILWKGVDACPGDEDADVSVLQAEIENLALEEQALDNQIRQTEERLRDLSENEKNQKWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVENDESDYWLLSNAEISMTDIWKTDSGIDWDYGIADVSTPPPGMGEIAPTAVDSTPR

SEQ ID NO: 6134 - protein, 461 aa, Unknown
  Azoarcus sp. EbN1
MRNKLQKAGLIMTGVFAGVLISLNFPASADKVSAAPLPVEELRAFADVFNAIKQGYVEPVEDKKLINHAISGMLSGLDPHSAYLDVEAYKELQVGTHGEFGGLGIEVGMEDGFVKVISPIEDTPAFRSGVKAGDLIVKLDETPVKGMTLSDAVKRMRGKPKTDITLTIVRKGEDRPVVVTLTREVIKVQSVKSKMVEPGYGYLRVAQFQENTSQAVAEHLAKLAKEGDMKGLVLDLRNDPGGLLHGAVGVASAFLPANALVVSTDGRTDDAKREYRARADDYLRGSREDFLKDLPAGARTLPMVVLVNAGSASASEIVAGALQDHRRAVVMGTQTFGKGSVQTILPLNSNTAIKLTTARYYTPSGRSIQAKGIEPDIIVEETANGSSRRLREADLERHLGNDRDPEAEPKKADEPKAGDQSPADDEAEALPRPELASKDDYQLNQAINLLKGLQIVQNKKE

SEQ ID NO: 6135 - protein, 559 aa, Unknown
  uncultured alpha proteobacterium EBAC2C11
MAAKEVKFGAEARTKMLEGVDILANAVKVTLGPKGRNVVLEKSFGAPRITKDGVTVAKDIELKDKFQNMGAQMVREVASKANDVAGDGTTTATVMAQSIAQEGAKAVASGMNPMDLKRGIDMAVDSVVKSLEAKSKKISTSDEVAQVGTISANGEEEIGKMIAEAMERVGNEGVITVEEAKSLDTELDVVEGMQFDRGYLSPYFVTDAEKMRATLEEPYILLHEKKLSNLQDMLPILEKVVQSGRPLLIIAEDIEGEALATLVVNRLRGGLKVAAVKAPGFGDRRKAMLEDIAILTNGTVVSEEVGISLDGLTLDMLGSAKRVEITKDESTIVDGSGAKKEIEARCNQIRAQAEESTSDYDREKLQERLAKLAGGVAVIKVGGATEVEVKERKDRVDDAMHATRAAVEEGIVPGGGVSLVKAIPNLSKLKPANRDQEVGIEIVTRALQAPARYIAQNAGAEGSVIVGKLIEGKDDNVGYDATSNDFTDMIKAGVIDPTKVVRSALQNAASVAGLLVTTEAMVAEKPEPKESAPGGGMPDMGGMGGMGPWGGMGGMGGMM

SEQ ID NO: 6136 - protein, 164 aa, Brassica napus
  misc_feature (14)..(14): Xaa can be any naturally occurring amino acid
  misc_feature (42)..(42): Xaa can be any naturally occurring amino acid
  misc_feature (53)..(53): Xaa can be any naturally occurring amino acid
  misc_feature (135)..(135): Xaa can be any naturally occurring amino acid
LQNRCKFALDIVEXVANEIGPDRVGIRLSPFADYMESADTNXQALALHMAQSXNKYGILYCHVIEARMKTMGEITECPHLLVPMRKAFQGTFISAGGFTRTDGNEAVEEGRTDLVAYGRWFLANPDLPKRFEVDXPLNKYDRPTFYTSDPVVGYTDYPFLESKA

SEQ ID NO: 6137 - protein, 544 aa, Ustilago maydis
MVAELKQRTTTATRDAPAAPKEEFADANIPDDYVSRVLATEKPLPPIQLKNILSEIQWVSFLALTVTPILAIYGLFTTSWNTKTALWSFIYYFMTGLGITAGYHRLWAHRSYNATYPLQYFLACMGSGAVQGSIHWWSRGHRAHHRYTDTDLDPYGAHFGLFWSHLGWMLVKPRRKPGVADISDLRKNPVIKFQHKFYIPMLLFFGFGLPTLVAGLGWNDWRGGFFFAGMLRLVFVHHSTFCVNSLAHYLGEATFDNKMTPRDHFFTALVTVGEGYHNFHHQFPMDYRNAVQWYQFDPTKWFIASMYKLGLATHLKTFPDNEVKKGRLAMQLQKAHELGQQLEWPKSSAHLPVISWDDFVEESKTRPLMVVHGFIHDVSSFLDEHPGGRHLLTGKIGKDATTAFLGGVYDHSNAAHNLLSMMRVGVLDGGYQLAKDELAKAERENRATGVSSHRPAGSPPSPVTSDDEDFAAPATPTDDTPMTTTSTVAAASEQLKAQQSADNVKSINAKAAAYVTPGEAYTIVKRGDLRENAKVGGTKFGRFL

SEQ ID NO: 6138 - protein, 726 aa, Solibacter usitatus
MPLPKSRPRGMQDVRWSMLEPHTTKAVEPGSPFPLGATLVDGGVNFAIYSKQAAGVFLLLFDSADGAATDVIPLTARDKLVWHACVKGVRAGQLYGYKVSGEYRPDLGLRFNEAKLLLDPYARAVTGKFRNVDNLLLAYAAQPASADLTQDTRDNSAVVPKGIVIDDGFDWQGVGAPKSALEQLVIYEVHVKGFTAHPSSGVSAPGTYLGFIEKIPHLTRLGVNAVELMPVHEHYVDDFLVDRGLTNYWGYNTIGFFAPEVSYGSQREAGCQVAEFKTLVRELHRAGIQVILDVVYNHTAEGNEMGPSMSFRGLDNVSYYCLTGPAEAPRRYYMNYTGCGNSMNFDSPAVIRLVMDSLRYWVEAMHVDGFRFDLASVLGRGADGSFRSTSGFFDAVAQDPVLSRAILIAEPWDTGTYQLGNFPIDWSEWNGKFRDTVRCFAKSDSGQLSQMGWRLTGSADLYGSEGRSAYNSVNFVTCHDGFTLHDLVSYNGKHNEGNGENNQDGTNDNNSWNCGAEGDTTDSGILSLRRQLMRNHACYLMFACGTPMMLGGDEFARSQQGNNNAYCQDNAIGWFDWSLVERNGDLVEFFRKAIAFTRRFPVLQRRKFLLGDDLDADGVADLTWFSPDLGTPAWSDANARVLCYQLDTSDCGDTCDADRLFFILNSDFDSQWVKLPPLAAGHTWFRAIDTSLAAGEDFAENGTEVRVEPDDHYIANARSTVVLLAR

SEQ ID NO: 6139 - protein, 491 aa, Pseudomonas fluorescens
MLSLSVQAATLTRDNGAAVGDNQNSQTAGATGPVLLQDVQLIQKLQRFDRERIPERVVHARGTGAHGTFTVTDNLTDLTRAKVFAAGEVTPVFVRFSAVVHGNHSPETLRDPRGFATKFYTEDGNWDLVGNNFPTFFIRDAIKFPDMVHAFKPDPRTNLDDDSRRFDFFSHVPEATRTLTELYSNSGTPASYREMDGNGVHAYKLINAKGEVHYVKFHWKSLQGLKNLDPKQVVEVQGRDYSHMTNDLVTHINKGDFPKWDLYVQVLKPEDLAKFDFDPLDATKIWPGVPERKVGQMVLNRNPANVFQETEQVAMAPANLVPGIEPSEDRLLQGRVFSYADTQMYRIGANALQLPINAPKNPVNNGNQDGAMNLGHSSTGVNYQPSRLMPREEPQTARYSQMALAGSTQQAKIQREQNFKQAGDLYRSFSKKERQDLIDSFGGSLATTDDESKHIMLSFLYKADPEYGTGVTKVAKGDLARVKALAAKLSD

SEQ ID NO: 6140 - protein, 344 aa, Photobacterium profundum
MMQGLYMPNMKTLGEFIVEKQNDFPHASGDLSSLLGSIKLAAKIVNREINKAGLVDITGAIGSENVQGEEQQKLDLYANDKFKAAMEARDQVCGVASEEEDEAVTFNKDLNRNAKYVILMDPLDGSSNIDVNVSVGTIFSIYRRVSPIGTTPTQDDFLQPGNQQVAAGYVIYGSSTMLVYTTGNGIHGFTYDPSLGVFCLSHENMQIPEDGQIYSINEGNYIRFPQGVKKYIKFCQEDVPADNRPYTSRYIGSLVSDFHRNLLKGGIYMYPSTAMYPNGKLRLLYECNPMAFLMEQAGGVASDGKNRILDITPTELHQRVPFFVGSTNMVKQVESFIEEYPEQH

SEQ ID NO: 6141 - protein, 740 aa, Unknown
  Pelargonium x hortorum
MEACNCFEPQWPADDLLMKYQYISDFFIAVAYFSIPLELIYFVKKSAVFPYKWVLVQFGAFIVLCGATHLINLWTFNLHTRTVEIVMTTAKLMTAAVSCVTALMLVHIIPDLLSVKTRELFLKNKAAELDREMGLIRTQEETGRHVRMLTHEIRSTLDRHTILKTTLVELGRTLGLEECALWMPTRTGLELQLSHTLRQQNPVGYTVPIHLPVLNQVFSSNRAIKISPNSPIARLRPLAGKYVPGEVVAVRVPLLHLSNFQINDWPELSTKRYAMMVLMLPSDSARQWHVHELELVEVVADQVAVALSHAAILEESMRARDLLMEQNVALDMARREAETAIRARNDFLAVMNHEMRTPMHAIIALSSLLQETDLTSEQRLMVETILKSSNLLATLINDVLDLSRLEDGSLQLDIATFNLHAVFRQVFNLIKPIASVKKLFITLNVSPDLPEYVIGDEKRLVQIMLNVVGNAVKFSKEGIISVTAFVAKSESVRDPRAPDFFPVSSDNQFYMRVQVKDSGSGINPQDMPKLFTKFAQSQPVATKNSGGSGLGLAISKRFVNLMDGHIWIDSEGPSKGCTVTFVVKLGIPEGSNEPKLPLMPKVSANNSQTDFPGLKVLLMDENGISRMVTKGLLMHLGCDVTSVSSSEECLRMVSQDHKVVFMDVRVPGLDGHELAVRIHEKFMKRHERPLIVALTSNADKVTKENCLRVGMEGVILKPVSVDKMRNVLSKLLEHRILFEA

SEQ ID NO: 6142 - protein, 193 aa, Yarrowia lipolytica
SLSTITKMAPPLNNPNYQPQQQNPNYQTRNNDEPSNACLYVLAVFFPFVAVGIKRGGCSGEMWLCLLLSYFFYIPGLIYAIYIIQQDSDKRRAQDVEHMGQGYATQYQQPQPIQPHYNQQPLHQQQAYPTEGTYPQVAPAKHEPAPMTQPPVNQHSGVAPQMHSGISPQAPPPTYAEGPSQPLHEKAQYVPPN

SEQ ID NO: 6143 - protein, 741 aa, Unknown
  Pelargonium x hortorum
MESCNCIEPQWPADELLMKYQYISDFFIAIAYFSIPLELIYFVKKSAVFPYRWVLVQFGAFIVLCGATHLINLWTFNMHSKTVEIVMTTAKIMTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGFTVPIHLPVINQVFSSNHAIKISPNSPIARLRPIAGKYMPGEVVGVRVPLLHLSNFQINDWPELSTKRYALMVLMLPSDSARQWHVHELELVEVVADQVAVALSHAAILEESMRARDLLMEQNVALDMARREAETAIRARNDFLAVMNHEMRTPMHAIIALSSLLQETELTPEQRLMVETVLKSSNLLATLINDVLDLSRLEDGSLQLDIGTFNLHALLREVHNLIKPIASVKKLCISLNVATDLPEYAVGDEKRLVQIILNVVGNAVKFSKEGNISITAFVAKSESLRDPRAPDFFPICGENQFYLRVQVKDSGLGINPQDIPRLFTKFAQTQPVATKNSGGSGLGLAICKRFVNLMEGHIWIDSEGPGKGCTATFVVKLGIPERSSEPKLLLMPKVPANHGQTNFSGLKVLLLDDNGVSRAVTRGLLAHLGCDVTTVSSSDELLRVVSQDYKVVFMDVCMPEVDGFEIAVRIHEKFMTRHERPLIVALTGNIDQVTKDNCTRVGMEGVVLKPVSIDKMRNVLSNLLEHRVLFEAI

SEQ ID NO: 6144 - protein, 451 aa, Bradyrhizobium japonicum
MMRKTSVILLSAATGAALTLFVTQPRAVFMGSSARAATADTYRQLNLFGDVFERVRSDYVEKPDDTKLIESAISGMLTGLDPHSSYMDAKSFRDMQVQTRGEFGGLGIEVTMEDGLIKVVSPIDDTPASRAGIMANDIITNLDDEAVQGLTLNQAVEKMRGPVNTKIKLKIIRKGQDNPLDVTLVRDNIRVRSVRARIEADDIAYIRITTFNEQTTEGLKREVANLSNQIGDKLKGYIIDLRNNPGGLLEEAVTVSDSFLEKGEIVSTRGRNAEETQRRTAHAGDLTKGKPVIVLVNGGSASASEIVAGALQDHKRATIVGTRSFGKGSVQTIIPLGSGNGALRLTTARYYTPSGKSIQAKGIVPDIEVLQDVPDELKSRTDTKGEASLRGHLKNDGDEKTGSQSYVPPDAKDDKALKLADDLLHGIKNSASAAPTPGTDKAATDKPKAAN

SEQ ID NO: 6145 - protein, 524 aa, Escherichia coli
AAKDVKFGNDAGVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTVAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLP

SEQ ID NO: 6146 - protein, 347 aa, Unknown
  Bradyrhizobium sp. BTAi1
MAREWPMEQSPTLQAHLALQNADADCAAVIEALADAARELARQIAIAPLAGFDEGAATVNADGDVQKALDIVADNLMRDALRKAPVAGILSEEVDRPETVNAAAPLCVAIDPLDGSSNLQNNISVGTIFSIRPRGRDVLSSFFEPGTAQRAAGFFVYGPQTCLVLAIDHRVDLYVLHPTLREFVLARSGLRIPQDTPEFAINASNRRHWSGTVRNYVDECLAGAAGPRGRDFNMRWIASLVAEAYRILMRGGVFLYPADSRPGYREGRLRLVYEAHPMALIMEWAGGSASSGRSRILELSARSPHQRAPLIMGDVRLVRDVDQLHEGVEPLFETSDAPLFARRGLFR

SEQ ID NO: 6147 - protein, 181 aa, Arabidopsis thaliana
RLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKRVKEIELQNDNMYLRSKITERTGLQQQESSVIHQGTVYESGVTSSHQSGQYNRNYIAVNLLEPNQNSSNQDQPPLQLV

SEQ ID NO: 6148 - protein, 366 aa, Unknown
  Polaromonas sp. JS666
MPSLFDPTQAGDIHLANRIVLAPLTRNRAPDAIPTSLMAEYYAQRASGGLLVTEATAISHQGQGYADVPGLYGTAQLDGWKEVTRAVHEAGGKIVVQLWHVGRVSHTELQPDGGQPVAPSAITARTKTVLLKDGAPTFVATSEPRALRADELPGIVHAYEAAARNAVETAGFDGVEVHGANGYLLDQFLKRGSNQRTDDYGGSIENRARLLLEVTRAVTGAIGGGRTGIRLSPVTPANDVHDADPQPLFDYVVRQLATLNLAYIHIIEGATGGPREIADRPFDYAALKTAYREAGGKGAWMVNNGYDQALAKQAVANGADLIAFGKPYIANPDLVERLRRNAPLNLPDQATFYGGGAKGYTDYPTL

SEQ ID NO: 6149 - protein, 133 aa, Magnaporthe grisea
MVNPPKEGEPSYELYKKEYDGIFEGLKARATALHKAFAEMEGVECDTPQGSMYLFPTINVPQKAAAEAEKEGRTPDEFYCMRLLEATGVCVVPGSGFGQKPGTLHLRTTFLAPGTEWVGSIVKFHKEFMDKYR

SEQ ID NO: 6150 - protein, 1008 aa, Chlamydomonas reinhardtii
MPHEFKTAVVWFRRDLRVDDNPALVAALAAAPNVIPVFIWAPEEEGQFQPGRCSRWWSKHSLVDLQQALAALGSRLVIRRSTDSTAALLQLVTELGAEAVFFNHLYDPISLMRDHDCKRGLTAAGVAHRTFNGDMLYEPWDVLDPNKQPYSTFDDFWNSVRAMPVPPPFPVSAPASMPAVPAAVPSMTVAEVDWFFTPEQEASSDQLKFKWKPGVGGAISELEHFLAERLTEFEHDRAKVDRDSTSRLSPWIHIGSISVRYIFYRVRQCQAEWLAAGTDRAQSCDDFLQQMGYREYSRYLAFHFPFIHERSLLGHLRACPWRIDQHAFKAWRQGQTGYPIVDAAMRQLWSSGWCHNRGRVVAASFLVKDLLLPWQWGLKHYWDAQIDADLECDALGWQYVSGGMSDAHPFSYMMDLEKEARRFDPDGEYVRRWLPALSRLPTEYIHAPWKAPASVLAAADVELGCNYPLPIITRSDAKANVDYACGVLEKSAVAPTGSESSGRYPYRAPTYPNAGGGGGASGGVDGAGSSGGNPTAAMGASGGAGPSSGTGTGGQGGAFRGRGDGGGSAPVSQQGGMLPPGVAVCVTAGTGGTQPDSRTVSGAHAGVSNSAGGVACDMPPPSHSHPRGGSSGVAAAGVGGVSGGPSSGGAAAPGATRKATAPGGAVFYHPGEASGEGHALLERILQQQRRQRGAANRQDGSGTNQPPPPVSMPGMLDAAGAAGGGGGGGGGLAGLPGVLQGLHGGAGATAAPAVAWAGRVAAGGVDDMDAVALWQQQQQLLQGGAAAFAFEQAMELLLARRRAGDGVSGFCGGDAPGRGGGDADEADGLMLEEDSEEVVSNTVDLHLSAFTGASCHRQSGTARGARAAERRLKKEAGSPEVTDGGGSAGAGCGEEDAMQCEDEEHGERGSPARRTADEEAQPPAEEGGAGSEDAGAAASEGDEAEGYGSESASEDNGGATPVEEADQMVVDGGGGGGGGGGGGGGRGGGQHKRRRSQLEGEQGDAAWE

SEQ ID NO: 6151 - protein, 354 aa, Nitrosomonas europaea
MLFNPLQVGSLTLPNRILLAPLTRARADAGHMPNALMAEYYSQRATGGLLISECTMVAPGTSAFVNEPGIYNDAQIAAWRQVTDAVHAKGGRIFMQIWHAGRAAYPGAADGAPIVSSSATAIEGEIHTPQGKVPHAVPRPLTVDEIPGIVAAFAQGARNAIAAGFDGVEVHGANGYLIDQFLRDTPNQRTDAYGGSLENRARLLFEVLTAVTQAIGSERVGLRLSPLNSFNSMKDSDPLALIGFLADRLNAFKLAYLHVMRADFFGVQKADVMPVAREKYKGVLVGNMGYSADEAEAAIAEGRLDAVAFGTAFLANPDLPARIRAKAPLNAPDSNTFYAGGAKGYTDYPTLQLA

SEQ ID NO: 6152 - protein, 414 aa, Dechloromonas aromatica
MKHVKKSAKLANVCYDIRGPVLQKAKQMEEEGHKIIKLNIGNLAAFGFDSPEEIQQDMIRNLPNAAGYTDSKGIFAARKAIMHYTQQKGIKGVTLEDIYVGNGVSELIVMAMNALLDAGDEVLVPAPDYPLWTAAISLSGGTPKHYLCDESKGWLPDLDDIRSKINAHTKAIVLINPNNPTGALYPDDLLYEIIDIARQHHLTIYADEVYDKVLYDDVKHTSIASLAEDVLMITFNGLSKNYRSCGYRAGWMVVSGDKRHAKDYIEGLDMLASMRLCANAPGQHGIQTALGGYQSINDLIKDGGRLRRQRDIAHELITAIPGVTCVKPKAALYMFPRLDPKIYPIKNDQQFISELLQEEKVLLVQGTGFNWPHPDHFRLVFLPHEDDLREAVARIARFLENYRKRHNTNQLIKD

SEQ ID NO: 6153 - protein, 563 aa, Unknown
  uncultured crenarchaeote
MCGIVGILSKKERNVAPLIGKMLSCMKNRGPDGMGLSTENQIVYSDTFDNPLFSQVEGHDVLGHSRLAIVGGSCGQQPFVSCDKKLILEHNGEIYNYKEIRKNLSAHHTFTTSTDSEVIVHLLEDHYQNTKGDLIEAIRRTVTQLDGIYVLAIREQSTGDIVLVRDGIGVRQIYYGESSDFIAFASERKALWKIAMSDQIKRLLPGYALVISRKEGSSNFKTTLFPISVNTKKSICEKYSILYTDIDSAVNAYGDTLVESMRKRVSDFKKIGIVFSGGIDSVIVAYLAKQMAPEVICYTSGIKGSSDILNSLEIAEKLDLKLEIEQMTESDVESTIPKIISIIEDDNMGQVEVAIPIYGAVKLAHEQGIRVMLTGQGADELFGGYSWYSKIVKKHGYEKIQGYLIEDIKLLYKETLEREDKITMSQSIELREPFLDTNLIDTVLRIDPRLNIQNNGNNYDNLGKRVHRKLAEKLGIPKEIAYRIKEAAQHGSGIHNTLNTLAMKNGFTESKVNSSYLDKLKKRELIGSSQRYGHLFEKEQIWSLEPHIQMYLENISKNILPRN

SEQ ID NO: 6154 - protein, 634 aa, Unknown
  uncultured bacterium
MEANHPSAMNAAAHSTSLAAPAAAAFSHFRQYEVLGAHADSTGTHFTVWAPNAKQLELIGTFSNWVPVAMQRAQDGSGRWSARVEGAGHGDLYKYRIEDAHGQWTEKADPYATRQEHPPGTASQIWKLDYEWNDRAWMAARADRQALGAPMSIYEVHLGSWQRQEGGRFLNYRDIAQRLAAHCNALGFTHVELMPITEHPFYGSWGYQTTGYFAPTARYGDPQDLMVLVDTLHQHGIGVLLDWVVSHFPSDAHGLARFDGTALYEHEDLRKGFHPEWNSLIFNYGRYEVRDFLIGNALFWLSKYHFDGIRVDAVSSMLYLDFARKPGEWVPNADGGHQNWEAVRFLQDLNCAVYAEFPDVQVIAEESTAWAGVSRPVDAGGLGFGMKWNMGWMNDTLRYMQRDHGHRHWHEGDIRFSMVYAFDENFVLALSHDEVVYGKRSLLSRQPGDQWQRFAGLRTLYGMMWSHPGKKLLFMGGEFGQVDEWHHERTLDWHLWAKARHSGMARWVADLNRIYRERPALHAHDFDAEGFAWAPVAPHQSTVLAFVRRAGDDIVLAVHNLTPQPVAALRVGVPVAGRWHELLNSDAEPYGGSGMGNFGGVDATPTPLEGQPAHLHLTVPPLSTVFLSNRPTRA

SEQ ID NO: 6155 - protein, 256 aa, Schizosaccharomyces pombe
MSFQILPIPMWVGTQDNYAYLLLCEETRQAAIVDPAEVNVVMPILKKKLKNKEIDLQAILTTHHHADHSGGNLNLKKEFPHVTIYGGSDQNGVSHVLQDKETLRIGNVQIEALHTPCHTRDSICFYAHSSNEHAVFTGDTLFNAGCGRFFEGTAAEMHIALNAVLSSLPNNTVIYPGHEYTKSNVKFASKHLQSEALNHLEGLCNHNQFIAGHITMGQEKQFNPFMRVTDPELQKHLGLNDPIKVMDELRTLKNQG

SEQ ID NO: 6156 - protein, 646 aa, Xanthomonas oryzae
MCGLAGLLLASPRLHGEQLDALVRPMGAALRHRGPDDAGTWCDAQAGVALAHQRLSILDLSPLGHQPMRSADGRYVLAYNGEVYNFAQLRAALSALGHRFRGHSDTEVLLAAVVEWGLDETLTRCNGMFAIALWDERDNCLFLARDRVGKKPLYYGWAGDTLVFGSELKALWQHPDFDNGVDRNALTLLLRLGYIPAPACIHAHTFKLMPGRVLRMDAQAVAAGAAAHRADQAQQPFWNAREAMQRALAAPFTGSDAQAEEQLDSVLRDAVALRMVADVPVGVFLSGGTDSSIVTAMMQAQSAQPVHTFSIGFEGSHHDEAPLAREVATHLHTDHTELYVSGADALAVVPCLPDMFDEPFADASQVPTALVARLARGGVTVALSGDGGDELFFGYGRYQRALRNWRMHGLVPGPLRRLMAVAARRNGESSRTGGLAALVAEAGARGIGDIYRNRISRWRDPAAVVPGATEPDSFYSLADPLHGSGTPADAMMLADFAAYLPDDLLCKVDRTTMAVGLEARAPLLDWRVAEFAWSLPLSLKYRDGMSKYLLKRVLCRYLPDTMVYRGKRGFGAPVSAWLRGDLHGWADDLLAHGALQREGVFAADTVAGLWRDFNGGERKWHTHLWTVLMFQAWQAHWREQRAAITR

SEQ ID NO: 6157 - protein, 376 aa, Unknown
  uncultured archaeon GZfos18B6
MEERGISKQELESFLKEQKQRDLTYRKVLSSMCTYPREIAVYAHNLFLDSNLGDSGLFPGTKEIEDELIRMIGALLGNENAHGYISTGGTESNIQAIRAIRNRKRKEGLQQMNIIVPKTAHFSFDKIEDLLSLEVKKAGLDDELRVDVNLVEELIDDNTISIVGIAGTTEFGQIDPIKELADIAHNSDIFLHVDAAFGGFVIPFLDAEYQFDFSLDAVSSISVDPHKMGMSTIPAGCILFRDESYLADLAVNTPYLTTNEQCSLIGTRSGAPVAATYAVLKYLGRNGLRAIVDECMLLTRMLVRGAKAMDIYPVIEPVTNVVTLRFPDVDRVAKALEARGWRVSTTRAPKALRLVIMPHVTEDTIELFLNDLACVT

SEQ ID NO: 6158 - protein, 131 aa, Edwardsiella tarda
VTAINRGDYPKWDLYIQVLKPADLKNFDFDPLDATKVWPDVPERKIGEMVLNKNPDNVFQETEQVAMAPSNLIPGIEPSEDKLLQGRLFAYADTQFYRIGANGLSLPINKPHSVVNNGNQDGQLNSGHTLD

SEQ ID NO: 6159 - protein, 529 aa, Zea mays
MFSPPFSPSPSPPSLEAFAPQLLRPVRPPTRLIPPAAMDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYSLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAISVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLPSRLNLKPSM

SEQ ID NO: 6160 - protein, 711 aa, Cytophaga hutchinsonii
MKKPTSKTEGTDPKFQDLQKNTSDATDQFMTTDQGLKINDDNNSLKAGERGPSLLEDFILREKITHFDHERIPERIVHARGSAAHGYFQVHESMAQYTKAGFLQDPSIKTPVFVRFSTVAGSRGSTDLARDVRGFSVKFYTAEGNYDLVGNNMPVFFIQDAAKFPDLIHAVKPEPHHEMPQAASAHDTFWDFISLMPESMHMIMWVMSDRAIPRSLRMMEGFGVHTFRFINKNNESHFVKFHWKPKQGTHSVVWDEAQKISGKNCDFHRQDLWEAIESGNFPEWELGVQLIPEADEHKFAFDLLDPTKLVPEEEVPVTIIGTMVLNRNPDNFFAETEQVAFHPGHLVPGIDFTNDPLLQGRLFSYTDTQLSRLGSPNFHEIPINRSVAPTHNNQRDGHMRQEINTGRVSYHPNSLGGGCPFQAKMAEGGFTSFNERIDAKKVRERSESFSDHFSQATLFFNSQTEVEKGHIIKALRFELGKVETEAIRVRMVGLLSQIDKTLATKVAAGLGIAVPAPAFPMNHGVGADDDFEKHEPKKAEQVTKSSDALTILRNPTVTPSIATKQIAFLCADEVSGASVVSYKNALERKGAVVKIIAPHLGFIKTEEGKKIKVDQSLLIAASVLFDAVFIPAGKGIKQLKGIKEVAEFITDTYKHCKVIGGEDEGALVIQSVQAIMEAGKNADEGIVLNKDTTAFVKALGKHRFWEREEAV

SEQ ID NO: 6161 - protein, 581 aa, Nicotiana tabacum
MGNTCVGPSISKNGLFQSVSAAMWRTRAPDDSGSTTNGDSARGETTESGKDPDLVVQNKPPEQITMPKSEQKEEEPAKKEEGPVKPKKPVEMKRVGSAGLRTDSVLQKKTGNLKEFFSIGKKLGQGQFGTTFKCVEKATGKEYACKSIAKRKLLTDDDVEDVRREVQIMHHLAGHPNVISIKGAYEDAVAVHVVMEYCAGGELFDRIIQRGHYTERKAAELTRTIVGVLETCHSLGVMHRDLKPENFLFVNQKEDSLLKTIDFGLSIFFKPGDRFNDVVGSPYYVAPEVLKKRYGPEADVWSAGVIVYILLSGVPPFWAENEQGIFEEVLHGDLDFSSDPWPSISEDAKDLVRRMLVRDPKKRLTAHEVLCHRWVQVDGVAPDKPLDSAVLSRMKQFSAMNKLKKMALRVIAESLSEEEIAGLKEMFRMIDTDNSGQITFEELKVGLKRVGANLKESEIYDLMQAADVDNSGTIDYGEFIAATLHFNKIEREDHLFAAFSYFDKDGSGYITADELQQACEEFGIGDVHLEDMIRDADQDNDGRIDYNEFVAMMQKGNPVIGGGKKGLEHSFSTGFREALRL

SEQ ID NO: 6162 - protein, 833 aa, Saccharomyces cerevisiae
MNNAANTGTTNESNVSDAPRIEPLPSLNDDDIEKILQPNDIFTTDRTDASTTSSTAIEDIINPSLDPQSAASPVPSSSFFHDSRKPSTSTHLVRRGTPLGIYQTNLYGHNSRENTNPNSTLLSSKLLAHPPVPYGQNPDLLQHAVYRAQPSSGTTNAQPRQTTRRYQSHKSRPAFVNKLWSMLNDDSNTKLIQWAEDGKSFIVTNREEFVHQILPKYFKHSNFASFVRQLNMYGWHKVQDVKSGSIQSSSDDKWQFENENFIRGREDLLEKIIRQKGSSNNHNSPSGNGNPANGSNIPLDNAAGSNNSNNNISSSNSFFNNGHLLQGKTLRLMNEANLGDKNDVTAILGELEQIKYNQIAISKDLLRINKDNELLWQENMMARERHRTQQQALEKMFRFLTSIVPHLDPKMIMDGLGDPKVNNEKLNSANNIGLNRDNTGTIDELKSNDSFINDDRNSFTNATTNARNNMSPNNDDNSIDTASTNTTNRKKNIDENIKNNNDIINDIIFNTNLANNLSNYNFNNNAGSPIRPYKQRYLLKNRANSSTSSENPSLTPLISNLIMTAKFQKFLLMTKKKKKPDFRPFTSRDPNNQTSENTFDPNRFTMLSDDDLKKDSHTNDNKHNESDLFWDNVHRNIDEQDARLQNLENMVHILSPGYPNKSFNNKTSSTNTNSNMESAVNVNSPGFNLQDYLTGESNSPNSVHSVPSNGSGSTPLPMPNDNDTEHASTSVNQGENGSGLTPFLTVDDHTLNDNNTSEGSTRVSPDIKFSATENTKVSDNLPSFNDHSYSTQADTAPENAKKRFVEEIPEPAIVEIQDPTEYNDHRLPKRVKK

SEQ ID NO: 6163 - protein, 639 aa, Lactobacillus reuteri
MCGIVAFVDNEKPQIKDQLIQKMKDRIIHRGPDAEGQYVDDDVALGFRRLSFIDVKSGNQPIFNEDSSKAIEFNGEIYNFEELREELISKGHTFKTHADTEVILHGYEEWGKDVVNKLRGMFGFVIWDFKTKEMFGARDHFGIKPLYYAKMNGTFFVGSEIKAFLDHPNFKKELNKEALKPYMTFQYPVTQETFFKGVYRLPEGHYFTYKDGQFEMTQYWDENFEPEDETFDEAVNKIDEVVKNSVKAHTFADKGIKVGSFLSAGVDSSLVTALMRPDNTFSIGFDSTYDETKQARELAAKMGLKNTDEKLTNEEAFHAFPMIQYYLDEPDSNPSVVPLYFLNKLAKDNGYKALLSGEGADELFAGYIDYGFNTKVKFIRWVTDQLKKMPRERRYKFAKWLDGKHFHGQEHMYRNLAPARDTFIGQAYIFSPEEAADYLQPEFDCGPSIADILNPLFDKMEDKDIDEVAKKQYVDLHRFMPGDICLKADKMSMANSVEIRVPLLDKEVMKVAETTPTKYLFNYKDTKWAFRMAANRHLPEEWATRPKMGFPTPVRAWLREKKYYQEVRELFEQDFVKEFFDQEKLLKLADDNFEGKVDGRRKIWTIYTFLTWYKLYFIDNFKPDESGIDRAQKAATTEV

SEQ ID NO: 6164 - protein, 131 aa, Zea mays
  misc_feature (22)..(22): Xaa can be any naturally occurring amino acid
  misc_feature (34)..(34): Xaa can be any naturally occurring amino acid
  misc_feature (36)..(36): Xaa can be any naturally occurring amino acid
QSDETWKMGDIVHTLTNRRWLXKCVTYAESHDQXLXGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 6165 - protein, 248 aa, Arabidopsis thaliana
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKRVKEIELQNDNMYLRSKITERTGLQQQESSVIHQGTVYESGVTSSHQSGQYNRNYIAVNLLEPNQNSSNQDQPPLQLV

SEQ ID NO: 6166 - protein, 514 aa, Lycopersicon esculentum
MKANPPCLILLLLISATVLTVHSDDDDDDVSPENTILDTGGLSRESFPKGFTFGTATSAYQVEGSASTEGRGPSIWDTFLKIPGLEPNNANGEIAVDQYHRYKEDIDLMAKLNFEAYRFSISWSRIFPNGTGKVNWKGVAYYNRLIDYMLKRGITPYANLNHYDLPQALQDRYNGWLGREVVKDFADYAEFCFKTFGDRVKNWFSFNEPRVVAALGYDNGFFAPGRCSKPFGNCTEGDSATEPYIVAHNLILCHASAAQRYREKYQEKQKGKFGILLDFVWYEPLTKGKADNYAAQRARDFHLGWFLHPLVYGEYPKTMQNIVGTRLPKFSKEEVKMVKGSFDYVGINQYTSYYMYDPHYTTPQPLGYQQDWNVGFAYDRKGVPIGPRAHSYWLYIVPWGLYKAINYVKEHYGNPTIILAENGMDYAGNITLPKALHDTKRINYYKSYLQQLKKTVDDGANVIGYFAWSLLDNFEWRLGYTSRFGIVYVDFNTLRRYPKMSAYWFKKLLKRQKH

SEQ ID NO: 6167 - protein, 450 aa, Trichoderma viride
MLPKDFQWGFATAAYQIEGAVDQDGRGPSIWDTFCAQPGKIADGSSGVTACDSYNRTAEDIALLKSLGAKSYRFSISWSRIIPEGGRGDAVNQAGIDHYVKFVNDLLDAGITPFITLFHWDLPEGLHQRYGGLLNRTEFPLDFENYARVMFRALPKVRNWITFNEPLCSAIPGYGSGTFAPGRQSTSEPWTVGHNILVAHGRAVKAYRDDFKPASGDGQIGIVLNGDFTYPWDAADPADKEAAERRLEFFTAWFADPIYLGDYPASMRKQLGDRLPTFTPEERALVHGSNDFYGMNHYTSNYIRHRSSPASTTPSATSTCSSPTSRATASAPRRSPPLAPVRPAATSWCGSARGTYPPIYVTENGTSIKGESDLPKEKILEDDFRVKYYNEYIRAMVTAVELDGVNVKGYFAWSLMDNFEWADGYVTRFGVTYVDYENGQKRSPRRAQRA

SEQ ID NO: 6168 - protein, 516 aa, Zea mays
MAAAMVRTMSTTAAGTPPVSVATINPKLVWVALICDRIAGRLKVSISVLKCEYAVRGEIVTHAQNLQQELQKNPESLPFDEILYCNIGNPQSLGQQPVTYFREVLSLCDHPALLDKSETHALYSSDAIERAWQILEKIPGRATGAYSHSQGIKGLRDEIAAGIAARDGFHASGDNIFLTDGASPAVHMMMQLLISSESDGILCPIPQYPLYSASIALHGGSLVPYFLNEETGWGLDVDELKKQLEEARSKGITVRALVVINPGNPTGQVLVEENQKKIVEFCKNEGLVLLADEVYQENIYVEDKPFHSFKKIARSLGYTDDDLPLVSFQSVSKGYYGECGKRGGYMEITGFSPEVREQIYKVASVNLCSNVSGQILASLVMNPPKAGDESFESFMSEKDGILSSLARRAKALEEAFNSLEGITCNKAEGAMYLFPRLHLPQKAIGAAQAVGTAPDAYYAKRLLEATGIVVVPGSGFGQVPGTWHFRCTILPQEDKIPAIVSRLKEFHEKFMDEFRD

SEQ ID NO: 6169 - protein, 254 aa, Oryza sativa
MISPDAARNVVGIIGNVISFGLFLSPVPTFWRICKRKDVEQFKADPYLATLLNCMLWVFYGIPIVHPNSILVVTINGIGLIVEGTYLFIFFLYSPNKKRLRMLAVLGVELVFMLAVILGVLLSAHTHKKRSMIVGILCVFFGSIMYFSPLTIMGKVIKTKSVEYMPFFLSLVCFLNGVCWTAYALIRFDIYVTIPNGLGAIFGAIQLILYACYYRTTPKKTKAAKDVEMPSVISGPGAAATASGGSVVSVTVER

SEQ ID NO: 6170 - protein, 674 aa, Unknown
  Frankia sp. EAN1pec
MPHDHPTASSSSAYPTTFSPIALGPRTARNRIWLAAHATEFSTDGTFADASADYYAERARGGVAVITMEAMAVHPSTRPRRGVILAYEAAVVDSYRKVAAAVHPHGALLMAQLWHRGRQTDGIISRLPTWAPSPVPDTVYREIPHEVTRREIDELVAHYVLSARHAMEGGVDGVEIHGLAHGYLLGQFLSPATNHRTDEYGGSFDGRIRIVRRIVEEVRQVVPADRVLGIRLNSSDGPGQNGLDNADWVRIATETESWGALDYISTTQGTYLDRMQIYGTSAARPAGYEVADTANITRAVSLPVVAVGRITTPEMAEDILASGKAQFVGMARQLIADPLWAVKAEQGRPDDIRPCIGANWCVASFARGPLACIHNPQVGRERQFRQDETRQRRRRRVAVVGGGPAGLRAALTAAELGHQVTLFEQDDTLGGQVNLIAQAPSYREWTGVTDWLTTQLARTDVSIQLKHRVTVNDLVGRYEAVVVATGSTPLRHGWTARRPERWARDAAALPGSDQWNVYTPVEILTGSVELPNRILIVDDTGDRQAFITAEYLRQRRHAVHVVSQYPQLGHAFADGHDLPFAFGQLRRSGVTFTPNVEVNAIDGDTVTLTDVFTGEASQLPDVDGVVLILGNTANDLLARELDGAGLDIHLVGDAQAPRRIFNAIWEADTAARTI

SEQ ID NO: 6171 - protein, 140 aa, Zea mays
MVSFEMNDLKKIGLSLTGFGVFFSFLGIVFFFDKGLIAMGNILFLSGLGLTIGLKSTMQFFTKPKNYKGTISFGAGFFLVLIGWPFFGMLLEAYGFIVLFSGFWPTLAVFLQRIPILGWIFQQPFVTSFLDRYRGKRVPV

SEQ ID NO: 6172 - protein, 921 aa, Yersinia pestis
MTKYSLRARMMILILAPTLLLGLLLSTSFMVNRYNELQNQIVSAGTNIIEPLAVASEYGMSFRNRDTVRQLINLLHRRHSNIVRSISVFDVDNKLFVTSNYNYNSSQLRLPPGEPVPDSLMLSYRGDSLILRMPIVSESNLSSEQASGQGESDQILGYIAIDLDLQSVRLKQYKEIFISTLLLLFCMCVAILFAYRLMRDVTGPIRNMVNTVDRIRRGQLDSRVEGHMLGELDILKNGINSMAMSLAAYHEEMQQNIDQATSDLRETLEQMEIQNVELGLAKKRAQEASRIKSEFLANMSHELRTPLNGVIGFTRQTLKTSLTPTQTDYLQTIQRSANNLLCIINDVLDFSKLEADKLILEHIPFSLRETLDEVIILLAHTAHEKGLELTLHINNDVPDQVLGDAMRLQQIVTNLLGNAIKFTEEGNIDILVVVKAIASQQVTLMVEIHDTGIGISESQQAQLFQAFRQADASTSRRHGGTGLGLVITERLVKEMGGNISFQSQMSCGSIFRFHLTLELNESIPYRQPDMAHLEGKQLAYIERNSTAARATINILNTTPLQVTHRQSLAQLPEQHYDFLLVGVPIPFRNNMAIHQDKLLTALKIADHVILALPSQSQVEAEQLKQIGAKDCLLKPISSIRLIPLLLAEDTHSKVPSEEQPRKQPKLPFRVMAVDDNPANLKLIGTLLEEQIEETVLCDSGAMAITYAREHTLDIILMDIQMPEIDGIRASEIIHQIPHHQETPIIAVTAHAVKGQQEQLLRLGMADYLAKPIDEARLLQVLSRYQSDNPPLSTASTAESLPLPVPKGAGVIDWAQAVRQAANKEDLARDLLTMLLEFMPQITARVQAILAGADDGDILNLVHKFHGSCACSGVPRLRQLCMTIELQLRQQVNLQDLEPEWLELLDEIENVSEAAKTYLRTE

SEQ ID NO: 6173 - protein, 171 aa, Arabidopsis thaliana
MEEKKTESTNKNVKKANLLDHHSIKHILDESVSDIVTSRGYKEDVRLSNLKLILGTIIIVVALVAQFYNKKFPENRDFLIGCIALYPFFSNSIDTFCFLLDSHLVGFQDHSPALVWWYLQSCPDSLISTLSPSTVLIQNQSQLGSQFSSPKVSPNGSRKMEFLLRVYSGKT

SEQ ID NO: 6174 - protein, 709 aa, Magnaporthe grisea
MCGASVIVSLRRKHEETNGAAAAKTSDKESRLAKSLDALAHRGPDARGVWIDPTGEVGLAHTRLAIIDLSAEGNQPLHDDQDHIHAVITGEIYDHDRLRRECVEAGYRFKGHSDSEVVVALYQRYGAPGFLEHCRGEFSMVVYDDRSGEVFACRDRSGIKPLFYTIVQNELWFSSEVKGFLGMGWKPEWALESIAMGVTQVGSSTIFQGVNRIEPGFYMKVTADGDITHSKYWDFDYPDKTVVDNRSMEDMVQELREALVDAVRLRLRADVPVGIYLSGGLDSSMIAGIAKKLIDEEGATAGSQKASERMTTFTLAVNSDQDNSVYNEASIASRTAKFLGVKEKTLNADEQLLASTFEDACWHIEQPISTLSMCAKVALSKLARDSGVTVILTGEGADETFAGYPWMLPDLTAEADHSRPDAPINRDIDNLRGPIRKQLFDMWANLGSTEMPKLLQQVKPETWAKMNFVSTPVVSDGSSGVGLIHPKLRAKYNLDDRISKTQDCIGEDVLKKVREKWHPLNSSLYLNHKTLLANTIIPSNGDRTEMANSVEGRPPILDHKVLELASKLPPSVQVGYFPDGANLNSGKTVFRSNNADGELMARFREKFLLREAARPFVTDEIYSRPKHSFMASSNYHAGGPIHQVLKRLLTKENVEAVGFLDWPKIEAHLASAFDPQLAHVAGQNFAPCLQAASFVTISQKFGVARASVE

SEQ ID NO: 6175 - protein, 536 aa, Thermoplasma acidophilum
MRIRNRLVMSPMISNMADPDGNTNENHISYLEERAKGGAGLIITEYTYVDRRSGIGSRNQMGMYDERQIPKFSRLTERIHAHGAKIFVQLVHAGAKAIGAINEYKIAPSKTNFDPSVREMDASDIEDVISAYRKAANIAERSGFDGIEIHGAHGYLVDEFLSPWWNKRTDRYGGSFENRIRFAQEVIDAVRSEVDIPVGIRISLYEDEEDGYSPDYGMKIAESIRNIDYVHVSAGNNEPPGSSASFYSPHAHIFQKLRGSTGKTLIVAGSITAREDVDLVLSAADFVAVGRAMLADPYFPMKIITGKGEIRPCIRCNQGCRNLAYGEVRCTVNPYFVVPEPRKIYKGEVVVVGAGVKGLEASLYAAKSGLKVVIYEKEDRIGGQINSIFDASKAREFRQLLDYYGRTIKKYGIDVRLGERYSGDGIYCLPDTVYPDLPDKDEIWIDSNVYMYHDLALRYAAEHKVYLSSYSLTSLDRARRKAYANIARKAGVTIVDTADHYDVSIHDRNQYDIYQAMLSGIEAMRSHIAASENEYL

SEQ ID NO: 6176 - protein, 122 aa, Aspergillus parasiticus
MSEQPYDPYIPSGSTTNAPAGASAAQNGDPRTREIDKKIQETVDTMRSNIFKVSERGERLDSLQDKTDNLAVSAQGFRRGANRVRKQMWWKDMKMRVCLVICVILLLVVIIVLPLSLLSIKH

SEQ ID NO: 6177 - protein, 578 aa, Nicotiana tabacum
MGNTCVGPSISKNGIFQSVSAAMWRSRSPDDTASTTNGESARIETPISVKEPDSPLPVQEPPEQMTMPKSEKKEEEKEQPKKPKKPAEMKRVSSAGLRTDSVLQKKTGNLKEFFSIGKKLGQGQFGTTFKCVEKATGKEYACKSIAKRKLLTDDDVEDVRREVQIMHHLAGHPHVISIKGAYEDAVAVHVVMEFCAGGELFDRIIQRGHYTERKAAELTRTIVGVVEACHSLGVMHRDLKPENFLFVDQKEDSLLKAIDFGLSIFFKPGDRFTDVVGSPYYVAPEVLRKRYGPEADVWSAGVIIYILLSGVPPFWAENEQGIFEQVLHGDLDFTSDPWPSISEDAKDLMRRMLVRDPRRRLTAHEVLCHPWVQVDGVAPDKPLDSAVLSRMKQFSAMNKLKKMALRVIAESLSEEEIAGLKEMFKMIDTDNSGQITFEELKDGLKRFGSNLKESEIYDLMQAADVDNSGTIDYGEFIAATLHMNKIERQDHLFAAFCYFDKDGSGYITADELQQACEEFGIGDVRMEEMIREADQDNDGRIDYNEFVAMMQKGNPVLGGGKKGLEHSFSIGFREAVKL

SEQ ID NO: 6178 - protein, 341 aa, Triticum aestivum
  misc_feature (146)..(146): Xaa can be any naturally occurring amino acid
MKFGSIYEEYLRAEQDKYLAKCSHVEYKRLKKVLKRCRLDRSLQADGTNGEQQEDRSDDSSDACDCNSCTLCDQMFFTELTKETSDIAGYFSSRVQHLLNLHVPSGLQRYIWRVRQCFIDDQQIMVQEGRLLVNYVTMNAIAIRKXILKKYDKVHGSVSGRDFRSKMQSEHTELLQSPWLIELGAFHLNCDSSDIDEPVGFFKNGFFKNFSCDLTGTQPVMTMAISETIKYDYSLTCPICLDTLFNPYALSCGHLFCKGCACGAASVYIFQGVRSAPPEAKCPVCREVGVFAHAVHMNELDLLIKTRCKDYWRCRLREERTEMVKQSKEYWESQAMLSMGI

SEQ ID NO: 6179 - protein, 284 aa, Corynebacterium efficiens
MSPTPSPTLSLSDGSEIPQIGLGTWQMHGEEAYRTVREAIGMGYRHIDTAKLYDNEVEVGRAVTDAIRSGEVTRDELFITSKVWNDDQGREQAARAFQASLARLGLDYLDLYLVHWPCPRKGLYNETFEAVARIQGLGQVQSIGVANFYAGVLEDLVVTTGIVPAVNQVELHPGFSQAPLRALHDRLGVVTTAWAPLARGGVLSHPVIKGIAGRYGVPASAVVLRWLVQLGVVAIPKSSDPGRLRSNLDVHGFQLSVEEVERITALDEGPGMGRLFHDPEEFPA

SEQ ID NO: 6180 - protein, 581 aa, Nicotiana benthamiana
MGNTCVGPSISKIGLFQSVSAAMWRTRMPDDSGSTTNGDSARGETAESSKDPNLVVPSKPPEQITMPKSDQKEEEPAKKEEGPEKPKKPVQMKRVGSAGLRTDSVLQKKTGNLKEFFSIGKKLGQGQFGTTFKCVEKATGKEYACKSIAKRKLLTDDDVEDVRREIQIMHHLAGHPNVISIKGAYEDAVAVHVVMEYCAGGELFDRIIQRGHYTERKAAELTRTIVGVLEACHSLGVMHRDLKPENFLFVNQKEDSLLKTIDFGLSIFFKPGDRFNDVVGSPYYVAPEVLKKRYGPEADVWSAGVIVYILLSGVPPLWAENEQGIFEEVLHGDLDFSSDPWPSISEDAKDLVRRMLVRDPKKRLTAHEVLCHRWVQVDGVAPDKPLDSAVPSRMEQFSAMNKLKKMALRVIAESLSEEEIAGLKEMFRMIDTDNSGQITFEELKVGLKRVGANLKESEIYDLMQAADVDNSGTIDYGEFIAATLHFNKIEREDHLFAAFSYFDKDCSGYITADELQQACEEFGIGDVHLEDMIRDADQDNDGRIDYNEFVAMMQKGNPVIGGGKKGLEHSFSTGFREALRL

SEQ ID NO: 6181 - protein, 366 aa, Propionibacterium acnes
MTSPLLFQPLTLRGLTVRNRAWLPPMCQYAVDSQDGIPSTWHLIHYGSFAVGGFGLIVAEATAVSPEGRISPCDTGLWNDAQVAAWRTITDAVHELGGTIAVQLGHAGRKASTEKWWPGFHGGVIPPEKGGWIPVGPTAAPADGKQYAGSPVTALNEDGISKIIDDFRTAASRAVVAGFDAVEIHSAHGYLLHQFYSPLSNTRTDGWGSDYDGRVRLPLAVADAVRGAIPDDMPLLARLSVTDWRDDGWSVEDSIELSRRFALAGVDLVDASSGGNSSAPIPVAPGYQADLAARVRAEADVPTATVGMIWTGELAEDLLNKGCADAVMVGRAALRDTNWPLRAAHELGVPNEEAPWHPARFRGAWR

SEQ ID NO: 6182 - protein, 542 aa, Kineococcus radiotolerans
MSKIIAFDEEARRGLERGMNQLADAVKVTLGPKGRNVVLEKKWGAPTITNDGVSIAKEIELEDPYEKIGAELVKEVAKKTDDVAGDGTTTATVLAQALVREGLRNVAAGANPMGLKRGIEKAVEAVTEQLLGAAKEVTTKEQIAATAGISAGDASIGELIAEALDKVGKEGVITVEESNTFGLELELTEGMRFDKGYISPYFVTDAERQETELEDPYILILNSKISTVKDLLPLLEKVMQSGKPLVIVAEDVEGEALATLVVNKIRGTFKSVAVKAPGFGDRRKAMLGDIAILTGGQVISEEVGLKLDTADLDLLGRARKVVVTKDETTIVEGAGDADAIAGRVGQIRAEIERSDSDYDREKLQERLAKLAGGVAVIKAGAATEVELKERKHRIEDAVRNAKAAVEEGIVAGGGVALIQAGVLAFEKLELVGDEATGANIVKVAIEAPLKQIAINAGLEGGVVAEKVRNLPTGHGLNAATGEYVDLLGAGINDPVKVTRSALQNAASIAALFLTTEAVIADKPEKAAAAPAGGDGGMGGMDF

SEQ ID NO: 6183 - protein, 371 aa, Brassica oleracea
QMGQAENQVSFDLLESYLEKKNPEGSLWESKGSRGFRENALFQDYHGLKNFRQAMASFMEKNRGGKARFDPDRIVLTAGATAANELLTFILANPNDALLVPTPYYPGFDRDLRWRTGVRIVPIHCDSSNHFQITPEALEAAYKTARDANIRVRGVLITNPSNPLGATVQKKVLEDLLDFCVRKNIHLVSDEIYSGSVFHASEFTSVAEIVENIDDVSVKERVHIVYSLSKDLGLPGFRVGTIYSYNDNVVRTARRMSSFTLVSSQTQHMLASMLSDEEFTDKYIRINRERLRRRYETIVEGLKKEGIECLKGNAGLFCWMNLGFLLNTNTKEGELELWDVILKELELNISPGSSCHCSEFGWFRVCFANMD

SEQ ID NO: 6184 - protein, 369 aa, Brassica oleracea
QMGLAENQLCLDLIKEWIKENPKASVCTPEGVHQFSDIANFQDYHGLKEFRQAIAHFMGKARGGRVTFDPERIVMSGGATGANETIMFCLADPGDVFLVPSPYYAAFDRDLRWRTGVEIVPVHCSSSNNFKLTVEAVEWAYKKAVESNKNVKGLLFTNPSNPLGTILDKDTLKNLVRFVTKKNIHLVVDEIYAATVFAGENLVSVAEVVKDSEVNADLIHIVYSLSKDMGLPGFRVGIVYSYNDSVVSCARKMSSFGLVSSQTQFMLASMLSDDSFVGNFLMESSKRLGIRHGVFTLGLKKAGINCLISTAGLFVWMDLRHLLRVRNSFESEIELWHIIIDKVKLNVSPGSSFQCTEPGWFRVCFANMD

SEQ ID NO: 6185 - protein, 344 aa, Unknown
  Mesorhizobium sp. BNC1
MPVPSSMPSAPNSKHGGTSAQAPTFRPAPDHESRRTMKTYKLVNRDVSAPGRDSAADADGSGVEMPMIGLGVFQTPPDETTAAVEEALRLGYRHIDTAAAYGNEREVGEGIRRAGIARDEVFIETKIWISDYGYDETLHAFDKSAGKLGVDQIDLLLLHQPLPSAFDRTLGAYRALEKLLADGKVRAIGVSNFMPEHLTRLLTETSIVPAVNQIEVHPYFQQRALQRLHAEHGILTQAWSPIGGITFYRGGEKSTLEDPVLLEIAQQHGKSAAQVMLRWHLQEGRSVIPKSTKPARIAENFDVFDFELSGEQIAAIDALDTGVRSGPEPDSITLESYGRPIPEA

SEQ ID NO: 6186 - protein, 482 aa, Zea mays
MAASVTVENLNPKVLKCEYAVRGEIVIHAQRLQQQLQTQPGSLPFDEILYCNIGNPQSLGQQPVTFFREVLALCDHPCLLEKEETKSLFSADAISRAKQILATIPGRATGAYSHSQGIKGLRDAIAAGIMSRDGFPANADDIFITDGASPGVHMMMQLLIRNEKDGILCPIPQYPLYSASIALHGGALVPYYLNEKTGWGLEISDLKTQLENARSKGIDVRALVVINPGNPTGQVLAEDNQYDIVKFCKNEGLVLLADEVYQENIYVDNKKFNSFKKIVRSMGYGEDDLPLVSLQSVSKGYYGECGKRGGYMEITGFSAPVREQIYKIASVNLCSNITGQILASLVMNPPKAGDESYASYKAEKDGILESLARRAKALEDAFNKLEGFSCNKAEGAMYLFPQIHLPQKAIEAAKAAKKAPDAFYALRLLESTGIVVVPGSGFGQVPGTWHIRCTILPQEDKIPAVISRFRAFHEAFLAEYRD

SEQ ID NO: 6187 - protein, 635 aa, Dechloromonas aromatica
MCGITGIFDTRSKRDIDRAVLHRMNESQIHRGPDEGGTHVEPGVGLGHRRLSIIDLSTGQQPLYNEDNSVCVVFNGEIYNYQELIPELQALGHVFHTRSDTEVIVHAWEAWGESCVDRFRGMFAFALWDRNRETLFLARDRLGVKPLFYALLDDGTFLFGSELKSLLAHGGLKRDIDPCAVEEYFALGYVAEPRSIFKQALKLPPASTLLVRRGQPVGTPREYWDVRFTLDNPISDADAQAELTHRLEESIKLRMISEVPLGAFLSGGVDSSAVVALMAGLSQKPVNTCSIGFSDPAFNESEFAKMVADRYQTNHHLDIVESDDFDLIDTLARLYDEPYADSSAIPTYRVCQLARKHVTVALSGDGGDESFGGYRRYRLHMMEEKMRSALPLGLRRPLFGALGKLYPKADWAPRVFRAKTTFEGMARNSVEAYFHSVSILRAPMRDRLFSTQFKSALSGYDALKVFTDHAAKADTTDPLALIQYLDLKTYLIGDINTKVDRASMAHSLEVREPLMDHKLVEWLATLPSTLKIRGQEGKYLLKKSMEPHLPNDVLYRPKMGFSVPLARWFRGPLKTRVQESILGSRLADTGWFNRDYLQKLVTDHNNGSRDYSASIWTILMFEAFLRNVMEQGEAA

SEQ ID NO: 6188 - protein, 716 aa, Glycine max
ITGIPPPGTGQKIYEIDPSLLAHRDHLDFRYGQYKRLCYEIDKHEGGLDTFSRGYEKFGFIRSATGITYREWAPGAKSAALIGDFNNWNPNADVMTRNEFGVWEIFLPNNVDGSPPIPHGSRVKIRMDTPSGIKDSIPAWIKFSVQAPGEIPYSGIYYDPPEEEKYVFKHPQPKRPKSLRIYESHIGMSSPEPKINTYVNFRDDVLPRIKRLGYNAVQIMAIQEHSYYASFGYHVTNFFAPSSRFGTPEELKSLIDRAHELGLLVLMDIVHSHASNNTLDGLNMFDGTDGHYFHPGSRGYHWMWDSRLFNYGSWEVLRYLLSNARWWLDEYKFDGFRFDGVTSMMYTHHGLEVAFTGNYNEYFGFATDVDAVVYLMLTNDVIHGLFPEAVTIGEDVSGMPTFCLPTQDGGIGFDYRLHMAIADKWIEILKKNDEDWKMGDIVHTLTNRRWLEKCVAYAESHDQALVGDKTIAFWLMDKDMYDFMALDRPSTPIIDRGIALHKMIRLITMGLGGEGYLNFMGNEFGHPEWIDFPRGDQHLPTGVIVPGNNNSFDKCRRRFDLGDADYLRYRGMQEFDQAMQHLEEKFGFMTAEHQYISRKNEGDKIIVFERGNLIFVFNFHWNNSYSDYRVGCSTPGKYKIVLDSDDALFGGFSRLNHTAEYFTSEGWYDDRPRSFLIYAPSRTAVVYALADDVEPTLADEAEPALADEAEPEPVDP

SEQ ID NO: 6189 - protein, 349 aa, Pseudomonas syringae
MTTIFDPITIGDLQLPNRIIMAPLTRCRADEGRVPNALMSEYYVQRASAGLILTEATSVTPMGVGYPDTPGIWSNDQVRGWSNITKAVHTAGGRIVLQLWHVGRISHPAYLNGETPVAPSAIAAEGHVSLMRPITPLPTPRALELAEIGDIVEAYRVGAENAKAAGFDGVEVHGANGYLLEQFLLTGSNQRTDEYGGSVENRARLLLEVTDAVIEVWGAGRVGVHLSPRFDMHDMSDANRTETFSYVAKELGKRGIAFICARERDAEDSLGPQLKKDFGGVYIANEKFTKDTANTWLAEGKADAIAFGVPYIANPDLPERLASDAPLNEAHPETFYGKGPVGYIDYPRL

SEQ ID NO: 6190 - protein, 356 aa, Yarrowia lipolytica
MSKPKPSEVRTLAFNVSDHYQILDMVGEGAYGIVCSALHTPSGQKVAIKKITPFGRSMFCLRTLREIKLLRHFSHENIIGILDVQKPASFESFNEVYLIQELMDTDLHRVIRTQELSDDHCQYFVYQTLRAIKALHSANVLHRDLKPSNLLLNASCDLKICDFGLARSAASTEDNFGFMTEYVATRWYRAPEIMLTFKEYTKAIDMWSIGCILAEMLGGRPLFPGRDYHSQLTMILDVLGTPTMEDYYSVKSRRAREYIRSLPFKKKLPFSQLFPKANPLAIDLLEKLLTFNPAKRITVEEALVHPYLEQYHDADDEPTAEPIPDEFFDFDRNKDELSVEQLKTLIYNEIMYWKRP

SEQ ID NO: 6191 - protein, 207 aa, Mycobacterium avium
MAGIDKIVTHGTFELDGGSWEVDNNIWIVGDDSDVVVFDAAHTAEPIVAAVGNRNVVAVVCTHGHNDHVTVAPELGAALDAPVLLHPGDDVLWRMTHPDKDFRTIADGDTIDVAGTELLALHTPGHSPGSVCWYAPELGVVFSGDTLFSGGPGATGRSYSDFPTILQSISGRLGTLPGETVVHTGHGDSTTIGDEIVHYEEWVARGH

SEQ ID NO: 6192 - protein, 135 aa, Zea mays
MRKHRIVSLVAALLVLLALAAVSSTRSAQKESVADNAGMLAGGIKDVPANENDLQLQELARFAVNEHNQKANALLGFEKLVKAKTQVVAGTMYYLTIEVKDGVVKKLYEAKVWEKPWENFKQLQEFKPVEEGASA

SEQ ID NO: 6193 - protein, 162 aa, Glycine max
  misc_feature (101)..(101): Xaa can be any naturally occurring amino acid
  misc_feature (113)..(113): Xaa can be any naturally occurring amino acid
  misc_feature (115)..(115): Xaa can be any naturally occurring amino acid
  misc_feature (140)..(140): Xaa can be any naturally occurring amino acid
MVRSKTAYQTDVSDHSTFAYRYDRTYLARDKIAEESILEEAAYQIIHDQLMLDGNSRLNLAAFETTWMEPERDKVIVADIDKNDDHMDEDPVSTELQNRSXNMIPHLFNAPLXRXHTAIGGGTVGSSEAIMWDGLAFHRXWRNRKTLDGKPYDIPNIVTGAN

SEQ ID NO: 6194 - protein, 209 aa, Bacillus clausii
MYTQIPLGPLQTNAYVLYNEKKEAVLFDPGGDGAAFVNWIREQKLTPQAILLTHAHFDHIGALEEVRQAFACPVYLHEAEKQWLLDPLKNGSARMGRQPIKTKPADHLLKDEGTLKVGSFSFKLFHTPGHSPGSVSYYVADENIVFSGDALFQQGIGRTDLFGGNHELLVQSIHNKLLTLPEETIVASGHGPLTTIGQEMDHNPFLNGY

SEQ ID NO: 6195 - protein, 455 aa, Yarrowia lipolytica
MHIKISTDFAIQNLHCTTMIRPLLRLCGQRTAATPFVSFFRPPKKPLSGISFARHYSPTKKPPSEVPTPTPGNYLVPITGPPGDTPRDTDLLIKSLTHKSLLPENNLVRCTVFDSDGNVTVASGEFKRTELLNKHGLLPRDLRKLDTGVNSIVPTILVRDNSILINLLHIRALIKADKVLLFDVFGSTDSKTQSLFMYDLGHKLKKSNKTMGSLPYEMRALEAIFISVIAALDAEMKVHTTVINGILSELEQDIDREKLRHLLIQSKKLSAFLQKATLIRDVIDELLDTDEDLAGLYLTEKKAGHPRAIDDHSEVEMLLETYYKHCDEIVQTVGNLVSNIRNTEEIVNIILDANRNALMHLDLKFQIGALGLAGGTFIASLYGMNLKNFIEESYWGFLGVTGVASLLTVWIIAHFLKSLRQVQRVTMTSDKKKAMKKKDTVAEKRRNHLRNWLTK

SEQ ID NO: 6196 - protein, 147 aa, Myxococcus xanthus
MQTRNPFNSAVVVNPLMRDVDALFRELTQPMWRQAPRERTPAADITESESGLTLHLDMPGLEAKAIQVTVEKDILTVQSERKAEPRAEGVNVRRQERAFGTFARSFALPDTVDASRVEARYEQGVLTLTLPRREESKPRVIEVKVQG

SEQ ID NO: 6197 - protein, 1267 aa, Kluyveromyces lactis
MSCAVQAAVVAMKDNSSHGQVPYRANNEHLNRVVQSVTDATKRLSQISTASSNANVNNTKTSKRRNRDTVGPWKLGKTLGKGSSGRVRLAKNMETGKLSAIKIVPKKFVKSNQIKQLPYGIEREIIIMKLISHPNVMGLYEVWENKSELYLVLEYVEGGELFDYLVSKGKLPESEAIHYFKQIVQAVAYCHGFNICHRDLKPENLLLDKKKRSIKIADFGMAALETSDKLLETSCGSPHYASPEIVLGRKYHGSPSDVWSCGIILFALLTGHLPFNDDNVKKLLLKVQSGKYQMPQWLSVEAKDLISRILVVDPNRRITIDQILQHELLTKYDQKSRSKSNSDLNLLNRTPNIVSFSSERDIDETILSNLQILWHGAARKHLVTRLMKPGFTEEKMFYSLLWNYQEKQQKSMQKDLIPVPTLKTSSASSVSPLNISSDVNSVTNTAKKQQQSSNGTVLPASMAPTISAFGQQISSDSSESSTLQAPKIHQKSHFSISSLKNGSSKSPKKTKQGFIASSSSSKLFQPNFGAKSSSQSISKSSSKKSLTPTTPKKRTLQNSASKRSLYSLQSISKRSINLNELLHDELQHEYPPPPLPSISSSEHTSSKLESIVDDYDRSTSVHGATMDNFLGESGQHMKAQQNEKLTQPSKNILAQPKLNNQPQTENRQSVTSMKRKTADNTIATVPVSMTPLKDMTNTFQSKSMYVSSLDPKRNKPKPSLENLLRKVSVPQRIKSRSTIRKLRDSGDWTVSGEAQALFGGKGSSEGENQLQRQKTNPSKLTAPETVLTTSTPMTDIKPDLLRMPSSLINSSMTFKDLSQFIMNIDEDKVPVTQASNPVNTDHEKLSENQTLMIENDSNRFETSSNYDDYNVNTAPAVTTAGDIDIFEDAPDDANESVTTSESMIDQSQLNLKKKAASIDSIDTSHVLTPATDVRVSLYINQMDKLDNLPRETTEQIISKFKLSPIKDIKQKRFSNGDRDLTITGSMISMFKDLDGDESRAEYDDNGLGLLGSALDTRPVENETNEDTNGTTVKRNSTVLVSSINGDNLDLSTEEQKNDDGNHGQGQTRRVTLLFDDGSSESEQVFKPVAAERRQPTLNANSTTTNNVGSKRKSNYINKLPKIKEDEVKPITSMKSSSPVNWFSKLLQRIKTSKPKRTVYEYRTSSIPFDNIHILLMTQFGKNGVDCELKKMERKGDKEYVTYDCNFGGIKRNRPKSKFTVEMRCMNGTETVLSLETRSKRFVNDKDTMASFERFNKDVAGAISAQEE

SEQ ID NO: 6198 - protein, 181 aa, Zea mays
MVVTVAATGSDTAEPLHSTTFASRYVRDQLPRYRMPEGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVEL

SEQ ID NO: 6199 - protein, 349 aa, Symbiobacterium thermophilum
MAHLFDPFTQKSVTLRNRIVMSPMCMYVAGADGVATDWHLVHYGTRAVGGAGLIITEATAVEPRGRISEGDLGLWNDQQAEALARIARFVHDQGVAFAIQLAHAGRKAWTPCKGQGPEPAVAPSALPFDTDWVTPQALDAEGIDRVVAAFGAAARRAGELGCDLVEIHAAHGYLLHEFLSPLTNRRTDEYGGPLVNRARLLRRVFEAVREAFPADRPVWVRISATDWVEGGWDIAESVELARMMKAWGVDLVDVSTGGNSPLQRIPSIGPGYQVAFAERIRREAGIATGAVGLITTPEQADSVVRTGQADVALLGRELLRNPYFPLAAAHRLGHEVTWPEPYVRGKFRR

SEQ ID NO: 6200 - protein, 273 aa, Propionibacterium acnes
MSVPSITLNDGVAIPQLGFGTWKVPANEAEKAVSAALEAGFRHIDTAAIYGNEEGVGRALADSGLDRKDLFVTTKLWNSSHHADDARKAIETSLTKLGLDHVDLYLIHWPAPVKYGDAYIEAWNALQDFKSEGLTRSIGVSNFKTEHLDAIEGATPSVDQIEMHPSFNQATFRAELAERGINPEAWSPLGQSKDLDNPVLTDISKATGKTPAQVVIRWHLQIGNVVFPKSVTPSRIAENFDVFDFELSDEQIAAIDGLDHGNRLGGDPSTADF

SEQ ID NO: 6201 - protein, 779 aa, Unknown
  Frankia sp. CcI3
MLRDSARFSRNGCLLAGSSLVPRWFLAGSRWRRGRPRRRRDAVRKRGLLVSSRVGPGTPGQHQVVSEVTIMTDPGTSRLPRDDAKQQQLDAVRIGDDGARMTTDQGIGVEHTDDSLAAGERGPTLLEDFHFREKLTRFDHERIPERVVHARGAGAYGYFEAYESLADVTRAHFLGEDGRRTPVFVRFSTVGGSRGSADTVRDVRGFAVKFYTEEGNFDLVGNNMPVFFIQDGIKFPDFVHAVKPEPHNEIPQASSAHNTLWDFVSLVPESMHMMMWLMSDRALPRSYRMMQGFGVHTFRFVDAAGQGTFVKFHWRPKLGTHSLVWDETQKIAGKDPDFNRRDLWESIENGTFPEWELGVQLVPESDEHAFDFDLLDATKIIPEERVPVRPVGRLVLNRNPGNFFAETEQVAFCVQNVVPGIDFTNDPLLQARLFSYLDTQLIRLGGPNFAQLPVNRPVAAVHNNSRDGYGQHRIQQSQTSYFPNSISGGCPVLSDPAHGGYVHYAERVDGNTIRKRSESFKDFYSQATLFWNSMSSWERRHIVDAFSFELGKVDYTQIKERVLGHLAQVDHELAAGVAENLGLPVPPESTPNHGRSSPALSQADQPSGVATRRIAVLAADGVDEVALRSATAALREQGAILEVLAPHGGMLATVSGDALPVDRTLVTMSSVLYDAVFVAPGERGVTALTHNGEAVHYVGEAYKHAKPIGAVGAGVSLLEIASLPGARVADQGDAVVSDRGIVTVRDLAGPSVLGDFGSAFATAVAAHRHFDRALEAVAA

SEQ ID NO: 6202 - protein, 813 aa, Escherichia coli
SSMQLGSNVPFPRQLTVTRDGDIMILRTPIISESYSPDESPSSDAKNSQNMLGYIALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELTPTQRDHLNTIERSANNLLAIINDVLDFSKLEAGKLILESIPFPLRSTLDEVVTLLAHSSHDKGLELTLNIKSDVPDNVIGDPLRLQQIITNLVGNAIKFTENGNIDILVEKRALSNTKVQIEVQIRDTGIGIPERDQSRLFQAFRQADASISRRHGGTGLGLVITQKLVNEMGGDISFHSQPNRGSTFWFHINLDLNPNIIIEGPSTQCLAGKRLAYVEPNSAAAQCTLDILSETPLEVVYSPTFSALPPAHYDMMLLGIAVTFREPLTMQHERLAKAVSMTDFLMLALPCHAQVNAEKLKQDGIGACLLKPLTPTRLLPALTEFCHHKQNTLLPVTDESKLAMTVMAVDDNPANLKLIGALLEDMVQHVELCDSGHQAVERAKQMPFDLILMDIQMPDMDGIRACELIHQLPHQQQTPVIAVTAHAMAGQKEKLLGAGMSDYLAKPIEEERLHNLLLRYKPGSGISSRVVTPEVNEIVVNPNATLDWQLALRQAAGKTDLARDMLQMLLDFLPEVRNKVEEQLVGENPEGLVDLIHKLHGSCGYSGVPRMKNLCQLIEQQLRSGTKEEDLEPELLELLDEMDNVAREASKILG

SEQ ID NO: 6203 - protein, 264 aa, Brassica napus
RFLWLCWSSGDIHGQYQDLLRLFEYGGYPPSANFLFLGDYVDRGKQSLETICLLLAYKIRYPSKIYLLRGNHEDAKINRIYGFYDECKRRFNVRLWKIFTDCFNCLPVAALIDDKILCMHGGLSPELDNLNQIREIQRPTEIPDSGLLCDLLWSDPDQKIEGWADSDRGISCTFGADKVAEFLDKNDLDLICRGHQVVEDGYEFFAKRRLVTIFSAPNYGGEFDNAGALLSVDESLVCSFEIMKPALASSSGHPLKKVPKMGKS

SEQ ID NO: 6204 - protein, 218 aa, Glycine max
  misc_feature (32)..(32): Xaa can be any naturally occurring amino acid
MVQTRKFRGVRQRHWGSWVSEIRHPFLKRRVXLGTFETAEEAARAYDQAAILMSGRNAKTNFPILQTPEGDPKTTLTPIDHETSSSSTTTSKELEEILHAKLRKCGKLPSPSMTCLRLDPENSHIGVWQKRAGQRSDSNWVMMVPPLGKKGGANEGGTGGDASCSNSFPFSECDPTPQVARQELLRTEMDEEERIALQMIEELLSRNCPTSPSFNNLY

SEQ ID NO: 6205 - protein, 149 aa, Arabidopsis thaliana
  misc_feature (109)..(109): Xaa can be any naturally occurring amino acid
GPPALKAGKEGAEYLGTGPPKFHFSGQDGIDAKKDGIYPVGTLDGAPFKASPPVFLMSRKIKSLGGKRVLSGEGAAEIFGGALFFHKAPTKKKFPQKTWRRGFISPPKXRHHQFFLLTLIRRAGDNLQIKALPKYDCLKANKSTSAFGL

SEQ ID NO: 6206 - protein, 644 aa, Solibacter usitatus
MCGIAGFVTVQPSDSPSIIERMTDTIRHRGPDDFGFYRDPWASLGFRRLAIIDVSGGHQPMPNEDQSKFIIFNGEIFNHASLRPALEQAGHRYSNRSDTETILHSYEQYGADCVLRLRGMFAFAIWDKNTRKLFCARDRLGKKPLYYFWDGRTFAFASEIKALFEHPSISPQFEESLLPEYLAFGYVSEDRTLFRGIRKLMPGHHLTLHLGAPNPQPVIRQYWEIPDPQPEQRDDASWISECRDRMEQTVQMRLMSDVPLGMFLSGGVDSSAIAALMKRNFSGPVKTFAVGYQEAEFSELSYARHVAGAIGTDHHEVVVGMEDFFNALPRLIWHEDEPITWPSSVSLYFVSKLAREHVTVVLTGEGSDEMFGGYARYRFYAMNERWMRFYRILPRAVRTAIRSQVATTSLLSSTLRRKLQHTFVGRAEDLESLYLDNFYSAFSQSQQRDLFPALAATSPYANFRRYWDSKPGLNPLPRMLFADQKTYLIELLMKQDQMSMATSIESRVPFLDHEFVEFSTRVPEHMKLRNGEGKYIVKKAIEGLVPHEIIYRKKMGFPTPLRQWLLDPRAAHLFDMMRAKDGLLASCIDPARLDDLLLRQTSGREDVTDRIWRLLTLQLWGDMFFTGKREERWDGLMAAARPAV

SEQ ID NO: 6207 - protein, 480 aa, Streptococcus pyogenes
MLAFPKEFWWGGATSGPQSEGRFAKQHRNLFDYWYEEEPDLFYDYVGPDTASDAYHQIESDLALLASLGHNSYRTSIQWTRLIDDFEQATINPDGLAYYNRVINACLANGIRPVINLHHFDLPIALYQAYGGWESKHVVDIFVAFSKVCFEQFGDRVKDWFVHNEPMVVVEGSYLMQFHYPAIVDGKKAVQVAYNLALATAKVIQAYRRGPAELSNGRIGTILNLTPAYPASQSEADMAAAHFTELWNNDLFMEAAVHGKFPEELVAVLKKDGVLWQSTPEELALIAENRVDYLGLNFYHPKRVKAPDVIPVISPSWSPEWYYDPYLMPGRRMNVDKGWEIYPEAVYDIAIKMRDHYDNIPWFLSENGVGISGEDRYRDETGQIQDDYRIQFLKEHLTYLHKGIEAGSNCFGYHVWTPIDGWSWLNAYKNRYGLVENNIHTQVRRPKASAYWFKKVATHNCLISLEVMEEFGGSASHLSD

SEQ ID NO: 6208 - protein, 392 aa, Candida albicans
MTISNSNLFKPINIGKKTISHRIAHLPTTRNRATKDHVPTDLMQKYYTDRAKTGGLLVTEATLISLNQGIYPNVPGIWNNQQRDAWKKITDSVHSVGGFISVQLWALGRVGNAKLLKNHGLPLTGVSPIYEHEQAEKDAVKAENPIQELTQDEIKDIIYNQFANAAKLADEAGFDFIELHGANGYLFEQFIHPGTNKRTDKYGGSIENRARFLFEVVDHLSTIVDPSKLAIRLSPLNNFQVPGINPTAKEDYSYIIAGLQKRADEGKGFGYINVVEGRFSPDGSTEACDVNFVGDIWKGALLKGGNYTYDKKNSWETIERDANADNRTLVGFGRYFIANPDLPTRIEKDLPLNDYDRSTFYANDDYGYNTYPFYGQEIKADPEHKVFGVALA

SEQ ID NO: 6209 - protein, 220 aa, Brassica napus
  misc_feature (56)..(56): Xaa can be any naturally occurring amino acid
MGSEGRTPVTINITGFKKFHGVAENPTEKRAYNLKEYLAKYPQSKDVVLGSCTVLXTADQGALPSLYQLLQSTINRKKSESVTCGKTIWVHFGVNSGATKFAIEQQAVNEATYRCPDELGWKPQHLPIVPSDGPISTVRKTTLPVEEITKALEKKGFEVITSDDAGRFVCNYVYYHSLRFAEQNKTYSLFVHVPLFVAVDEETQMRFPASLLEVLTSVCK

SEQ ID NO: 6210 - protein, 443 aa, Glycine max
  misc_feature (66)..(66): Xaa can be any naturally occurring amino acid
MREAQNDIVATEFATTTNDEEVPSGVVLFGKYELRRLLGVGAFAKVYHATSVDDTHQSVALKAVSXNKVLNGGFAANVEREISIMRRLHHPNIINLFEVLATKTKIYFVMEFAAGGELFHEVAGKGRLTEETARFYFRQLISAVKHCHSRGVFHRDLKLDNLLLDEDGNLKVSDFGLSAVTGQIRPDGLLHTVCGTPTYVAPEILAKRGYDGAKVDLWSCGVVLFALIAGYLPFNDYNPSVLYRKIYRGQFRFPRWISHDLRFLLSRLLDTNPKTRITVDEIYKDTWFNADGEYRFNRVLVKESECEKQLGRTGFKSLNAFDLISFSTGLDMSGLFEDPTGSNSVERVVSTVVPEKIMERVEAMTEEGRVVVRREKNGGGAKLEGQDGNLIGIVVVYQLTDELVVVEMKRSEKGGGFGGQFWKDKLRPLLLELASELEEPVSR

SEQ ID NO: 6211 - protein, 140 aa, Brassica napus
LNESTGWGLEISDVKKQLEDARSRGIDVRALVVINPGNPTGQVLAEENQYDIVKFCKNEGLVLLADEVYQENIYADNKKFHSFKKIVRSLGYGEEDLPLVSYQSVSKGYYGECGKRGGYMEITGFSAPVREQIYKIASVN

SEQ ID NO: 6212 - protein, 474 aa, Brassica napus
  misc_feature (450)..(450): Xaa can be any naturally occurring amino acid
  misc_feature (466)..(466): Xaa can be any naturally occurring amino acid
MAAAVSTVGAINRAPLSLNGSGAGAASVPATTFLGKKVVTASRFAQNNKKSNGSFKVVAVKEDKQTDGDRWRGLAYDMSDDQQDITRGKGMVDSVFQAPMGTGTHNAVLSSYEYLSQGLKQYNLDNMMDGLYIAPAFMDKLVVHITKNFLTLPNIKVPLILGVWGGKGQGKSFQCELVMAKMGINPIMMSAGELESGNAGEPAKLIRQRYREAADLIKKGKMCCLFINDLDAGAGRMGGTTQYTVNNQMVNATLMNIADNPTNVQLPGMYNKEDNARVPIIVTGNDFSTLYAPLIRDGRMEKFYWAPTREDRIGVCKGIFRTDKIKDEDIVTLVDQFPGQSIDFFGALRARVYDDEVRKFVEGLGVEKISKRLVNSREGPPVFEQPEMTLEKLMEYGNMLVMEQENVKRVQLADQYLNEAALGDANADAIGRGTFFGQTTVNLPVPEGCXTDPAAKNFDPTARSDXDGTCVFNF

SEQ ID NO: 6213 - protein, 942 aa, Pseudomonas aeruginosa
MVRLRIAIGLLVSFLLLLLGPMSPAVADDAGVSSVPLQTTATTPSANQNWRLLRDESAQLRIADVLQRKEQFRPLAKRSFIFPASPQAVWLQVQLPAQKVPSWLWIFAPRVQYLDYYLVQDGQLVRDQHTGESRPFQERPLPSRSYLFSLPVDGKPMTLYVRMTSNHPLMAWFDQIDEAGLVGLEKPAYAFGMLLGGMLLLLMYNLIRFAYSRSASSLWLAAVHAALAVCAAANLGLVAFWLPGLKFNQSLTADLGALGAAVSLLWFACSFFRGTAESRLNRLLQGEALLILAVGAIIAFTQQLWFSWLIYLLVILSSLSVPLIAAWHWYRGYQPARLIVAGMIVFNAGFMVFLPVLFGTKQLDPGWLVLGVFSFATLAGLVLSVSLTERQRLIQQLNLQQRTSEAAHTAELQTKAEFLAKISHEIRTPMNGVLGMTELLLGTPLSAKQRDYVQTIHSAGNELLTLINEILDISKLESGQIELDEVQFDLNALIEDCLDIFRVKAEQQRIELISFTQPQVPRVIGGDPTRLRQVVLSLLDNAFKQTEEGEILLVVALDDQGETPRLRIAVQDSGHPFDAKEREALLTAELHSGDFLSASKLGSHLGLIIARQLVRLMGGEFGIQSGSSQGTTLSLTLPLDPQQLENPTADLDGPLQGARLLVVDDNETCRKVLVQQCSGWGLNVSAVSSGKEALAQLRTKAHLREYFDVVLLDQDMPGMTGMQLAAKIKEDPNLNHDILLIMLTGISNAPSKIIARNAGIKRILAKPVAGYTLKATLADELAQRGVSGVTNYLQPAKEAQAPSLPSDFRILVAEDNSISTKVIRGMLNKLNLQPDTASNGQEALSAMKATQYDLVLMDCEMPVLDGFSATEQLRAWEAHEQRPHTPVVALTAHILSEHKERARLVGMDGHMAKPVELSQLRELIAYWVGERDRRRQGDALPS

SEQ ID NO: 6214 - protein, 550 aa, Kluyveromyces lactis
MPSEYSSPPVYSTSNGFKYSHHPYGAQYSRPDGPLLLQDNHLIESLARFDRERIPERVVHAKGGGCHIEFELTDSLSDITYAAPYQSPGYKCPGIIRCSTVGGESGAPDTARDPRGFSFKFYTKWGNHDWVFNNTPVFFIRDANKFPHFIHTQKRSPRNHLGQASDTSMYWDYLTQNIESIHQITYMFGDRGTPASWSDMSAYSGHTYKFINAEGKLTYVQIHVLPENGFKTLSLEEANKLAGENPDYNNQLLFEKLEAGERPKFNCYVQTMTPEQAENFRYSINDLTKIWPHKEFPLRKFGTITLTHNVDNYFEEIEQLAFSPSNTCIPGIEPSNDSVLQSRLFSYPDTQRHRLGTNFMQLPVNRPVNMGREACPFAGANFQRDGPMCMFNFKDQPNYIASSGKNLVQFNTLDDNNAKSTHERFTGVVLEEDVVAEIKRQEENRVEHERVVNGKINEYYIVNGASPVDLEQPRALYEKVYNDKDKKTFVKNVVAHASKISNPEIKTRVSQYFGLLNEDLGKQIAEGLEIQWEPVSFETYARRISIASAF

SEQ ID NO: 6215 - protein, 574 aa, Kluyveromyces lactis
MCGIFASFRNPDVQAYKPKALQLSKRIRHRGPDWSGNIVKNSTILVHERLAIVGLDSGAQPITSEDGSYTLAVNGEIYNHIMLREECASYPFKTLSDCEPIIPLYEKYDIDAPKHLDGMFAWCLYDSKKDRIIAARDPIGITTLYMGRSSASPKSVWFSSELKCLTDDCDEIIAFPPGHVYDSETDKLTRYFTPDWLDESRIPTTPVDFKAVRESLEKAVRKRLMAEVPYGVLLSGGLDSSLIAAIAARETEKTNAELDPVVYDSDPHQLAGLDEQGHLHAAGWSRLHSFAVGLPNAPDLQAARKVATFIGSIHHEHTFTLQEGLDALDDVIYHLETYDVTTIRASTPMFLLSRKIKAQGVKMVLSGEGSDEIFGGYLYFAQAPSAAEFHVESVKRVKNLHLADCLRANKSTMAWGLEARVPFLDRDFLQLCMNIDPNDKMIKPAEGKIEKYILRKAFDTTDEPDLKPYLPEEILWRQKEQFSDGVGYSWIDGLKDAAESTISDEQFAQPKAEWGDDIPTTKEAYWYRLKFDALFPQKTAASTVMRWIPKADWGCAEDPSGRYAKIHEQHVDKK

SEQ ID NO: 6216 - protein, 492 aa, Lactobacillus plantarum
MPEEPKQTNPHIKKVPRPKRRVGLWTYIISIVVALGIGVGGTYWLIGRQVNAQLSSMQQTSKAMKKIESVYETINENYYKPVNANKLANGAINGMVNSLGDKFSEYMDKSETESLNDTIDSSFSGIGAQVQKSGNYVQIISPIAGTPAKKAGLKPKDIIKAVNGKSVAGKTLTQAVSMMRGKIGTTVKLTIERSGQTFTVSLKRAKIPVTTVDYKLVGGDKKIGYITVSTFSTNTAKEFKTALKALDKKGAKKLVIDMRGNPGGLMTAALKMASIFLKNGKTIMQVQARDGSTEKYTASKKYDGGFKETKSTTVLIDGGSASAAEIFSAALHQSAGVKLVGSQSYGKGTVQTVTTFNDKTEMKITVAKWLTPNGTWINKKGLTPDVKADEPSYASLTVISKVSDLQADKVNSNVKTFQKYLQALGYFKGTVNGYFGDSTTSAVKQYQKHAKLTVNGKVDKQTLTKIETELANKISDNDRAYDAAMKLIEKTN

SEQ ID NO: 6217 - protein, 496 aa, Actinobacillus pleuropneumoniae
MNNGAPVVDNQNSMTAGPRGPLLAQDLWLNEKLANFVREVIPERRMHAKGSGAFGKFTVTHDITQYTKAAIFSEVGKETELFARFTTVAGERGAADAERDIRGFAVKFYTEQGNWDFVGNNTPVFFLRDPRKFPDLNKAVKRDPRTNMRSATNNWDFWTLLPEAFHQVTIVMSERGIPASYRHMHGYGSHTYSLINANNERFWVKFHFRTEQGIKNLTNEEAAAIIANDRESHQRDLYESIEKGDFPKWKLYIQVMPEAEAEQVDFHPFDLTKIWSKKDYPLIEVGVMELNRNPANFFADVEQSAFAPSNLVPGISVSPDRMLQARLFNYADAQRYRLGVNHHQIPVNAPRCPVHSNARDGQSRVDGNYGSTLHYEPNSFGQWQEQAQFAEPPLKINGDAAFWDYRQDDSDYFSQPRALFNLMTEKEKQSLFKNTAEGMGDALDFIKYRHIRNCYFCDPAYGEGVAKALGMTVADAMEAYNTDPAMGQPGLIKPNF

SEQ ID NO: 6218 - protein, 645 aa, Sinorhizobium meliloti
MCGFGGYLGSIRDGKPLLERMTAAIGHRGPDERGIFTAPGAGLGHVRLSIVGLGDGQQPMSNPSGELTIAFNGEIFNYVELRDELRARGRQFRTSSDTEVILHLYEEMGEDCLSLLNGDFAFAIWDARRRRMMLARDRMGVRPLFHTLKGGTLYFASEVKALLEVPGVSAEIDPIALDQIFTLWAPIAPRTPFRDIHELEPGHLMIADQNGTTTRPYWQLDYPDRDERPAYAEESRAAEELRALLTDATRIRMRADVPVGAYLSGGLDSSIISALAAGMTSQGLRTFSVTFDSAEHDESAFQEEMAAALGTEHRAVACRAGDIARDFPDVIRFTEKPIIRTAPAPLYKLSGLVREAGLKVVLTGEGADEVFAGYDIFKEARVRRFCGRQPGSRIRPHLFRKLYPYLPGLQQQSAEYLAAFFGAGDVALDDPLFSHRPRLKGTAATKMFFSSDLRAELTGYDAAEELVSRLPAAFGRWHPLHQAQYLESRFLLPGYILSSQGDRMAMAHGIEGRFPFLDHRLVEFAAKLPPEMKLRGLVEKHILREATKDLLPPAIGRRTKQPYRAPDSHSFSGAGELDYVRSAMSEDAVAAGGLFNAKAVTKLYEKCQSRPASGFRDNAAFVGVLSTQLWLQTFTGTSLRKAEAA

SEQ ID NO: 6219 - protein, 480 aa, Oryza sativa
  misc_feature (320)..(320): Xaa can be any naturally occurring amino acid
MVLSHASSGRDDAVRCTFATRYACETLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGWDVPIHVDAASGGFIAPFLYPELEWDFRLPLVKSINVSGHKYGLVYPGVGWVIWRSKEDLPEELIFHINYLGTDQPTFTLNFSXKGYKNIMQNCMENTAILREGIEATGRFEILSKEAGVPLVAFSLKDSGRYTVFDISEHLRRFGWIVPAYTMPANAEHVAVLRVVIREDFSRSLAERLVSDIVKILHELDAHSAQVLKISSAIAKQQSGDDGVVTKKSVLETEREIFAYWRDQVKKKQTGIC

SEQ ID NO: 6220 - protein, 367 aa, Pseudomonas fluorescens
MPVQALFKPFQLGALELPTRVVMAPMTRSFSPGGVPNSKVIEYYRRRAAAGVGLIITEGTTVGHQASNGYPNVPHFYGEAALAGWKKVVEAVHAEGGKIVPQLWHVGNVRRLGTEPDASVPGYGPSEKLKDGQVVVHRMTKQDIQDVIAAFAQAAKDAQSIGMDGVEIHGAHGYLIDQFFWEGSNQRTDEYGGSLANRSRFAIELIQAVRAAVGEGFPIIFRFSQWKQQDYTARLVQTAEALGEFLKPLSDAGVDIFHCSTRRFWEPEFDGSDLNLAGWTRKLTGKPTITVGSVGLDGEFLQFMVNTDKVAQPASLEKLLERLNNEEFDLVAVGRALLVDPDWAQKVREGREQDILPFSREALMTLV

SEQ ID NO: 6221 - protein, 634 aa, Zea mays
MDGCDCIEPLWPTDDLLVKYQYISDFFIALAYFSIPLELIYFVKKSSFFPYRWVLIQFGAFIVLCGATHLINLWTFTTHTKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLRHQITVGSSVPMNLPVVNQVFSSNRAIIIPHTSSLARVRPLAGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDEHFYLKVQVKDTGCGVSPQDLPHVFTKFAHPQSGGNRGFNGSGLGLAICKRFVSLMGGHIWIDSEGTGRGCTATFVIKLGVCDNTNTYQQQLVPLVWPSSADSNLSAPKVLPDGRGSVSLKSRYQRSV

SEQ ID NO: 6222 - protein, 473 aa, Lactobacillus acidophilus
MTKTLPKDFIFGGATAAYQAEGATKTDGKGRVAWDKFLEENFWYKGDPASDFYHNYVEDLELAEKFGGNVIRISIAWSRIFPNGDGEVKPNGVDFYHKLFAECDARHVEPFVTLHHFDTPEGLHEDGDFLTHEKMDDFVEYADYCFKEFPEVKYWITINEIRSVAVDQYIIGNFPPADTFGFDKMFQTHHNQMVGHARAVKLFKHDGSKGEIGIVHALQTNYPFNESNPADIGAAELEDLLDNKFLVDGTFVGKYPQETMEAVKDILAANHGGEFNIEDEFKAIDAAKDVQDFVGVDYYLSEWMRAYDGKSEITHNGTGDKGTSKVQVKGVGEEKLPDGIETTDWDWLIYPQGLYDKIMRVKNDYPNIHKVYITENGIGFKDTVPDNEETDKTVHDDARIDYVKQHLEVIADAIADGANVKGYFIWSLMDVFTWTNGYTKRYGLFYVDFDTQDRYPSKTADWFKNLAETHIIE

SEQ ID NO: 6223 - protein, 538 aa, Thermotoga neapolitana
MPKLLKFNEEARRALERGVDKVANAVKITLGPKGRNVVIEKSWGSPTITNDGVSIAKEIELEDKFENLGAQLVKEVASKTNDVAGDGTTTATVLAQAMIKEGLKNVAAGANPILLKRGIDKAVERAVEEIKKLSKKLSGREDIAHVAAISANSPEIGELIAEAMDKVGEDGVITVEDSKTLETYVEFTEGMQFDRGYISPYFVTDAEKMEVVLKEPSILITDRKLSAVKPLIPILEKVAQTGKPLLVIAEDVEGEALTTLVLNKLKGTLQSCAVKAPGFGERRKAMLQDIAILTGGQVASEELGINLEDLTLEDLGRADLVRVKKDETIIIGGKGDPEAIKKRIAQIKAQIEETTSEYEKETLQERMAKLAGGVAVIKVGAATETELKEKKHRIEDALSATRAAVEEGIVPGGGVTLLRSRKAVEKLLEELDGDEKIGAQIVYKALSAPIRQIAENAGYDGAVIIEKILASDDPAYGFDALRGEFGNMFEKGIIDPAKVTRSALQNAASIAGMLLTTEVLVVEKPEEKKETPSLPEEY

SEQ ID NO: 6224 - protein, 525 aa, Escherichia coli
AAKDVKFGNDAGVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTVAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPK

SEQ ID NO: 6225 - protein, 575 aa, Bacteroides fragilis
MSTKNSSRFTPVIIAISVVIGILIGTFYAKHFAGNRLGIINGSSNKLNALLRIVDDQYVDTVNMADLVEKAMPQILAELDPHSTYIPAQNLEEVTSELEGSFSGIGIQFTIQDDTIHVNSVIQGGPSEKVGLMAGDRIVMVDDSLFVGKKVTNERAMRTLKGPKGTQVKLGVKRATEKDLLNFTITRGDIPQNTIDAAYMLTDDFGYIQVSKFGRTTHVELLNAIALLNHKNCKGLIIDLRGNTGGYMEAAVRMVNEFLPEGKLIVYTEGRKYPRADEFANGTGSCQKMPVIVLIDEGSASASEIFTGAIQDNDRGMVVGRRSFGKGLVQQPIDFSDGSAIRLTIARYYTPSGRCIQRPYQNGKDRNYEMDWLTRYEHGEYFSKDSIKLDENLRYSTALGRPVYGGGGIMPDVFVPQDTTGVTSYLTEVLSKGLTIQFTFHYTDNNRDKLKKYEDEESLLNYLRRQGLVEQFIRYADSKGVKRRNILIQKSYKLLEKSIYGNIIYNMLGKEAYIQYLNQSDQTVKKAVELLESGEAFPKAPVSVEPQKEEKKDGKKKTTAQVDSTGEEEILRLYA

SEQ ID NO: 6226 - protein, 451 aa, Cryptococcus neoformans
MTSLNFKVAPAVQATEAPPIPKAQAWGCQYVPSPSAPLLDLSQGVPRAAPHPNVLAALSKVASDPQAARYGPILGEPGLRQALAEEIKVQYHVSGQGVTFEDVAITTGCNMAFLSLLMTLCPPGKSSVLLPLPAYFNHTMSLSLQDVKPVYVLCEPDNMLKASLPSARSYLASLRKGNGDRREPRMIVLVSPSNPTGTVYTNEEIKQWYDLAREYKVALVLDETYRDFVEGESGQRGLPHRLFEEPDWRSTLVSLGSFSKGYRIPGHRLGSIIASPELLQHITTICDCMQICPPRPPQIALTPLLPSLRPDLFAASSQLSHRRHLFETTVNAIPGWEVISSGGFFAYVQFPEDYIYASSILGLKRKKLGSEDVARVLALRCGVVTLPGSFFMPPLADDEQWDDILNGETLRQDKWLRFAVANVEDDVILSLGPRLKLMNKIMGVDNEGVAS

SEQ ID NO: 6227 - protein, 296 aa, Brassica napus
MAKMGINPIMMSAGELESGNAGEPAKLIRQRYREAADLIKKGKMCCLFINDLDAGAGRMGGTTQYTVNNQMVNATLMNIADNPTNVQLPGMYNKEDNARVPIIVTGNDFSTLYAPLIRDGRMEKFYWAPTREDRIGVCKGIFRTDNVKDEDIVTLVDQFPGQSIDFFGALRARVYDDEVRKFVEGLGVEKIGKRLVNSREGPPVFEQPAMTLEKLMEYGNMLVMEQENVKRVQLADQYLNEAALGDANADAIGRGTFYGKAAQQVNLPVPEGCTDPQADNFDPTARSDDGTCVYNF

SEQ ID NO: 6228 - protein, 322 aa, Candida tenuis
MSASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIHFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPRSNLPERLVQNRSFNTFDLTKEDFEEIAKLDIGLRFNDPWDWDNIPIFV

SEQ ID NO: 6229 - protein, 287 aa, Unknown
  Halobacterium sp. NRC-1
MADVIDAVFDAIADAAPEVRAGLPDHRATRDDQNASGDTQLEADVWADDLLFDRTESIEGVNWYASEERDAVVTVGDAEGGYAVALDPLDGSSNVKSNNPCGTVVGIYDQPLPAPGSSLVAAGFVLYGPTTTMVVARDDTVRESLVSETGATTDLGPVELPADPTVYGFGGRVPDWTPAFESFVRDVEDDLKLRYGGAMIADVNQVLVYGGVFGYPGMESAPDGKLRAQFEALPIAYIVETAGGASSDGTQSLLDVAPTRLHERTPTFVGTDDVIAALDAALPDHTN

SEQ ID NO: 6230 - protein, 492 aa, Oryza sativa
MDPYKHRPSSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSSETLRDPRGFAVKFYTREGNFDLVGNNMPVFFIRDGMKFPDMVHAFKPSPKTNMQENWRIVDFFSHHPESLHMFSFLFDDVGIPLNYRHMEGFGVNTYTLINKDGKPHLVKFHWKPTCGVKCLLDDEAVTVGGTCHSHATKDLTDSIAARNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFKQAGERYRSFDPARQDRFLQRWVDALSDPRITHELRGIWISYWSQCDASLGQKLASRLNLKPNM

SEQ ID NO: 6231 - protein, 142 aa, Clostridium thermocellum
MSLISWNPFREVDSISRDMETFFERSPFGFFSRATAPRVDVFETEKDVVVKAEIPGVSKEDLNVYVDENSIRLSGETKRDTEYKNEHIYRTERYYGSFSRTIPLPVEVKSEQAKAEYKDGILTVTVPKVETTQMKGKKIDIH

SEQ ID NO: 6232 - protein, 682 aa, Escherichia coli
MNMFFRLTALAGLLAIAGQTFAVEDITRADQIPVLKEETQHATVSERVTSRFTRSHYRQFDLDQAFSAKIFDRYLNLLDYSHNVLLASDVEQFAKKKTELGDELRSGKLDVFYDLYNLAQKRRFERYQYALSVLEKPMDFTGNDTYNLDRSKAPWPKNEAELNALWDSKVKFDELSLKLTGKTDKEIRETLTRRYKFAIRRLAQTNSEDVFSLAMTAFAREIDPHTNYLSPRNTEQFNTEMSLSLEGIGAVLQMDDDYTVINSMVAGGPAAKSKAISVGDKIVGVGQTGKPMVDVIGWRLDDVVALIKGPKGSKVRLEILPAGKGTKTRTVTLTRERIRLEDRAVKMSVKTVGKEKVGVLDIPGFYVGLTDDVKVQLQKLEKQNVSSVIIDLRSNGGGALTEAVSLSGLFIPSGPIVQVRDNNGKVREDSDTDGQVFYKGPLVVLVDRFSASASEIFAAAMQDYGRALVVGEPTFGKGTVQQYRSLNRIYDQMLRPEWPALGSVQYTIQKFYRVNGGSTQRKGVTPDIIMPTGNEETETGEKFEDNALPWDSIDAATYVKSGDLTAFEPELLKEHNARIAKDPEFQNIMKDIARFNAMKDKRNIVSLNYAVREKENNEDDATRLARLNERFKREGKPELKKLDDLPKDYQEPDPYLDETVNIALDLAKLEKARPAEQPAPVK

SEQ ID NO: 6233 - protein, 649 aa, Lactobacillus gasseri
MCGICAFFDPELKDKDCAIQGMMDTIKHRGPSSDGKYTNDQVALGFRRLSIIDLRGGSQPIFNEDKSRAIIFNGEIYNFKPLRKELIDAGHTFTTKADTEVLLHGYEEWGMDGLLKRVRGMFAFVIWDDNTKTLYGARDFFGIKPMYYSDQNGKLIVGSELKSFLAYPGFKKELNTEAVKPYLMNQYNDLKETFFKGVYRFPAGHWFEYKDGKMKTHQYWDAKYVENSLSFEETLDKINEDLKETVDLYRNADVPVGAFLSEGIDSSYLTSLLDPEDVFSVSFDDSTYNEASKAKALSDLHGWKFFADKVDADEAMRDFPEMQYHMDEPDANPSIIPLWYLCKLARKHVTVALSGEGADELFAGYVNYGMHTHNDVIKVFTAGLKKLPKKSRVRLAHKIKKMPNFPGKVHMYTNLAEPSEFYVGQSVIYDMDYPTIFTSKDANNILRDKYKNDLTVNGIYQEDFKKVKNIDEVKQMQYIDLHHFMLNDIEQKADKISMAHSLELRVPYLDKKIAELANSIPTKYLVNRHDTKYALRKASEKVLPEEWAQRPKLGFPTPIKQWLKEPRFYKQVRELFTEDFVNDIFDQKKIVKLLDDNYKGDGSARRQIWAIYTFLVWYKLFFVDYDETVKKYQHVQPEVAELIESGRLV

SEQ ID NO: 6234 - protein, 512 aa, Arabidopsis thaliana
MKKQLILGVILLGLFVIFLNTTQVEAARPLQADSEIRFVFQLLQRGQVIGSGPNGCTNIPGGSGTCRPNKFTYITIIKNPRISGCVSRRRIKCPVSTQPWHLGVPRGMLVQPFGPDPLTGPLCSAWNTNRISSAAVGNGLIASTCLTSKNTTKKATNITKIITCLFIFLDQLLVNTSWLDFGIILTSLYISSVTDLVTWKLVSQPCVRPCVRQLHVRKGLVSGVMKLFSSPLRTLRDAGKSVRISRFCSVSNVSSSLQIELVPCLTDNYAYILHDEDTGTVGVVDPSEAVPVMDALQKNSRNLTYILNTHHHYDHTGGNLELKDRYGAKVIGSAADRDRIPGIDVALKDADKWMFAGHEVHIMETPGHTRGHISFYFPGARAIFTGDTLFSLSCGKLFEGTPEQMLASLQRIIALPDDTSVYCGHEYTLSNSKFALSIEPTNEVLQSYAAYVAELRDKKLPTIPTTMKMEKACNPFLRTENTDIRRALGIPETADEAEALGIIRRAKDNFKA

SEQ ID NO: 6235 - protein, 464 aa, Zea mays
  misc_feature (28)..(28): Xaa can be any naturally occurring amino acid
MSGVGSGRPPAAQKILQSLRPPLSFATXPSRPPFAAPDDYHRFPTPAAATAPAATSGGVGAGAPPRDTIEEGLVIRTPLKRKATSEENDAAAEPSDCIITSPMPTSVSGKTVKASKAKAKNSKTGPQTPTSNVGSPLNPPTPVGTCRYDSSLGLLTKKFINLLKQAPDGILDLNNAAETLEVQKRRIYDITNVLEGIGLIEKTLKNRIRWKALDDSSVQLDNGISALQAEVENLSLQEQALDERISDMREKLRGLTEDENNKRWLYVTEDDIKGLPSFQNETLIAIKAPHGTTLEVPDPDEAGDYLQRRYRIVLRSTMGPIDVYLVSQFDEKFEELGGVATPVKHSNVPRHQPVEDFNTYAGQSSTPMDVAHDVQHGQKIPQDPSALHDFGGMTRISPSDVHTDSDYWLLTEGDVSMTDMWKTGQEVQWDQIDFLSEDVVTPRAHNQQPVTVDGPHMEVPSMDP

SEQ ID NO: 6236 - protein, 882 aa, Vibrio parahaemolyticus
MERWMLRLSIKTRLALLALLPAVVIVAFAIHQFYANSVRVDHLNQTVSNIQGFQLISQASHFIYSMEKDRRQYGQETPLSIEVDVQNNVVLSMHHKFSTNPHTSEYADDLKEAMLGMVSGDLTNTDEVGDWAFQLLQEMSLSLLQNYQLYGNSDGHAMQNFIAYLAQLSYWTQKEAWLTYRLVMDPDAKLNQSVFFQTIDRQQQNLDAFLHLGASYAHVDKLLGLFSSPRYQRNLESRARLMNGDMPRSDYAAYLDELDFRVQRLQMMIEGFTRQAEQSLLTQVNEQKRNVLLITCGVAVVLLLLGWLGFATWYRVNSKIGAIIHALNALVNEEEKEKKVAVDGSDEFTLFAQQVNRVVEEKQRQTHEILHAKESAVAANRAKSVFLANMSHEIRTPLNGIMGMTEILSQSELSPHQQEVVDDIDTSSHTLLALLNDILDLSKIESGRLELSLVEADIREVVYQSVILFQSKATSKQLELDISLDENIPARVMVDDHRIKQIITNLVSNAVKFTEQGYILVDVSYEEALEQGRGSLTFLIKDSGIGIERDKLATIFEPFTQEDEGVSRQFGGTGLGLAICRQLVSMMGGKLVATSTKGVGTCFGFSIEVEALPLFGWHSDVVKRGLFICDNYAYAEQIVQECRLAQIELVGVNSLSEAKALDEDFDVIFLCNDGQMDIDSCLSELAEVYDVRRVVVCQHHLTSSYTNAENVHAVLTQPFLGNRFKHAIEELAKLEKNTLRDNVTNIASRAESKISRTHRRILIAEDNLMNQKIASFFLDKAGYDYLITSNGQEALDAITKGEQFDAILMDCMMPVMDGLTATKEIRRWEKKVGCKKTTIIALTASVLEEDIHNCFAAGMDAYLPKPYKSNQLFELFNELKLA

SEQ ID NO: 6237 - protein, 250 aa, Cynodon dactylon
MERVEVLGGGSSAGQVRKKRMRRKSTGPDSIAETIKRWKEHNQKIHEDRKAPAKGSKKGCMAGKGGPENGNCAYRGVRQRTWGKWVAEIREPNRGRRLWLGSFPTALEAAHAYDEAARAMYGPTARVNFSESSADANSGCTSALSLLASNIPPASQRSDDKDEVESVETEVHEVKMEVNDDMRSVHVERKTLEVFQSEESVLRKEGDVSYDYFHVEDVLEMIIVELNAAKKIEVHEEYQDGDDGFSLFSY

SEQ ID NO: 6238 - protein, 250 aa, Cynodon dactylon
MERVEVQGGASSAGQVRKKRMRRKSTGPDSIAETIKRWKEHNQKIHEDRKAPAKGSKKGCMAGKGGPENGNCAYRGVRQRTWGKWVAEIREPNRGNRLWLGSFPTALEAAHAYDEAARAMYGPTARVNFSESSADANSGCTSALSLLASNIPPASQRSDDKDEVESVETEVHEVKMEVNDDMRSVHVERKTLEVFQSEESVLRKEGDVSYDYFHVEDVLEMIIVELNAAKKIEVHEEYQDGDDGFSLFTY

SEQ ID NO: 6239 - protein, 423 aa, Xanthomonas campestris
MSTAPQKPLAIRERLSEVRYEIRGELARRARELEAQGRKLIKLNIGNPGAFGFRAPEHLQRAIADDMGRTDPYTHQQGLPEAREAVATAYSRRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRELLERIVAIATKHNLLLMVDEIYDQVLYDDAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLQLVAPAGALYAFPAVVGAAARNFDDHAFALDLMNEEGVLVVPGSSFNVPYRHHFRVTLMPEAGVMRDVFARIDRALARRAEAITKVVPLKPRNVA

SEQ ID NO: 6240 - protein, 661 aa, Saccharomyces cerevisiae
MSELLAIPLKRTLEVDFATELSKLIDTTSFQTASFFQSDILKVVDARNNAIAPDISIDGLSALKEYYVILLQLEKKFPNNQIEFTWFQTLSQKSRGTSQYSLQWEKLTIIYNIGCMYSLLALNSNNDAAESLKTSCLYFQNAAGCFKHVLDHQKNLETIPVVDDATLNALTSLMLAQAQECFWFKAVQDKHKDSLIAKLSQQIVDFYCEAINDAQRGKLIRSDWINHLKAKKAYFSAVTYYRIALSFNEKKQFGNVVKALQMGLQFINESTLSSQAKFKTVVESSLKEAQRDNEFIYLQEVPSELPSIKPALMVKPSSSATLLPSIKKDETLFKDLIPIEVMEYCTAYNERQDEYVEQRVTNPLASLNKLLKESLTTFQIPQGLTKVSEAELSHYQASLNNLLINNKNVQVQLDNIEQILNEEAFTDNQLRLKHGTLNWTLPESSTTNTAYYEKLKKLRGYLDEGSAIDKQTNELFQSIDKNLIGSEIRLPESNDPLTNKIKMIIQERNDYIDRTRRKSSEYRILPKIITSYKKNGTVDFEPIFIGHLKYFDEDLRYVNSTKEENIKLIEEVNLSKKNNPGRSGIEPKKMVRIDPRELYIEDLRYSFKLLDEVKENLSAGTAFYENLITSTSNLYNEVQEYDTARRAEKARLDKSLTFEDQ

SEQ ID NO: 6241 - protein, 268 aa, Triticum aestivum
  misc_feature (16)..(16): Xaa can be any naturally occurring amino acid
  misc_feature (227)..(227): Xaa can be any naturally occurring amino acid
  misc_feature (229)..(229): Xaa can be any naturally occurring amino acid
  misc_feature (244)..(244): Xaa can be any naturally occurring amino acid
  misc_feature (251)..(251): Xaa can be any naturally occurring amino acid
  misc_feature (255)..(255): Xaa can be any naturally occurring amino acid
  misc_feature (262)..(262): Xaa can be any naturally occurring amino acid
  misc_feature (267)..(267): Xaa can be any naturally occurring amino acid
GSGTRDRPGRRRRPWXPYKHRPTSGANSGYWTTNSGAPVWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLXSXDGKAHLVKFHWKPTXGVKCLLXDETXTVGGTCXTMPQXT

SEQ ID NO: 6242 - protein, 382 aa, Triticum aestivum
  misc_feature (318)..(318): Xaa can be any naturally occurring amino acid
QGNRNPLNKIHWQATKRHVRPHREWRTTAAAAAAGTATSAPTPSRWRFFRPTAGTPLAAAGSMSIRSVLNRLNSSVDASGTRPVVPLGHGDPTSSACFRTAPEAEDAVVDALRSRKHNGYSPTVGVPQARSAIAEYLSRDLPYELSPDDIYLTSGCVQAIEIMISVLAQPGANILLPRPGFPMYESRTTFSELEVRYFDLVPERGWEADLESVKAIADENTVAMLIINPSNPCGSVYSHDHLAQIAETAGELGILIIADEVYDHLAFGSKPFIPMGVFGKTVPVITLGAISKRWLVPGWRLGWIPTCDPNGIFKETNXHQSIPNYIYITSDPCTIIQGAAPPILAHTREGYFNKIPGLLRKSTNYCTVIKEIRGIIFRQPEG

SEQ ID NO: 6243 - protein, 283 aa, Physcomitrella patens
MGRGKIEIKKIENTTSRQVTFSKRRGGLLKKAHELAVLCDAEVALVIFSSTGKLFEYASSGSMRDIIERYKKSPNGAMKSGASTDFLGREVLKLQEQVERLKSSQRRMLGEDLSALKVPDLLQLEQQLDLGASRVRARKNQLILEEIEGLQKKEQELMVANEDLRKKIADAEAVARANLSEARPESPRHLARTLSRDVSASSHPAATVYPHPNLRDVQRSQTSLQLGMFSSESYPPSSSRWPSEQQFPSASEGCAGESSMKWDHPHYHIQNRLHANILPSVRI

SEQ ID NO: 6244 - protein, 1125 aa, Unknown
  Populus tremula x Populus tremuloides
MSSSRPSHSSSNSARSRHSARIIAQTTVDAKLHADFEESGSSFDYSSSVRVTDSVGGDQPPRSDKVTTAYLHHIQKGKLIQPFGCLLALDEKTFRVVAYSENAPELLTMVSHAVPSVGEHPVLGIGTDIRTIFTAPSASALQKAMGFGDVSLLNPILVHCKTSGKPFYAIVHRVTGSLIIDFEPVKPYEVPMTAAGALQSYKLAAKAITRLQSLPSGSMERLCDTMVQEVFELTGYDRAMAYKFHDDDHGEVVSEVTKPGMEPYLGLHYPATDIPQASRFLFMKNKVRMIVDCHAKHVKVLQDEKLPFDLTLCGSTLRAPHSCHLQYMENMNSIASLVMAVVVNDGDEDGDTPDSANPQKRKRLWGLVVCHNTSPRFVPFPLRYACEFLAQVFAIHVNKELELENQIVEKNILRTQTLLCDMLMRDAPLGIVTQSPNIMDLVKCDGAVLFYRNKIWRLGITPSDLQLQDIAFWLSEYHMDSTGLSTDSLYDAGYPGALALGDVVCGMAAVRITSKDMLFWFRSQTAAEIRWGGAKHEPGEKDDGRRMHPRSSFKAFLEVVKTRSLPWKDYEMDAIHSLQLILRNTFKDIETMDVDTKTIHARLSDLKIEGMQELEAVTSEMVRLIETATVPILAVDVDGLVNGWNTKISELTGLLVDKAIGKHLLTLVEDSSVDIVKRMLFLALQGKEEQNIQFEIKTHGSKSECGPICLVVNACASRDLHENVVGVCFVGQDITGQKMVMDKFTRIEGDYKAIVQNRNPLIPPIFGTDEFGWCSEWNPAMTNLTGWKREEVLDKMLLGEVFGLNMACCRLKNQEAFVNLGVVLNTAMTGQESEKVSFGFFARTGKYVECLLCVSKKLDREGAVTGVFCFLQLASQELQQALHVQRLSEQTALKRLKALAYLKKQIWNPLSGIIFSGKMMEGTELGAEQKELLHTSAQCQCQLSKILDDSDLDSIIEGYLDLEMVEFTLREYYGCYQSSHDEKHEKGIPIINDALKMAETLYGDSIRLQQVLADFCRCQLILTPSGGLLTVSASFFQRPVGAILFILVHSGKLRIRHLGAGIPEALVDQMYGEDTGASVEGISLVISRKLVKLMNGDVRYMREAGKSSFIISVELAGGHKSQKRA

SEQ ID NO: 6245 - protein, 467 aa, Pectobacterium carotovorum
MRRNTMKAFPDGFLWGGSVAANQVEGAWNEDGKGVSTSDLQLKGVHGPVTERDENISCIKDRAIDFYHQYPQDIQLFAEMGFKVLRTSIAWTRIYPEGDEAEPCEAGLAFYDRLFDEMAKHQIQPLITLSHYEMPYGLVKKLGGWGNRAVIDHFEKYARTVFSRYKDKVKYWLTFNEINMALHSPFTGIGLSGEPSKQEIYQAIHHQLVASARAVKACHDLIPDAKIGNMLLGAVRYPMTCHPKDVLEAQNKNREWLFFGDVQVRGTYPAWIQRYFRENGVELTITAQDKDDLSHTVDFVSFSYYMSGCATFEPEKYQSSRGNIIRLIPNPHLEASEWGWQIDPEGLRFLLNELYDRYQKPLFIVENGLGARDVVEEDGSIHDSYRIDYLRRHLLQVREAIDDGVELLGYTSWGPIDLVSAGTAQMSKRYGFIHVDRDDDGKGTLVRRRKDSFYWYQDVINSNGKSL

SEQ ID NO: 6246 - protein, 516 aa, Zea mays
MAAAMVRTMSTTAAGTPPVSVATINPKLVWVALICDRIAGRLKVSISVLKCEYAVRGEIVTHAQNLQQELQKNPESLPFDEILYCNIGNPQSLGQQPVTYFREVLSLCDHPALLDKSETHALYSSDAIERAWQILEKIPGRATGAYSHSQGIKGLRDEIAAGIAARDGFHASGDNIFLTDGASPAVHMMMQLLISSESDGILCPIPQYPLYSASIALHGGSLVPYFLNEETGWGLDVDELKKQLEEARSKGITVRALVVINPGNPTGQVLVEENQKKIVEFCKNEGLVLLADEVYQENIYVEDKPFHSFKKIARSLGYTDDDLPLVSFQSVSKGYYGECGKRGGYMEITGFSPDVREQIYKVASVNLCSNVSGQILASLVMNPPKAGDESFESFMSERDGILSSLARRAKALEEAFNSLEGITCNKAEGAMYLFPRLHLPQKAIGAAQAVGTAPDAYYAKRLLEATGIVVVPGSGFGQVPGTWHFRCTILPQEDKIPAIVSRLKEFHEKFMDEFRD

SEQ ID NO: 6247 - protein, 324 aa, Nostoc punctiforme
MVEYYTQRASAGLIITEGTHPSPMGRGYTTCPGLHNQEQVGGWRKVTDAVHAAGGRIFVQLMHAGRVSHSSLLPNHARPIAPSAVPVVSEEVHVWDGKVPFEIPRPLELSEIPEIVEEFRRAAELSIEAGFDGVELHAATGYLPNQFQVSGSNQRTDAYGGTLENRTRFTLEVVNALCKVRGAEQIGVKIAPGFTVNDTFDDNPAETYTYVAKALSPLGLAYLHVGYNQGYARGTAPNFNPIDLLRTVYQGTLLAVGGFDRQQGDEAITSRRADAIVFGRPFISNPDLVERLRLNAPLSKGDIRTFYGGSEHGYTDYPTLPQLH

SEQ ID NO: 6248 - protein, 524 aa, Escherichia coli
AAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLP

SEQ ID NO: 6249 - protein, 486 aa, Oryza sativa
MSTAAAGAAPVSLDTINPKVLKCEYAVRGEIVTHAQLQQELQKNPDSLPFDEILYCNIGNPQSLGQQPVTFFREVLSLCDHPALLDKSETHALYSDAIERAWQILDKIPGRATGAYSHSQGIKGLRDEIAAGIAARDGFHASGDNIFLTDGASPAVHMMMQLLIRSENDGILCPIPQYPLYSASIALHGGSLVPYFLDEETGWGLEVDELKKQLEEAQSKGITVRALVVINPGNPTGQVLAEENQKKIVEFCKNEGLVLLADEVYQENIYVEDKKFHSFKKIARSMGYTDDDLPLVSFQSVSKGYYGECGKRGGYMEVTGFSADVREQIYKVASVNLCSNVSGQILASLIMNPPKAGDESYESFMVEKDGILSSLARRAKALEEAFNSLEGITCNKAEGAMYLFPRIYLPQKAIGAAQAAGTAPDAYYARRLLEATGIVVVPGSGFGQVPGTWHFRCTILPQEDKIPAIISKFKEFHEKFMDEFRD

SEQ ID NO: 6250 - protein, 311 aa, Cucumis melo
NFQDYHGLPEFRNAIASFMGKAGGGRVKFDPSRIVMGGGATGASETVIFCLADPGDAFLIPSPYYAAFDRDLQWRTRAQIIPVHCNSSNNFQITREALEVAYKKAEESNIKVKGLIITNPSNPLGTIYDRDTLKSLVNFVNDNNIHLICDEIYSATVFKSPSFTSIAEIIEEMDHCKKELIHILSSLSKDMGLPGFRVGILYSYNDTVVSIARKMSSFGLVSSQTQHLLAAMLSDKEFVDNFLVENSKRLAKRHARFTEELEKMGITCLNSNAGLFVWMDLRKLLKDQSFESEMELWRVIINEVKLNVSPG

SEQ ID NO: 6251 - protein, 488 aa, Triticum aestivum
  misc_feature (290)..(290): Xaa can be any naturally occurring amino acid
  misc_feature (403)..(403): Xaa can be any naturally occurring amino acid
  misc_feature (407)..(407): Xaa can be any naturally occurring amino acid
  misc_feature (416)..(416): Xaa can be any naturally occurring amino acid
MVISHASSSAGEAVYSTFSSRYVREELPRYRMPEGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKLLNDLLVAKNKETGWDVPIHVDAASGGFIAPFLQPELEWDFRLPLVKSINVSGHKYGLVYPGVGWVIXWRSKADLPDELIFHINYLGTDQPTFTLNFSKGASQIIAQYYQLIRLGFEGYKHIMENCKLNAAVLKEGIDATGRFDVLSKADGVPLVAIRLKDSTNFSVFDISENLRRFGWIXPAYXMPADAEHVXVLRIVIREDFNRSLAQRLLADINKIVGELDAHAIHAIKLSTAAAAEGASKSTVDAVTEAFKGLAGNKKAGVC

SEQ ID NO: 6252 - protein, 909 aa, Kluyveromyces lactis
MSTEAHRHTYYGGPTTNTESSHHIHTSHAHNCSNGSSRRHSSSHNGRRRQVTFGPYIIGPTLGEGEFGKVKLGWSKSNSDESKNVAIKLIRRDTIPKNSEKEVKIYREINALKHLAHPNIVTLEEVLQNSKYIGIVLHYASGGEFYKYIQKKRRLKEPAACRLFAQLISGVHYMHHKGLAHRDLKLENLLLDEHENLIITDFGFVNEFSSRNDLMKTSCGSPCYAAPELVVTTKAYEARKADVWSCGVILYAMLAGYLPWDDDPDNPDGDDIAKLYNYITKTSLKFPEYINPIPRDILRRILVSDPSKRITVELILKHQWLQPHALFLSLKPEDWDIKAKAEISNIFRPPPSQSSQSAYSRPHSNSSVSSSEKRNSLIIDSTLHLQPVPPHESQSHAIAKPSSPSSDLRSSPIKRVNHSRSNSAASIALQAVVDAEREFFQSSQSILQISGVQSIEQSPNTRVQTYTATRSLAHNNSSSLMNRNSIIVEVSPNKEVISSSSSSAIPGMSYSASRESYISTSPVRNAAQSPKFVPGSFTSNTSHHNNKFGSSQQSRPRPTSYHPISSSYLEMQPSNSQNNFITTTNEFSYIPRTVNANNYIDSTRAISPELNGRTVDGTSPPLNSRNFQSGIIRRGSFSASKPSPSVDLNNVEGDLIKTDAEDHKKLKQQRRKSQRYSTVILDNSIATVQEETEEPITAYDANIKKPVENSNNLTKEFGKIVINEPRKEDAHIPISKPESEHLQKPPQQHQSQASIARADSHSKKEKRFSLLSFYSYYNNSKTSVSSDSSGGRRVSANSQKTNERISSVKSNGIPSRNVSGSINQFETSKPRVSSNPSNRTNYRHSMLPPKSSQVIDASAKRMNRSSVMVSSAKDITSSDGTASKEHKEQREPSTAKRVFDFFKRRSMRV

SEQ ID NO: 6253 - protein, 213 aa, Sinorhizobium meliloti
MLQAGIIPVTHFEQNCTVLFDSETKEGVVVDPGGDVDIILQTIRENGIALKAIWLTHGHIDHAGGAKELKEALGLDIVGPHKDDLPLLERLEDQAERFGLAMKVQNVVPDRWLEEGDTVSFGDHVFEVLHCPGHAPGHVVYFNRAQNFAHVGDVLFHGSIGRTDLPGGNHQQLLDSIRDKILPLGDNVGFICGHGPGGQIGEERRTNPFLRGL

SEQ ID NO: 6254 - protein, 279 aa, Glycine max
MENRTSSVLPPGFRFHPTDEELIVYYLCNQASSRPCPASIIPEVDIYKFDPWELPDKTDFGEKEWYFFSPRERKYPNGVRPNRATVSGYWKATGTDKAIYSGSKHVGVKKALVFYKGKPPKGLKTDWIMHEYRLIGSRRQANRQVGSMRLDDWVLCRIYKKKNIGKSMEAKEDYPIAQINLTPANNNSEQELVKFPRTSSLTHLLEMDYLGPISHILPDASYNSTFDFQINTANGGIDPFVKPQLVEIPYATDSGKYQVKQNSTINPTIFVNQVYDQRG

SEQ ID NO: 6255 - protein, 138 aa, Saccharomyces cerevisiae
MWLTEAQKFGVAFTFGGFLFFLFGIFTFFDRALLALGNILFLIGVFLIIGSQKTYIFFTRPNKRRGSLFFLVGAFLILLKWTFLGFIIESLGIIGLFGDFFGVIVQFLRSMPIIGPILSHPAIAPIVDKLAGVRVLPV

SEQ ID NO: 6256 - protein, 140 aa, Triticum aestivum
NKPKPPVIITRESANTLRAHILEVGSGCDVFECISTYACRRQRGVCVLSGSGIVTNVTLRQPSAPAGAVVTLHGRFEILSLSGSFLPPPAPPGATSLTIFLAGGQGQVVGGNVVGALYAAGPVIVIAASFANVAYERLPL

SEQ ID NO: 6257 - protein, 277 aa, Staphylococcus aureus
MEVKTFYNGNTMPQIGLGTFRVENDENCMESVKYAIEQGYRSIDTAKVYGNEEQVGAGIRAGLESTGIAREDLFITSKLYFEDFGRENVAAAYEASLSRLGLKYLDLYLVHWPGTNEAVMVDTWKGMEDLYKNNKVKNIGVSNFEPEHLEALLAQVSIKPVINQVEYHPYLTQHKLKLYLAAQHIVMESWSPLMNAQILNDETIKDIAQELGKSPAQVVLRWNVQHGVVTIPKSVTPNRISENFQIFDFELSDEQMTRIDGLNQDKRIGPDPKTFEG

SEQ ID NO: 6258 - protein, 500 aa, Oryza sativa
  misc_feature (214)..(214): Xaa can be any naturally occurring amino acid
MDPYKHRPSSSFNGPLWSTNSGAPVWNNNNSLTVGSRGPILLEDYHLVEKLANFDRERIPERVVHARGASAKGFFEVTHDITPHLRRLPPRPGRPDPGHRPLLHRHPRARQPGDPPRPAWLRHQVLHPGGQLGPRRQQLPRLLHPRRHEVPGHGALAQAQPQVARPGELAHPRLLLPPPGEPPHVHLPLRRHRHPRRLPPHGRFRRQHLHARHXAGKSHYVKSTWKPTCGVKSLLDDEAVTVGGTNHSHATQDLYDSIAAGNFPEWKLFIQTIDPDHEDRFDFDPLDVTKTWPEDIVPLQPVGRMVLNPQHPTTFFSENEQLALRAAGVLPRGSWGPGDLLAPDDKPLQERGIFSYSDTQRHRLGPNYLLLPPNAPKCAHHNNHYDGFMNFMHRDEEVDYFPSRYDPAKHAPRYPIPSATLTGRREKVVIAKENNFKQPGERYRSWDPARQDRFIKRWIDALSGPRLTHEIRSIWLSYWSQADRSLGQKLASRLSAKPSM

SEQ ID NO: 6259 - protein, 543 aa, Arabidopsis thaliana
MFTSGNVTARVFERQIRTPPPGASVNRARHFYENLVPSYTLYDVESPDHCFRKFTEDGLFLISFSRNHQELIVYRPSWLTYSTTDDSTTTLPPLPRRASKFDSFFTQLYSVNLASSNELICKDFFLYHQTRRFGLFATSTAQIHDSSSPSNDAVPGVPSIDKITFVLLRLDDGVVLDERVFLHDFVNLAHNMGVFLYDDLLAILSLRYQRIHLLQIRDSGHLVDARAIGYFCREDDELFLNSSSQAMMSQDKSKQQSLSGSKEDDTGENGLRHSLSQPSGSNSFLSGVKQRLLSFIFREIWNEESDNVMRVQSLKKKFYFHFQDYVDLIIWKVQFLDRQHLLIKFGSVDGGVTRSADHHPAFFAVYNMETTDIVAFYQNSAEDLYQLFEQFSDHFTVSSSTPFMNFVTSHSNNVYALEQLKYTKNKSNSFSQFVKKMLLSLPFSCQSQSPSPYFDQSLFRFDEKLISAADRHRQSSDNPIKFISRRQPQTLKFKIKPGPECGTADGRSKKICSFLFHPHLPLAISIQQTLFMPPSVVNIHFRR

SEQ ID NO: 6260 - protein, 546 aa, Oryza sativa
MRGDETSSLLFIHPWPPSLEAHHRHTGSLLHSAFLARSPHLTSLTYIAGSIAPSPAANEMLRAAARALTVSSLNPKVLALADHHLGGLVARRAQSMQQELDANPASHPFSEIIYCNHSNPQSQGQQPNKFFREVLALCNHPHLLDRSEASFMFSSDAITRAREIVGFIPGKTTGGYSHCQGIEGLRDAIAAGIASRDGLPSYSEDIFLTDGAAAPVHMMMHLLIRGKKDGILCPIPSHSLYTDSMVLRGATLVPYYLDESRGWSVNISDLKKQLDGARAKGIDVRGLVVVNPGNPTGQVLVEENQCEIVELCKNECLVLLADEVYQENIYTDQKKFNSFKKVARSIGYGEGDISLVSFHSVSNGYYGECGRRGGYMEVTGFSSEVRGEVYKVASLSACSNISGQILMSLVMNPPKVGDESYPSYRAERDSILSSLSCCAEAMVSTFNSMEGMTCNKAEGGISVFPSVRLPPRAIEAAEAMNTEPDVFYALRLLESTGIVVVPGSVFGQVPGTWHFRCTILPQEEKTRQIISRFNVFHEAFMEEFRS

SEQ ID NO: 6261 - protein, 530 aa, Oryza sativa
MCGILAVLGVADVSLAKRSRIIELSRRLRHRGPDWSGIHCYQDCYLAHQRLAIVDPTSGDQPLYNEDKSVVVTVNGEIYNHEELKANLKSHKFQTASDCEVIAHLYEEYGEEFVDMLDGMFAFVLLDTRDKSFIAARDAIGICPLYMGWGLDVCRIKILVLIYVPSKKFKVFVTGHEVGFFFDVISGSLFKAIIKRLMTDVPFGVLLSGGLDSSLVASVVSRHLAEAKVAAQWGNKLHTFCIGLKGSPDLRAAKEVADYLGTVHHELHFTVQEGIDALEEVIYHVETYDVTTIRASTPMFLMSRKIKSLGVKMVLSGEGSDEIFGGYLYFHKAPNKKEFHEETCRKIKALHLYDCLRANKSTSAWGVEARVPFLDKNFINVAMDIDPEWKMIKRDLGRIEKWVLRNAFDDEEKPYLPKHILYRQKEQFSDGVGYSWIDGLKDHANEHNAARLTVPGGPSVACSTAKAVEWDAAWSKNLDPSGRAALGVHDAAYEDTLQKSPASANPVLDNGFGPALGESMVKTVASATAV

SEQ ID NO: 6262 - protein, 205 aa, Juglans regia
KRRNGLLKKAYELSVLCDAEVALIVFSSRGRLYEYANNSVKSTIDRYKKARADSSNTGSVSEANTQFYQREAATLRQQINSVQESNRKMLGESLSGMAFRDLKSLESKLESGIRRIRSKKNELLFAEIEYMQKREVDLHNNNQLLRAKIAENERNQQNLNVMPGGGNLELMHSQPFDSRNYFQVDALQPNHDQYPRQDQMALQLV

SEQ ID NO: 6263 - protein, 219 aa, Lactobacillus collinoides
MKIDQIFSPYQLNKRVTLRNRLVLAPLNIQSSLFDGSVSLNNLNFHKARAKYVGLDIIGSAYISDSANTAYGAISVADDSKIDGLKKLATVIHQGGSKAILQLVHAGRMTNSYASKGAPVLTPSEVKAAHGDVDLPKAMTKTDIETVIKQFETATIRAIKAGFDGVELHGANTFLFQQFMSPLSNLRTDEYGGSLENRIRFCAETAKRVLDTAHAHKPG

SEQ ID NO: 6264 - protein, 315 aa, Unknown
  uncultured crenarchaeote DeepAnt-EC39
MNEPIKNIRLLLEEITIKCDASWIAFSGGLDSSILAEIKKEQNLNAITIISKDFLATDLSYSQITAKHIDIPLEIKYVSIDQMLGAIESTIKILKNFNDIEIRNSIVPYLYMNALKEKNITNVITGDGADEIFAGYNFLLKKDHNELKNELKRIKKIMHFTSQKIANKLGMSIQMPFIDEKIIELVETLPINLLINQKNGIKFGKWVLRKAFENTLPTNVIWRKKTAMQDGSGTTNLTKLFDSIITDDIFTKKVKKIKSECNIKIRTKESLYYYELFKENFIIPECEDKKNICPDCNAEIVSNSKFCRMCGKFPI

SEQ ID NO: 6265 - protein, 247 aa, Petunia integrifolia
MVFPNQEFESSSSQRKSGRGKIEIKRIENTTNRQVTFCKRRNGLLKKAYELSVLCDAEVALIVFSSRGRLYEYANNSVRATIDRYKKHHADSTSTGSVSEANTQYYQQEAAKLRRQIRDIQTYNRQIVGEALSSLSPRDLKNLEGKLEKAIGRVRSKKNELLFSEIELMQKREIEMQNANMYLRAKIAEVERATQQMNLMPGGGSEYQQQPMSSTSQPYDARNFLPVNLLEPNPHYSRQDQTALQLV

SEQ ID NO: 6266 - protein, 370 aa, Pseudomonas aeruginosa
MLFSPYTLGHLTLPNRIVMPPMTRSRAASGEVATALMAEYYSQRAGAGLIVSEGTQISRQGQGYAWTPGIHSAEQVAGWRQVTDAVHAAGGRIFAQLWHVGRVSHTSLQPGNAAPVSSSALVAEGVKVFVDPQGRGAQAGGGEMVQHSAPRALAVEEIREIVADYAQAARNALDAGFDGVELHGANGYLINQFIDSQANARNDQYGGSLENRLRFLREVAEAVTAVVGRERIGVRLAPLTTLQGAVDDTPQATYLAAARLLDEIGVAYIHIAEADWEDAPAMPAAFKEALRIVYRGSLIYSGMYTKARAEEALARGWADLVGFGRPFIANPDLPYRLEHDLALADGDRSTYFGGGAAGYTDYPSLPQAAG

SEQ ID NO: 6267 - protein, 1412 aa, Cryptococcus neoformans
MHQQRAPAAHHHSYSYAPYPHASVSAENTVPSMAQPQVYYQQPPADFYPHVPGHNPHTGASHGTQAGPSQSAENNAFAMPDVRQSKSARPRPPPSSVTMPMIPTSLPDPSMHSYAPVQAPVPQQQTRTANRRSHNPAATLNSPSAPRPEELTDEYVLHPSVYAFKQEYPRRAMVGLGPYIVLQTLGEGEFGKVKLGVHADYGVEVAIKLIRRGDLQEEAHASKVEREINVLKTLKHPNIVRMFDVLDTHKYIGIVLEFAGGGELFEYILANEYLKDKEGQRIFAQLISGVDYLHKKGVIHRDLKLENLLLDKNRNLIITDFGFANQFDLSKGDLMSTSCGSPCYAAPELVVLDTPYHGSAVDIWSCGVILYAMLAGYLPYDDDPDNPDAGNVVELYRYIMNTELHYPDHVSPLGKNLLQHMLILHPEHRIKIPVIVKHPWLKSYHDMFNKSVEECEAAFQDAMYRKSRQARKELQERRRVQTQARESLQTKERAHVQRSQSSAPGTIINAAALDQIRRRPHSAMPGSTPLPEIIAKHSESVDDVALTMRSATPPTALSQPTEIRSPTTESPRPRSESMAPRLSFTTSVSTPTAMTVETPSSVPVQSPTDALPPAAMTVMQPSVEAAPPMRDHKNRNTIQVEHAGEGLHDRAKEAFDANHGRADGSMETTSTADTGMVASSLLDVKREESTDIEMESGSSDSEQPKPANDGISQQPGEKSMDIPPIVPITIPLAPPAESGTATAANDSSQVLEPQEKLSPALVEHGSASIDEMASPSTPRVSTSVEQEPVNITPRAKMRAPPVATTPKASLVNERKRHGSMPPPMGPSFVSDSRPESSLTATGLPKLPKKDRYRKGMSLDKFGLAKLLGHASQAHTTVHGEGKMAPPSASSSALALQHQLQQHGGQSQAVSESDSVKKSRRRTLQFGFHSRKDSKASSAAVATPGTPLMDKDTNGENRLSSITGGTASLRDKRRKTVQIGLSTQSEQKDTTVNVPGLSSSGHLVKNPATEPPQGISIGPVVGTDASALSQSSPSAVALEAFAAQQGHYPSYRGSSSRASKVMDWFRRKTFVKETLPEPKSPVIKSDSQSSFVRIGEVASPASKTQESAQASTVSQENTDKAEEKIDSTADQENAAKTTPTKSPVLPQPIGATATTPSVMITPPRPTAATTPTIGSSTQQSPPTTIRTRSASTFTFDESKIRVHTGLVDQSALSTKPPQDVFVEVIQVLRGMGVEMKRESDFKLRCTRAKKKAAGTSIGLGSVVSTGSGMSPFSIMNNASASKTDSRGLPRPTSPSAVANRSSAGIKGLLRRGSSRSSAHPARLTRTGDEVPNPPSQSTPNLELPESSMASKPEPLYGKELMDAGDEVKFTVELCKMKNLPGLFILKIKRTKGNLWSFKFIYQTVIERTTTLTH

SEQ ID NO: 6268 - protein, 357 aa, Unknown
  Acinetobacter sp. ADP1
MNQIFKPILIGQYQLANRLAMAPMTRSRAQFDGTPSELAAEYYTQRASVGLIIAEGAQPSEDGQGYLATPGIYTDSHIAGWKKITNAIHAKGGRIFIQLMHVGRMSHPDNTPHHRQAVAPSSIAPGTVTFTPTGMQEIPKPRALTIKEIKQTIQDFRHAARSAIEAGADGVEIHGANAYLFQQFFAPTANTRTDEYGGSIENRARFAIEVATAIAEEIGADKTAIRLSPGSLLWGIDEGQEGPELYHYLVKELNKLGLVYLHIMHLGNETLLQDIRQLWTQALIVNRPGRPREQIGTDVESGLADLESYGEMILANPDFVNRLQQNLPMNEADKTTYYGGDAKGYVDYPALNASDKI

SEQ ID NO: 6269 - protein, 232 aa, Zea mays
  misc_feature (2)..(2): Xaa can be any naturally occurring amino acid
  misc_feature (10)..(10): Xaa can be any naturally occurring amino acid
  misc_feature (219)..(219): Xaa can be any naturally occurring amino acid
GXAERGELAXESVRLRAELKKGATGLPFPEVISANIGNSQQLDQKPITFFRQVLSLLENPQLLEHEDVLLEKLGYKSDVIARAKWLLSEVSSVGAYSASSGVSGIKESIARFLERRDGIPADPKHIYLSAGASSGVNTLLHIICANKNSGVLVPIPQYPLYTASLSVLDAVCVPYLLDESKAWGTDLDIMRASYEKAKADGVDTRALVVINPGNPTGAXLSEADVRATIQFA

SEQ ID NO: 6270 - protein, 84 aa, Oryza meridionalis
ARYVKFHWKPTCGVSCLMDDEATLVGGKNHSHATQDLYDSIAAGNFPEWKLFVQVIDPEEEERFDFDPLDDTKTWPEDEVPLRP

SEQ ID NO: 6271 - protein, 320 aa, Yarrowia lipolytica
MAATDPKKYLFNHTMLRIKDPKVSVPFYEKHFGMKVLGHYKFEQFKFDIYYLAYDHPESPYYGKPVWDRQGVLELTHNYGTENDANYKINNGNVEPHRGFGHICFSVDNIEKVSADLENGGVKFQKKLTDGRQKDIAFALDPDGYWIELITNHEAKLVANETNPSSYRFNHTMLRVKDPKKSIEFYTEKLGMRLFRTSKHENAKFTLYFLSYDKDFEVNDASRAGDREGLLELTHNWGTEDEADFSYHNGNAEPQGFGHLAITVDDIEAACERFNKIGVKFKKQLDEGGMKYIAFILDPDGYWIEVIPPYNLPLENHAKI

SEQ ID NO: 6272 - protein, 85 aa, Oryza barthii
KARYVKFHWKPTCGVSCLMDDEATIVGGKNHSHATQDLYDSIAAGNFPEWKLFVQVIDPEEEERFDFDPLDDTKTWPEDEVPLRP

SEQ ID NO: 6273 - protein, 84 aa, Oryza glaberrima
ARYVKFHWKPTCGVSCLMDDEATIVGGKNHSHATQDLYDSIAAGNFPEWKLFVQVIDPEEEERFDFDPLDDTKTWPEDEVPLRP

SEQ ID NO: 6274 - protein, 693 aa, Pseudomonas putida
MRCPHSVITPSGDLSMAADRYPHLLAPLDLGFTTLRNRTLMGSMHTGLEERPGGFERMAAYFAERARGGVGLMVTGGIAPNDEGGVYSGAAKLSTEEEADKHRIVTEAVHAAGGKICLQILHAGRYAYSPRQVAPSAIQAPINPFKPKELDEAGIEKQIADFVNCAVLAQRAGYDGVEIMGSEGYFINQFLAAHTNHRTDRWGGSYENRMRLAVEIVSRVRGAVGPNFIIIFRLSMLDLVEGGSTWDEIELLAKAIEQAGATLINTGIGWHEARIPTIATKVPRAAFSKVTAKLRGVVSIPLITTNRINTPEVAEAVLAEGDADMVSMARPFLADPDFVNKAAAGRADEINTCIGCNQACLDHTFGGKLTSCLVNPRACHETELNYLPVRTVKRIAVVGAGPAGLAAATVAAERGHAVTLFDAASEIGGQFNVAKRVPGKEEFFETLRYFRNKVKSTGVDLRLNTRVDVQALVGGGFDEVILATGIAPRTPDIAGVEHAKVLSYLDVLLERKPVGKSVAVIGAGGIGFDVSEYLVHQGVATSQDRAAFWKEWGIDTHLQARGGVAGIKAEPHAPARQVYLLQRKKSKVGDGLGKTTGWIHRTGLKNKGVQMLNSVEYLGIDDAGLHIRVDGGEPQVLAVDNVVICAGQDPLRELQEGLVAAGQSVHLIGGADVAAELDAKRAINQGSRLAAEL

SEQ ID NO: 6275 - protein, 539 aa, Paxillus involutus
MSLSKHVNAESLIRESKDKKHPHHHRSTTTSISTISYGARYGTQSIPKFHLPSKGTSAENAYQLIHDELALDGSPSLNLASFVHTWMPEPANKLMVENMSKNLIDQDEYPMTQLIHTRCVSILADLWHAPSTKQAIGTATTGSSEAIQLGGLAMKRIWQEHRKAAGKSIHEPGPNIVMGANAQVALEKFARYFEVECRLVPVSAESKYRLDPKKAMEYIDENTIGVFVILGSTYTGHYEPVKEMADLLDEYEKQTGHSVPIHVDGASGAFIAPFAQPKLLWDFKIPRVVSINTSGHKFGLAYVGVGWVVWRSKEYLPKDLIFELHYLGSVEYSFSLNFSRPAAPIIAQYFNFLHLGFEGYRAVALDDLKNARLLSRVLEGTGWYTVLSDIHRQKSNSLLTKGMQATIGIDEEHLENYMEGLPVVSFRFSDKFQEQYPEIQQKWIQTLLRAKGWIVPNYELPPNLEKVQILRVVVRENCTEVLIDRLVTDIVEITQNLVDRDSSTHALDMLGNGQHCKTVIGQMEEGSGSRSSGTYAKQC

SEQ ID NO: 6276 - protein, 636 aa, Oryza sativa
MDGCDCIEPLWPTDELLIKYQYISDFFIALAYFSIPLELIYFVKKSSFFPYRWVLIQFGAFIVLCGATHLINLWTFTTHTKTVAMVMTVAKVSTAVVSCATALMLVHIIPDLLSVKTRELFLKNKAEQLDREMGLIRTQEETGRHVRMLTHEIRSTLDRHTILKTTLVELGGTLGLEECALWMPSRSGSSLQLSHTLRHQITVGSTVSINLPVVNQVFSSNRAIIIPHTSPLARIRPLAGRYVPPEVAAVRVPLLHLSNFQINDWPELSAKSYAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMSFIKPIAAIKRLSVSVMLAPDLPLCAIGDEKRLMQTILNISGNAVKFTKEGHITLVASVVKADSLREFRTPDFHPTASDDNFYLKVQIKDTGCGISPQDLPQVFTKFAQSQPGGNRGYSGSGLGLAICKRFVTLMGGHIWLDSEGTGRGCTVTFVIQLGICDNTNAYQQKLIPLVWPSSGDADFVGPVPNAPNEEKGQASLKSRYQRSI

SEQ ID NO: 6277 - protein, 86 aa, Oryza glaberrima
GKARYVKFHWKPTCGVSCLMDDEATIVGGKNHSHATQDLYDSIAAGNFPEWKLFVQVIDPEEEERFDFDPLDDTKTWPEDEVPLRP

SEQ ID NO: 6278 - protein, 450 aa, Unknown
  Bradyrhizobium sp. BTAi1
MTTRPRFVWGASTSAFQIEGAAHRDGRADSIWDVYLRAPGRVSHNDTADIACDHYHRYADDVTLMRDLGLDAYRFSIAWPRVLPQGRGAANEAGLAFYDRLIDALLAAGIEPWLCLYHWDLPQALGELGGWQNRDIAGWFADYTALVARRYGDRVKRFATFNEPGVFTLFGYGLGWHAPGVADKAALHQAIHHVNLSHGRAVDVLRRDVVGASIGAIHNRQPCYPCTSSPEDAAAALRLAAYWNDAFPFPQAFACYPPALRDAVTPYVRPDDMAQIGRPVDWFGLNHYSPHYVKADTNLIGASFGPPPQAVPRSAIGWPVVPDAFRETLVDIDQRFRIPIYVMENGTAAADVIDPAGDIQDDDRIGYLKAYITAMEQAIAAGADVRGYFVWSLMDNFEWGAGYSQRFGIVYVDHATQRRIPKASARWYAEMIAARRSPDDPAGPHNRAEE

SEQ ID NO: 6279 - protein, 264 aa, Poa pratensis
MSRKKKVRRRSTGPDSVAEIIKKWKEQNQKLQEENGSRKAPAKGSKKGCMAGKGGPENSNCKYRGVRQRTWGKWVAEIREPNRGNRLWLGSFPTAVEAAHAYDEAARAMYGATARVNFSERSPDANSGCTSAPPVLMSNGPTAVSYPSDEKDESESPPSLMSDAPTATLHRSDAKGEPESAGTLVHEVKTEVSNDSRSIREERKTVEVFQPEGKALHKEEKVSYDYFNVEEVLDMIIVELSADRKMEVHEEYQDGDDGFSLFSY

SEQ ID NO: 6280 - protein, 174 aa, Xanthomonas axonopodis
MPLNDLQHVPGANDAPAETHGFVFNHTMLRVKDATQSLDFYTRVLGFRLLDARDFADAKFSLYFLALLPEGTAIPDDDAQRRLWMAGIPGVLELTHNHGTETQDGPVYHDGNSDPRGFGHLCISVPDIHAACARFDSLNVPYQKRLEDGRMKHLAFIKDPDGYWVEIISNTPLA

SEQ ID NO: 6281 - protein, 142 aa, Silicibacter pomeroyi
MPLKYLHVMVRVKDLEKSMAFYELLGLREIRRYDSEEGRFTLVYLAAPGQDETPLELTYNWDGDDGLPSDSRHFGHLAYGVDDIYATCAMLQENGITINRPPRDGRMAFIRSPDNISIELLQNGAALDPAEPWVSMDSTGHW

SEQ ID NO: 6282 - protein, 330 aa, Rhodopirellula baltica
MTHTDQSVAPAASPEAESQARDAVSEVEPYEFTEIAMPIIAMHVLALFAFIPEFITGTNVLLLMISLVVFSNGITLGYHRLLTHKSLRVPKWLEYGYVGLALCCLQESPAKWVSTHRRHHSHSDEPDDPHSPTASFWWSHVGWLLWKRKGQHEFRTDDRYCADIIADPFYALMEKYPDLPAGIYILHAGVIWLLASALFLVDNSFVSAVWQGAGLVLWCVVLRTVMIWHFSWSVNSLTHCFGYQNHKTSDQSRNNWLVAIVSNGEGWHNNHHHDPASASVQHKWWEFDATYLQIRVLKRLGLATHVIEPRQFRKGSVEPDNPSRLNKQTG

SEQ ID NO: 6283 - protein, 295 aa, Prunus mume
MSSSDLQLPPGFRFHPTDEELVKHYLCRKCQSQPISVPIIAEIDLYKYNPWDLPGLALYGEKEWYFFSPRDRKYPNGSRPNRAAGSGYWKATGADKPIGSPKPVGIKKALVFYAGKAPRGEKTNWIMHEYRLADVDRSPRKKSSSLRLDDWVLCRIYNKKGTVEKQQQQQQQQQQQTTSRMSSGSEFEDRKPENLACPPPPAAVAPTRPNDYVYFDTSDSVPRLHTDSSCSEHVVSPEFTCEVQSEPKWKEWEKALDFNYNYMDTSVENGFGPQFQSANQMSPLQDIFMYLQKPY

SEQ ID NO: 6284 - protein, 142 aa, Glycine max
  misc_feature (24)..(24): Xaa can be any naturally occurring amino acid
  misc_feature (113)..(113): Xaa can be any naturally occurring amino acid
  misc_feature (126)..(126): Xaa can be any naturally occurring amino acid
FSFGIDAIEDVLYHIETYDVTTIXACTPICLMSRLIKSLGVKWVIPREGSSEIFGGYLYLHKAPYKEEFLREPCLWIKALDHYDRLRANRSTFGWGLEARVPFWDKACINAAXEFSPEWNMMKRDXGRIEKWVLRRAFDDEE

SEQ ID NO: 6285 - protein, 417 aa, Zea mays
  misc_feature (328)..(328): Xaa can be any naturally occurring amino acid
MAAAAFDAYTDKNAIFRRLKAKPENKMCFDCNAKNPTWASVTYGIFLCLDCSAVHRSLGVHITFVRSTNLDSWTPDQLKMMAFGGNNRAHAFFKQHGWTDGGKVEAKYTSRAAELYRQMLNKEVAKSAITDNALPSSPVTVSEASKPSDDFPEFKLSDAPAPPAENLNGKHEPKSPKSAPRSPKAATHPTFATSVKKPIGAKKVGGKTGGLGVRKLTTKPNESLYEQKPEEPKPAIPALTAPTAKGGPSLHSRFEYVDNEQSSDSRTGGSGSRVTGHVAPPKSSDFFQEYGMGNGFQKKSSNASKAQIEETDEARKKFSNAKANFVIXFFGTQNREEKEAQLSLQKFAGSSSISSSDLFGRTNVDDSNLDLSAADLINRISFQASQDLSSLKDIAGETGKKLTSFASNFISDLDRIL

SEQ ID NO: 6286 - protein, 471 aa, Lycopersicon esculentum
MLKMLSKMAMCKSHGQDSSYFIGWQEYEKNPYDPLQNPSGIIQMGLAENQLSFDLIESWLTRNQDVIQFRENGGSMFRDLALFQDYHGLQAFKNVLVSLMAEIRRKKVKFDPKNLVLTAGSTSANETLIFCLAEPGEALLIPTPYYPGFDRDLKWRTGAEIVPIQCYSSNNFRITESALEEAYEQAQKRNLTVKGVFITNPSNPLGTTMSRNELNILITFAMTKNIHIVSDEIYAGTVFDSPKFVSIIEALIDRKLEKSKMWNQVHIVSSLSKDLGLPGFRVGMIYSNNETLIAAATKMSSFGLISSQTQYLLSKILGDRRFIKRYVKQNKKQLIHRREMLASGLANSGIECLDSNAGLFCFVDMRDLLNSNTFEAEMELWKKIISNVGLNVSPGSSCHCSEPGWFRVCFANMSKETLDLAMQRINNFVNFDRDIHRQQPLRFVTGAGSRRRRTIANWVVKFSSGDGRRDR

SEQ ID NO: 6287 - protein, 337 aa, Thiobacillus denitrificans
MHTGTTLTQFIIEEQRRTAGATGDFTSLLNDVVTACKAISNAVNKGALLGVMGALESENVQGETQKKLDVITNDIMIRSNEWAGHLAGMASEEMDDVYAIPGQYPLGKYLLVFDPLDGSSNVDVNISVGTIFSILKAPVAGRAAKAEDFLQAGTKQVCAGYAIYGSSTMLVLTFGHGTNGFTLDRDVGEFVLTHPAMKIPTETKEFAINASNMRFWEKPVQRYVDECLAGKTGPRGKDFNMRWVASMVAEVHRILTRGGIFMYPKDTKDPSKAGKLRLMYEANPMAFIVEQAGGAATTGYQRILDIAPEGLHQRVPVILGSKTEVDTVTGYHHEKAA

SEQ ID NO: 6288 - protein, 87 aa, Leersia perrieri
KARYVKFHWKPTCGVSCLMDDEATLVGGKNRSHATQDLYDSIAAGNFPEWKLFVQVIDPEEEERFDFDPLDDTKTWPEDEVPLRPVG

SEQ ID NO: 6289 - protein, 342 aa, Bordetella parapertussis
MNLLSPIDIAGIALRNRIAVAPMSRTQADVHGHPAAETAAYYARYARHGAGLVITEALYTAGPAARAYFNQPGLASEAQAEHWRATVRAVHQEGGRVIAQLQHAGKLAEPGLHARPLGPVDGAAQGLSWQTQQPNAPAHAATAEEIERIIEGFALSARLAHYAGFDGVEIHGARGYLVNDFLSAYNVRDDEWGADRARIAEAVLRAVRQSCPLPIGFNYSIYKMDEYRYQPPGSGAEIAALLARLCQAGADILHISSRRVLKPEPWGGLLAQLARAAAPKALMVNGGLATLQDCETALAATQADLVSLARPFLANPDWLARSLAGEPLRAYEPGMEQRPLLD

SEQ ID NO: 6290 - protein, 283 aa, Ralstonia solanacearum
MRRIQHRTQGNAMNDTFTMPAFGLGTFRLTGEAAIDSVRTALELGYRAIDTAQIYANEAEVGQAIAASGVPRRDLFLTTKIWVDNLAADRLIPSLKASLARLRTEQVDLALIHWPSPGGAVPMAEYLGALDEARREGLTRALGVSNFTVALLREAIETVGAAQIATNQIELHPYLQNRKVAAFAQSQGIHVTSYMTLGVGRVLADPVLADIARAHGATPAQVVLAWAMQLGCSVIPSSTRRANLQSNLAARDLRLTGDDMARIGALDRGERIADPAGIAPDWD

SEQ ID NO: 6291 - protein, 764 aa, Anabaena variabilis
MPMTTIAPEQVNRIVWNQHHDPFEILGSHPIEQNGKNVWVVRAYLPNASAAWVVLPEQRQEYAMQTVHDPHFFECIIETSELSNYQLKTKEGEHERVSYDPYAFRSPRLTDFDLHLFAEGNHHRIYEKLGAHFTEVDGVTGVYFAVWAPNARNVSVLGDFNLWDGRKHQMRKGATGVWELFIPEIGVGEHYKYEIKNFAGHIYEKSDPFGFQQEPRPKTASIVSNLNSYNWSDENWLEQRRHTDPLTQPISVYEVHLGSWLHAASAEPAKLPNGETEPVVIASELNPGARFLTYRELASRLIPYVKELGYTHIELLPIAEHPFDGSWGYQVTGYYAPTSRFGTPEDFMYFVDQCHQNNIGVIVDWVPGHFPKDGHGLAFFDGTHLYEHADSRKGEHKEWGTLVFNYSRNEVRNFLVANALFWFDKYHIDGIRVDAVASMLYLDYCRKEGEWLPNQYGGRENLEAADFLRQVNHLLFSYFPGVLSIAEESTDWPMVSWPTYTGGLGFNLKWNMGWMHDMLDYFSMDPWFRQFHQNNVTFSMWYNHSENFMLALSHDEVVHGKSNIIGKMPGDKWQKLANVRCLFAYMFAHPGKKTMFMSMEFGQWSEWNVWADLEWPLLQFEPHQQLKKFFTELNKLYRSEPALYTLDFAREGFDWIDCSDNRHSVVSFIRREKDTENFVVVVCNFTPQPHSHYRIGVPEKGFYTELFNSDARQYGGSNMGNLGGKWTDDWSMHSRPYSLDLCLPPLGVLILKMDKEKTAKASGS

SEQ ID NO: 6292 - protein, 453 aa, Ashbya gossypii
MWRARTMASQEEFYRTQIFGTVFEITNRYADLNPVGMGAFGLVCSAVDTYTQQPVAIKKIMKPFSTAVLAKRTYRELKLLKHLRHENLICLEDIFLSPLEDIYFVTELQGTDLHRLLQTRPLEKQFLQYFLYQILRGLKYVHSAGVIHRDLKPSNILINENCDLKICDFGLARIQDPQMTGYVSTRYYRAPEIMLTWQKYNVEVDIWSAGCIFAEMIEGKPLFPGKDHVHQFSIITDLLGSPPKDVIDTICSENTLKFVTSLPHRDPVPFTERFKNLKPDAVDLLEKMLVFDPKKRITAGDALTHPYLAPYHDPTDEPVADAKFDWNFNDADLPVDTWRVMMYSEILDFHQVPDSQINPNDTFDDQVAAATAAAEAARQQQQQKQQQQKQQQQRHQGVEHGAQHVQLQHGAKQLSADPLVGDSNGGIPLNVSAANETLNNFANQAAQYATDFE

SEQ ID NO: 6293 - protein, 90 aa, Oryza coarctata
RDGKARYVKFHWKPTCGVSCLMDDEATLVGGKNHSHATQDLYDSIAAGNFPEWKLFVQVINPEEEERFDFDPLDDTKTWPEDEVPLRPVG

SEQ ID NO: 6294 - protein, 773 aa, Yarrowia lipolytica
MPNIIWIPFRETQAVDLITGLGDTIEKQLNQPRDKFTADLKTANDLRNNILNPQPNASYLDHLTKYYAQLTYWTTKFPAGCDSLEFMWYGTLAYTANAAPVISQSLHFERCNLLYNLGSLYSQMGVNEGRQDADGLKMSFNYFQMAAGCFQILIENGLPDLESLNMRGLEYDTICCVRDLMLAQAQECFWQRSLLSGSRNSLVAKLAQQVSLLYDSALAWAQKSPQVRSEWVHHMTCKRQHFLAVAHYRMARDALDGCRYGEEIARLKAALNAIKEGTGKGMLRRYLVESVADDLNGIIDVVTEDLKRAEKDNNLIYLQSVPQTTALAPITPALMVKCTPPVELAKPIEFLTKDKLGLPLFVKLTPFAFHQALVLYSQECDKIVSSIESQLKNCTNSKNQALVEMALPGSLDSVEKPKGIPADIIAHSDQIKSERGLETTREAVKDVQRLAATARQELEAAKAVLDDERSEDEMLRRKNNSGWTRFDSKEAGAHLYTRLAELEQYLADAGASDKLVRGKLDEIDYLLSILNSGRSALENYLPSSVSGVRSPEVKRQVPHLRDLLNNLESLEIKRAQYMDRLSLKQQNDDIEPVLEYHMNKLIREKHANLRLTLADFEPITSKELEKYTVDQDWASEQKELQEEVLEKLDVANKDFRSSLDMNDAAIHRENAIQSLEVAYFSYQEQKDHLDAGRNFYNQLLGEISIFHKNCKQFVYERKMEGASLEHELSSMHLSEHEHSGGHSDTSSTPLAAPRAQRASNLSMWSPEDGIRFG

SEQ ID NO: 6295 - protein, 339 aa, Oryza sativa
MKFGAIYEEYLREQQDKYLTKCSHVEYKRLKKVLKKCRVGRSLQEDCPNGDQQEGNNESPDICKCNSCTLCDQMFFTELTKEASEIAGCFSSRVQRLLNLHVPSGFLRYIWRVRQCFIDDQQIMVQEGRMLLNYVTMNAIAIRKILKKYDKIHGSVSGRDFKSKMQTDHIELLQSPWLIELGAFHLNCNSSDIDETVGFLKNEFFKNFSCDLTEARPLMTMAISETMKYEYSLTCPICLDTLFNPYALSCGHLFCKGCACGAASVYIFQGVKSAPPEAKCPVCRSDGVFAHAVHMTELDLLIKTRSKDYWRQRLREERNEMVKQSKEYWDSQAMLSMGI

SEQ ID NO: 6296 - protein, 473 aa, Unknown
  Malus x domestica
MRMLSRNATFNSHGQDSSYFLGWQEYEKNPYHEVHNTNGIIQMGLAENQLCFDLLESWLAKNPEAAAFKKNGESIFAELALFQDYHGLPAFKKAMVDFMAEIRGNKVTFDPNHLVLTAGATSANETFIFCLADPGEAVLIPTPYYPGFDRDLKWRTGVEIVPIHCTSSNGFQITETALEEAYQEAEKRNLRVKGVLVTNPSNPLGTTMTRNELYLLLSFVEDKGIHLISDEIYSGTAFSSPSFISVMEVLKDRNCDENSEVWQRVHVVYSLSKDLGLPGFRVGAIYSNDDMVVAAATKMSSFGLVSSQTQHLLSAMLSDKKLTKNYIAENHKRLKQRQKKLVSGLQKSGISCLNGNAGLFCWVDMRHLLRSNTFEAEMELWKKIVYEVHLNISPGSSCHCTEPGWFRVCFANLPERTLDLAMQRLKAFVGEYYNVPEVNGGSQSSHLSHSRRQSLTKWVSRLSFDDRGPIPGR

SEQ ID NO: 6297 - protein, 488 aa, Arabidopsis thaliana
MRLIVPLRGVIQGRGGLFVGSLIPCCLFYFLQLYLKRRRPPPSDPTDLPRTFSRTNLFSRGNSIGRVRVSSRAVPVAKPSDSPYYIGLERVKTDPYDRITNTDGIIQLGLAESTRWMSENLMESMMQSDDGEFDISSIAMYKPFEGLLELRVAFADFMSRIMGGNVSFDPSNMVITAGGTPAIEVLAFCLADHGNAFLIPTPYYPGFDRDIKFRTGVELIPVHCRSSDNFTVTVSALEQALNQARKRGSKVSGILFSNPSNPVGNILSRETLCDILRFAQEKNIHVISDEIFAGSVYGDKEFVSMAEIAGSGEFDKTRVHIIYGLSKDLSIPGFRAGVIYSFHEDVVNAAKKLMRFSSVPVLVQRILISLLSDVRFIEGYMAAHRQRIRDKHIRFVEGLKQLGIPCAESGGGLYCWVDMSSLLTSYSEKGELELFEKLLTVAKINATPGTACYCIEPGWFRCCFTALADEDIPVIMERIRQLAESFRS

SEQ ID NO: 6298 - protein, 200 aa, Glycine max
MVQSRKFRGVRQRHWGSWVSEIRHPLLKRRVWLGTFETAEEAARAYDEAAILMSGRNAKTNFPVGENQIVGNHSSNTSSSSTTTLSAVLSAKLRKCCKSPSPSLTCLRLDTENSHIGVWQKRAGPRSDSNWIMMVELENKNNDNEGDHHQGPSSSDDSEFPVVVVDVDAQEKVKPEEESTGLDEEQKMALQMIEELLNRN

SEQ ID NO: 6299 - protein, 727 aa, Xylella fastidiosa
MSLRILNSLKVALLTLAITTAPALMAKSDSASPQVATPDQTTATKLVYGLLSDSRYAYRLRPLDETMSKDIFKRYLEALDNNKQFFTEADIDNFSAFKAEIPDSIRNGNLKPAFSIFTVYKKRVAERVTYANQLLKQNFDFSGQEKYEYDRSKAPWPASPQDLDDIWRRSIMNDWLRLKLAGKKPEDIRKTLKKRYANLLKTVNELKGEDVFQLYLNAYTNSIDPHTDYFTPRTADAFNQQMSLSLEGIGAQLQKQEDMVIIREVIPGGPTALDGTLKPGDRIVGVGQGKGGPIEDVIGLRIDDVVSKIRGKKDTQVRLEYIPAESGIDGAHRIVTLTRQKVRLAEQAAKGETITIEGSNGDAQRRIGIIKLPTFYEDFEGRRRNLANYTSATRDVAKLLTNFKTDKVDGVVLDLRNNGGGSLDEAIQLTGLFIEQGPVVQVRESGGRVTVNGDRDDKVTWDGPLAVLINRGSASASEIFAGAIQDYGRGLVIGETSFGKGTVQNIVDLDRWPANESRRFGQVKLTIAQFFRISGSSTQHKGVLPDIAFPASVGATEFGESTYENALPWTRIASLQHTQYGNFSPILSKLKKIHISRTANDIEFKWWQEDVHNFSLEKEKKYVILNEAERLAERRKQETQHRERQTIRKNLGLQLDPLSEESDDGLIGNERDIAKDTAREKLADKRPDPLLHESAAILTDTINLLEKDQILSAQVLLQSTTPGHWAN

SEQ ID NO: 6300 - protein, 131 aa, Zea mays
QSDETWQMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 6301 - protein, 636 aa, Podospora anserina
MLEDPSYNSVVRWSPEGDSFVVLEKFTKTILPKHFKHSNFASFVRQLNKYDFHKVRHNEESGEAPYGRDAWEFKHPEFRADRKDQLDNIRRKAPAPRKPPPTEDAFPASQQIVVLSESLNATNVQIQTLQEQYLELDRTNRLLVAEVLSLQKMLRAQSQASNELISHLNNMEDRRRNSRHSAQSSHSSHSGTNYHQGTLGLLPDGTDEPAPELRRAREILNGVSPDSQADRELERLSMAYHQNGSPAESAGSSVMFTHAGPQTSMNVVHDPFSDPRHLVYPVGQTQGIDPFHADHIHNIPYSRPLSNPNVMTEAPSQISPPPGKEQNGSLWRGKKPQILLVEDDKTCARIGSKFLTNMDCSVETARDGLEAVEKINTDADRFDLVFMDIIMPNLDGVSATAMIRMVTPQIPIIAMTSNIRQEDIQTYFQFAKPFTRDGMVRILKKHLTRMLKDPQSAGVLNDPNDPTSAGNGGGGQQTAGGPGPPTGGYANANMAASMQAAINQAAQVQVKYEQTPIPSPSTTASWHSPGTTMQQVQHQQVQQQQQHASPRLDQGGYMNAVGSGQGVGGMVLTPGGSQRGPGPGQQQQQQYAGYMQAGPGPVTRLPEMGGMGGGAGDDRPEKRQRLYGPGQGGYVG

SEQ ID NO: 6302 - protein, 471 aa, Lycopersicon esculentum
MKLLSDMASCNSHGQDSSYFLGWQEYEKNPYDEIQNPKGIIQMGLAENQLSFDLLESWLAQNPDTAGFKRNGESIFRELALFQDYHGLPDFKNALVQFMSEIRGNKVTFNPNKLVLTAGATSANETLMFCLANPGDAFLLPTPYYPGFDRDLKWRTGAEIVPIQCTSSNGFRITQSALEESYKLAKTRNLRVKGILVTNPSNPLGTTLTRNELELLVSFVAEKGIHLISDEIYSGTVFNSPKFVSVMEVLIENNYMYTEVWDRVHIVYSLSKDLGLPGFRIGAIYSNDAVIVSAATKMSSFGLISSQTQYLLSAMLTDKKFTKKYISENQKRLKKRHAMLVKGLESSGISCLESNAGLFCWVDMRHLLKTNTFEAEIELWKKIVYEVRLNISPGSSCHCTEPGWFRACFANMSEDTLNLAIQRIKSFVDSSDVIGINVDQSNQTNQNTSTSPKKKLFAKWGFRLSFNDRER

SEQ ID NO: 6303 - protein, 75 aa, Zea mays
QSDETWKMGDIVHTLTNRRWLEKCVTYAESHDQALVGDKTIAFWLMDKDMYDFMALDRPSTPTIDRGIALHKMIR

SEQ ID NO: 6304 - protein, 211 aa, Castanea mollissima
MGRGRVEVKRIENKINRQVTFAKRRNGFLKKAYELSVLCDAEVALIIFSNRGKLYEFCSTSSMLKTLERYQKCSYGAVEVNKPGKELEISYREYLKLKARFESLQRTQRHNICWTSFLISKIRNTYLVEANRALTIKLDEISSRNNLRQSWEGGEQSMSYGPQNAHSQSFFQPLDCNPTLQIGYNASGSDQQLSGTTHAQQVNGFIPGWML

SEQ ID NO: 6305 - protein, 200 aa, Arabidopsis thaliana
WAYPEAITVGEDVSGMPTFCIPVQDGGVGFDYRLHMAIADKWIEMLKKRDEDWQMGDIIYTLTNRRWSEKCISYAESHDQALVGDKTIAFWLMDKDMYDFMAVDRPSTPLIDRGIALHKMIRLITMGLGGEGYLNFMGNEFGHPEWLDFPRTHAAPLSRTDTALTTSSALPHTPRHKLRQAAPRRANTQPTGTRAQPDPH

SEQ ID NO: 6306 - protein, 633 aa, Phalaenopsis equestris
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILRTTLVELGRTLDLVECALWMPSRTGLNLQLSHTLNNQIPVGSVVSINLPVVNQVFNSSCAVRIPHTCPLARFQPHTGRYVPPEVVAVRVPLLHLSNFQINDWPELSAKNFAVMVLMLPSDSARKWHVYELELVEVVADQVAVALSHAAILEESMRARDQLMDQNVALDLARREAEMAIRARNDFLAVMNHEMRTPMHAIIALSSLLLETELTPEQRLMVETILKSSNLLATLINDVLDLSKLEDGSFELEVTVFNLHTVFREVVNLIKPIAAVKKLSLIVFLSPDLPSCAVGDEKRLMQTMLNVVGNAVKFTKEGSISITASIAKPDSLRDPRDPEFYPIPSDGHFYLRVQIKDTGCGISPQELPHLFTKFAHAQNGSDKGYNGSGLGLAICKRFVNIMKGHIWPESEGIGKGCTTIFIVKLGISEDPAHRFQHKLLPPIRAGQSEADAFGSKPTPTDLIPLKNRYQRSL

SEQ ID NO: 6307 - protein, 215 aa, Zea mays
PASAHASAHASAHASAHAFAHASAHASAHASAHASAMNALDERFSFLSSSKQIASDMNDEEKVIVFERGDLVFVFNFHPKKTYEGYKVGCDLPGKYRVALDSDALVFGGHGRVGHDVDHFTSPEGVPGVPETNFNNRPNSFKVLSPPRTCVAYYRVDEAGAGRRLHAKAETGKTSPAESIDVKASRASSKEDKEATAGGKKGWKFARQPSDQDTK

SEQ ID NO: 6308 - protein, 471 aa, Clostridium thermocellum
MFPLGYNYIITLFANNILKGVVNMSKITFPKDFIWGSATAAYQIEGAYNEDGKGESIWDRFSHTPGNIADGHTGDVACDHYHRYEEDIKIMKEIGIKSYRFSISWPRIFPEGTGKLNQKGLDFYKRLTNLLLENGIMPAITLYHWDLPQKLQDKGGWKNRDTTDYFTEYSEVIFKNLGDIVPIWFTHNEPGVVSLLGHFLGIHAPGIKDLRTSLEVSHNLLLSHGKAVKLFREMNIDAQIGIALNLSYHYPASEKAEDIEAAELSFSLAGRWYLDPVLKGRYPENALKLYKKKGIELSFPEDDLKLISQPIDFIAFNNYSSEFIKYDPSSESGFSPANSILEKFEKTDMGWIIYPEGLYDLLMLLDRDYGKPNIVISENGAAFKDEIGSNGKIEDTKRIQYLKDYLTQAHRAIQDGVNLKAYYLWSLLDNFEWAYGYNKRFGIVHVNFDTLERKIKDSGYWYKEVIKNNGF

SEQ ID NO: 6309 - protein, 428 aa, Sorghum bicolor
MSISVNGQSVVPPGFRFHPTEEELLTYYLKKKVASERIDLDVIRDVDLNKLEPWDIQEKCRIGSGPQNDWYFFSHKDKKYPTGTRTNRATAAGFWKATGRDKAIYASGARRIGMRKTLVFYKGRAPHGQKSDWIMHEYRLEPALDVDAAAGSASAHHAAAGAAADHHPYYTSSSPPALPTAIRGAAGDQQAAQEQEGWVICRVFKKKNLVHHGQSSGGGVTAAGSKMASAAAPMEGSPSHCSSVTVISDHTMNKHQAQAMLQHSASDDDALDHILQYMGGGGGKQPDTKPVLLDHHHHHHLAAAATTTTTACSAGGAGLYGKFMKLPPLEHAGGGGGLLPSPAGACDYGAADASGIADWDALDRLAAYELNGLSDASKNMSAFFDEPSATAAFSSSSSSVHAAAVDGDLWSLARSVSALHADLTMNNV

SEQ ID NO: 6310 - protein, 370 aa, Bordetella parapertussis
MSTLFQPLNAGKLRLANRIVMAPLTRNRSPNAVPPPLTATYYAQRASAGLIITEATAISHQGQGYADVPGLYAPEQLAGWRRVTDAVHAAGGTIVVQLWHVGRISHTTLQPGQGAPVAPSAIRAQARTYLVDAQGKGQFADTSEPRALALDELPGIVEDYRRAARAAIDHGFDGVELHAANGYLLDQFLRSGSNHRDDAYGGSIENRARLLLQALDAVCAEVGADRVGIRLSPVTPANDAHDDQPQPLFEYVLRELARRGLAYVHVIEGATGGDRAYQQGPAPFDYAALKAAYRAAGGAGAWMVNNGYDASLAEQKLSSGQADLVAFGKPFIANPDLVARLRQGAALNEGDRDTFYGGGERGYTDYPALA

SEQ ID NO: 6311 - protein, 449 aa, Bdellovibrio bacteriovorus
MNQSRGGRNDPEAQRQVQRIFLEQSRDIHIRVDRGFSILLLIQWVAAIVMGILLTPTTWLGSFSGAVENAFVGLIFGGLFSLPAVYCVYVFPGEKWTRYVVAVSQMCFSILFIHLSGGRIETHFHVFVSLAALAFYKDVGLLGVASFIVITDHILRGCLLPISLYGVAESNQWRWLEHAAWILIEDIILIIGIERIRGELHEMAYSKYQLVQAREEALQLSSIKSTFLSNMSHEIRTPLNSIIGFSDILRDTRLDKDQTDYVQTIQRCSDSLLHIINDVLDISKIENGLLQIDRHKFDVKELHTDIFKIFEAKCQEKNLQLEVDIDESIPAFALGDSHRLRQILMNLVGNAVKFTDKGRVCISLQRQPGSGHYVWKVSDTGRGIRLENMSKLFRSFSQEDVSISRTYGGSGLGLMICKNLVEMMGGDIKVESKLGEGTTFHFTLPLEEA

SEQ ID NO: 6312 - protein, 261 aa, Capsicum annuum
MALEALNSPTGTPTPPPFQFESDGQQLRYIENWRKGKRSKRSRSMEHQPTEEEYLALCLIMLARSGGSVNHQRSLPPPAPVMKLHAPSSSSAAEEEKEKMVYKCSVCGKGFGSYQALGGHKASHRKLVPGGDDQSTTSTTTNATGTTTSVNGNGNRSGRTHECSICHKCFPTGQALGGHKRCHYDGGIGNGNANSGVSASVGVTSSEGVGSTVSHRDFDLNIPALPEFWLGFGSGEDEVESPHPAKKSRLCLPPKYELFQH

SEQ ID NO: 6313 - protein, 509 aa, Ralstonia solanacearum
MSFPSRSLRVSLLALAALTAFHAGAVTLTRDNGAPVGDNQNSQTAGPNGPVLLQDVQLIQKLQRFDRERIPERVVHARGTGAHGVFVASKDISDLTRAKVFTPGEETPVFVRFSSVIHSGHSPETLRDPRGFATKFYTREGNWDLVGNNLPVFFIRDAMKFPDMVHSLKPSPDSNVQDPNRFFDFFSHQPESTHMLTRVYTDYGTPTSYREMDGNSVHAYKFVNAKGEVHYVKFHWKSLQGQKGLSAKEVEAIQGKDFNHMTRDLIANIDKGNYPKWDLYIQVLKPEQLAKFDFDPLDATKVWPDVPEVKVGTMTLNKNPENVFQETEQAALAPSNLVPGIEPSEDRLLQGRIFSYADTQLYRVGTNGLQLPVNRPRTSAANYNQDGDLNAGARKGSVNYQPSAHADLSDAATVKYSQLPVSGTTQQQRIARTQNFKQAGDYYRSLTAKEQANLVSNLAGDLGQVKDDGVKYTMLSYFQKADAGYGRALAQAVKADPARVESLAAKLQD

SEQ ID NO: 6314 - protein, 2799 aa, Ustilago maydis
MSIDMTGGAAPTDDDFTKLPIHDRLASKLWKARVSAYEELSKAFPNTSSEDDPIFRQYTRNPDILKSIVVDTNAVAQEKGVDAVRAFVEFGAKPAGSTRELVVPALVEKCLGSTRAGTKNNALQLISFYAEMEDVLGCEPLLADLLDGLKAKQPKVVAGCVTAIMHLVRDFGHKQVSPKPILQRLPDMFAHSDKNVRAEASLLALQLHRYIGAALEPTIDTLKDIQAKELRQQFAEIDAAAASKPLPTRFLLSQREKLQAAAAPISQPGTDAAASISAAQQDHRDDDDDDVDPYDLAEPVNVFGSRDYPADFEEMIVSKKWQERKETLETILKILSSSPKIQPDNRFDGLVDHLALKISKDANINVVLVSCQCLNAMAKGLRDNFARYKDKVVPPIIEKLKEKKPATVEVLAKALDAIFQTVSFSEILEHIFTGIKHKNPAVKTESIRFLVRCLRTTKLAPAKADIKPIGDALVVAMADGSPDVRDAGAAGLGTLMKLIGERPMNIFLDGLDDIKKAKIQDECNTAEVKVKMGAGAGARPPLSSAARPTAPIPASAPSAVTNRAAPPAAVRAKPPSATQAMATGKENQAPRPVARPTPSMAARPIGTRPAAATSSAVSSAPAPARKATPAAAAGSSKVAASATEPVKYRFHPDDAEARAADLIPAAIATQLASSAWKERLAGMTQFNDWLKVEAESVESEIIVRALGKKPGWKESNFQVMAEVYKALQLLANDCPTFSRPSVALSVQPLCDKLGDIKLKTPAGETLVTFAEKTSFGFLLAQALGPLGSLKAPKAIADSVLWVDQTLLEFGTAGVDVRSLIDYLITCLKSANAAVRINATKAIGTLARFLGTALNSFLADLNPQLRTTIEAEIEKAASNPPPAPVRFSDETKAPAGKAAVAGGEDAAGPAAQDNAADEDMLDQLVPRVDLDRLVSAAAIARMGDANWKERKEGLEEVLAVVNANSRLKGNMAELANALKMRCSDSNIMCKSMALDAIAKIATAMNKHFEPQARILAGPVTQVLADAKAPVRASATTALTAIAEQVGAGPLLPGMSTVVEGKTANPMLKQELFGWLAAWFELHPPEKGMDLAPLALPCVQCLDDKLAAVRKASLACLPHIITRAGYKHVMEQANQLKTASKNTAIPLIDAAKIQAQNSARAAGATATAAPAATATVPAPTARVAAVSARTATASPARAAGVGSTSSVAPATSSPRTSAIARPGGIKPPSAVGRSLKAPSSIIARQARLASDSSNGAVPSRNALASANGAASQGAGPGGAMEGSAPLISADTKAKALREKREGKAANWIGADGAPRPELVEVLRQQCDGQLSRGITDSMFSKSHSSEKDYYAALTLLSDFISSPTFAEEQYGLSRQETIERTLANSDLIFKYVSIRLTDNNTSLSLKCLDILEHLVALLSEQQYHMSDYEAACILPCLTAKFGDAKVAFRDRIREIFRKMTFIFPPSKLLTSYLENGLPSKNARVRTECLSEVGYLFSKNGLQVCSPSRTLPVIAKQISDRDANVRTAALSAIGEVYKIIGDEVYKLVGALPGKEMSMLEERLKRTTAPPASVAVAVAKSAGAASTAGRAGPRASVVPSSAPGPSSPGRLSAGAPSSRLARPGSALQQPAAPSAGVRSRLAAPGAARRESAIGLPRAAKPPSVASPRASMLRAPSEAAARATSIIAPGRNKVLADELPEEEDEELSVDQAINLVVNDNFEQSVFAIKHVEAFIQEEEPQLISYVDQIAIVLSKQMQKAFSLDPSDLGNERLRKHLLVANISLFDKDRVWEDGRTLGSYLSRSALIPLLTVLVQQLIQSSFRAEDPSAQNESKYLNIILLRCFSACSLNLLYGACLQMLSEATEDLRELEGDVLETRYEFAKLLIKCLWKIAKRLEDDLSQRKVEPQQLFVDIESFLQTIEPFEWRQRAEDGVPLADVPLRTVKIILSSVVNHFGEEALGMLDMIPQPENSYVYKYLVRMLNFAFGDGGVDEEGDAVGSNAGTRTRTDAKAPSQAVNEADTVVEAQRNIAPEDRGVDKAAVVDEEGDAVGSNAGAGANAPSQAVNAADTVDGAQQNSQNGHAADAAVDEESSIRLAELHAELHEIFKRISDKKLSRQGLQEMYEFRKRYPYLESYIQSLLQTTGPMFQRYIKRVFANYAAEDPDVINAAQPPPVDAYIIALIDTHRTSRQLHSQPVVVHTFAAILLLPSRLLSAEMNVQQSHRIEPGRAVHMMCTCSRAEHRSEDMRPNVQGEHQQYDEHEYDGHGAESKPVQLDQLLQILEHDFTVQLALTLLAQTEAERNFCDIGTVQSDFETLGIDMMIGCVEAVFCDSKESTHGVRGGCERTREHARTGRNDSSMQGPVLVHADTDAVACTEDERLLPVEREQKRGYRLRRMLQVSVHTDHSLAASFAKSSNHSGRKPAFRRAHNDAGRRLRFSRNAGTITEQLGVEDVDHPEDPGCFRILADASMSRAIDIEILDVSAADPSQRPRRRESRTVNRESRIACFVTRGSWFVRAVRTLSECYIASQRMYLFPVSRVVCLFNDSRLYISSPCTLDSPLDCESRIHKTSNSTDQDASYRRDCQLPTQPSARTLYRASLDSVMLRVKDPKISLDFYENVLGMDLIDKHDGGDFTLYFLAYQHQKGITQRGEREAILELTHNHGTENDADFSYHNGNQEPKGFGHLCVAVDDIHKACDRFEKLGVKFQKKLTDGKMKNIAFILDPHTPEAGWLKLTLSLVCLVGATNACSHARACASSVVGNLRNDISSPNRPPQSKSPRPTEDHQCVPALRDPASVLQNVSVA

SEQ ID NO: 6315 - protein, 419 aa, Arabidopsis thaliana
MDSINKNYVDMDEYPVTTELQNRCVNIIARLFNAPLEESETAVGVGTVGSSEAIMLAGLAFKRKWQNKRKAEGKPYDKPNIVTGANVQVCWEKFARYFEVELKEVNLSEGYYVMDPDKAAEMVDENTICVAAILGSTLNGEFEDVKRLNDLLVKKNEETGWNTPIHVDAASGGFIAPFIYPELEWDFRLPLVKSINVSGHKYGLVYAGIGWVVWRAAEDLPEELIFHINYLGADQPTFTLNFSKGSSQIIAQYYQLIRLGFEGYKNVMENCIENMVVLKEGIEKTERFNIVSKDQGVPVVAFSLKDHSFHNEFEISEMLRRFGWIVPAYTMPADAQHITVLRVVIREDFSRTLAERLVADISKVLHELDTLPSKISKKMGIEGIAKNVKEKKMEKEILMEVIVGWRKFVKERKKMNGVC

SEQ ID NO: 6316 - protein, 490 aa, Streptococcus sinensis
RGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIEAAVATAVSALKETAIPVSNKEAIAQVAAVSSRSEKVGEYISEAMEKVGNDGVITIEESKGMETELDVVEGMQFDRGYLSQYMVTDSEKMVADLDNPYILITDKKISNIQEILPLLESILKTNRPLLIIADDVDGEALPTLVLNKIRGTFNVVAVKAPGFGDRRKAMLEDIAILTGGTVITEDLGLELKDATIEALGQASKVTVDKESTVIVEGSGNPEAIANRVVVIKSQIESTTSEFDKEKLQERLAKLSGGVAVIKVGAATETELKEMKLRIEDALNATRAAVEEGIVSGGGTAFVSVLGAVAALELTGDEATGRNIVLRALEEPVRQIALNAGFEGSIVIDRLKNSEAGTGFNAATGEWVNMIEAGIIDPVKVTRSALQNAAQ

SEQ ID NO: 6317 - protein, 450 aa, Kineococcus radiotolerans
MTSVLWFRRDLRLSDHPALLAAAADGDVLPLFVIDPALWGPSGDVRRTYLLRSLRSLDAALGGALVVERGDPAVVVDRVAARIGASRVHVTADAGPLGRRRDDAVGRALAAGGRELVRTGTPYAIGPGTLRTGSGSPFQVFTPFSRAWRAHGWPAPADSPGAVRWVGDGEGVDGGHWPDEPDLGGLTLPEAGEDAAHERWHRFLDHALADYDGDRDRPDRDGTSQLSHALKWGELHPRTLLAALRGQSSKGAETYATELCWRDFYADVLWHRPDSAREYYKPQLAGLRYAEPGEQFRAWAEGRTGFPIVDAGMRQMRAVGWVHNRVRMITASFLVKDLHVEWQHGGREFMHWLRDADLASNMHGWQWVAGSGTDASPFFRVFNPVTQGQRFDPDGDYVRRFVPELRHLPGKSVHTPWEAADGYAHGYPERIVDHAHEREVALAEYARVRG

SEQ ID NO: 6318 - protein, 482 aa, Nicotiana glutinosa
MGFISGNKKLLSKIATSDGHGENSAYFDGWKAYENDPFHLTQNPNGVIQMGLAENQLCFDLIQEWVVNNPKASICTAEGAQDFNDIAIFQDYHGLREFRKAVSRFMEKVRGDKVTFDPDHIVMSGGATGAHETLAFCLADPGDAFLVPTPYYPGFDRDLRWRTGVQLFPVVCESFNNFKITKEALESAYEKAQESNIRVKGLLINNPSNPLGTILDRETLKDILRFINDKNIHLVCDEIYAATVFSQPDFISISEVMQEVNGCNENLVHVVYSLSKDLGFPGFRVGIIYSYNDVVVSCARKMSSFGLVSTQTQFLIASMLSDEIFVENFIAKSSVRLSQRHGFFTKGLAQVGISSLKSNSGLFFWMDLRRLLKESTFEAELDLWHIIINEVKLNVSPGVSFHCSEPGWFRVCFANMDDETMRVALRRIKHFVLQRKGLIEVATKKQCRRRRKREISLSFRRLDDFMNSPHSPMSSPMVQART

SEQ ID NO: 6319 - protein, 435 aa, Saccharomyces cerevisiae
MTTNEEFIGTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 6320 - protein, 490 aa, Gloeobacter violaceus
MIRSLVWFRKGLRLHDNPALLDAARDAARLYPLFIVDPWFVNPERVGVNRMRFLLESLGEIDGNLRRLGSRLIVLQGRPQEVLERVLSRWQIGRLCFERDTEPYARRRDEAIRSMAERVGVRVISPTAHTLYDPDELIELGRGKVPTTYGAFGRLAAKLGEPDAPVASPSHLPPPGELDADYGIPTLAELGYPDPECPSRGIIPPGGEGEGLRRLHVYLSDRQRSAGFAKPDTDPTAFDPPSTTALGAHLKFGCLSARTFYAEVQKVYREVGEHTEPPMSLIGQILWREFFYTVGYATPNYDRIEGNPVCRQIPWDDNPEYLAAWSEARTGFPWIDAAMTQLRTEGWLHHLSRHAVACFLTRGDLWVSWEKGQAVFERLLLDQDWSLNASNWMWLSASAFFNAYYRVYSPISFAKKYDPEGRYVRRYLPKLARVPAEFIYEPWRAPLLVQKQAGCVVGRDYPDPIVDHEQAKACNLERMRLAYEQNAKGG

SEQ ID NO: 6321 - protein, 220 aa, Arabidopsis thaliana
MGQQNLIYSFVARGTVILVEYTEFKGNFTAVAAQCLQKLPSSNNKFTYNCDGHTFNYLVENGFTYCVVAVESVGRQIPMAFLERVKEDFNKRYGGGKATTAQANSLNREFGSKLKEHMQYCVDHPDEISKLAKVKAQVTEVKGVMMENIEKVLDRGEKIELLVDKTENLRSQAQDFRTQGTKIRRKMWFENMKIKLIVLGIIITLILIIILSVCGGFKCT

SEQ ID NO: 6322 - protein, 466 aa, Unknown
  Frankia sp. CcI3
MALHRQASGDRAEETVDVRPHLAPLGEEVVVPRFRMPQESTAPETAYQIVHDELMLDGKARLNMATFVTTWMDSYADRLMAECAPKNMIDKDEYPQTAALEERCVNILADLWHAPDAEHAVGCSTTGSSEACMLAGLAMIRRWRARRRSAGAPADRPNIVMGVNVQVCWEKFARYWDVEARLVPMAPGRTHLTADEAVAHCDENTIGVVAILGSTFDGSYEPVAGIVAALDHLAASGGPDVPVHVDAASGGFIAPFCDPDLVWDFQLDRVVSINTSGHKYGLVYPGVGWVLWRDRAHLPAELVFQVDYLGGTMPTFALNFSRPGAQVVAQYYTLLQLGYKGYRRVAQACRDNARWLAAEVAAMGPFELVSDGSGIPAFAFKLRDDITDYTVFDVSELLRTRGWLVPAYRFPPGLTDLAVLRVVVRHEFSRDLAGLLIADLRRVVNRLAHPGRRTAGDRPGESSFHH

SEQ ID NO: 6323 - protein, 131 aa, Zea mays
  misc_feature (92)..(92): Xaa can be any naturally occurring amino acid
QSDETCKMGDIVHTLTNRRWLEKCVTYVESHDLALVGDKTIAFWLMDKDMYDFVALDRPSTPTIDRGIPLHKMIRLITMGLRGEGYLNFMGXEFGHSEWIHFPRGPKRLTSGKFIPGNNNSYDKCRRRFDV

SEQ ID NO: 6324 - protein, 546 aa, Burkholderia thailandensis
MAAKDVVFGDSARAKMVEGVNILANAVKVTLGPKGRNVVLERSFGGPTVTKDGVSVAKEIELKDKLQNMGAQMVKEVASKTSDNAGDGTTTATVLAQSIVREGMKYVASGMNPMDLKRGIDKAVAAAVEELKKISKPCTTNKEIAQVGSISANSDSSIGDRIAEAMDKVGKEGVITVEDGKSLADELDVVEGMQFDRGYLSPYFINNPDKQVAVLENPFVLLHDKKVSNIRDLLPVLEQVAKAGRPLLIIAEDVEGEALATLVVNNIRGILKTVAVKAPGFGDRRKAMLEDIAILTGGQVIAEETGLTLEKATLAELGQAKRIEVGKENTTIIDGAGEAVNIEARVKQIRTQIEEATSDYDREKLQERVAKLAGGVAVIKVGAATEVEMKEKKARVEDALHATRAAVEEGIVPGGGVALIRARTAIAALTGVNADQNAGIKIVLRAMEEPLRQIVTNGGEEASVVVAAVAAGKGNYGYNAATGEYVDMVEAGVVDPTKVTRTALQNAASVAGLLLTTDAAVAELPKEDAPMPGGMPGGMGGMGMDM

SEQ ID NO: 6325 - protein, 392 aa, Oryza sativa
  misc_feature (213)..(213): Xaa can be any naturally occurring amino acid
SHITNSIRREICTMKLVKHPNVVRLFEVMGSKARIFIVLEYVTGGELFEIIATNGRLKEEEARKYFQQLINAVDYCHSRGVYHRDLKLENLLLDASGNLKVSDFGLSALTEQVKADGLLHTTCGTPNYVAPEVIEDRGYDGAAADIWSCGVILYVLLAGFLPFEDDNIIALYKKISEAQFTCPSWFSTGAKKLITRILDPNPTTRITISQILXRDPWFKKGYKPPVFDEKYETSFDDVDAAFGDSEDRHVKEETEDQPTSMNALELISLNQALNLDNLFEAKKEYKRETRFTSQCPPKEIITKIEEAAKPLGFDIQKKNYKMRMENLKAGRKGNLNVATEVFQVAPSLHVVELKKAKGDTLEFQKFYRTLSTQLKDVVWKCDGEVEGNGAAA

SEQ ID NO: 6326 - protein, 208 aa, Candida albicans
MYFMKKLLSNQDGSRDLITVVAIAHVHANKTLVLNVLKNIMDKYIEYKREFDSNKSVSGQSSKAKLGEFKLYMNQIIKYEEMNYDSNQHIYNYGSTNENNEDGHPADQINPNQLLLANEEVDEVRQLMLENINKLLSRGDKINSLVDQTDRLNTSSSVFQKRAQQIKRKMWFMKTKFLLSITGGVLLILYLFIGSECGFPAFSHCIRN

SEQ ID NO: 6327 - protein, 425 aa, Glycine max
MESGVVAVNNNINNYESKATSTITIKGILSLLMESIDDENCDGGGSKKRVISLGMGDPTLTTLFHTPNVVEEAVADALQSRKFHGYAPTAGLLQARIAIAEYLSRDLPYQLSRDDVFITCGCTQAIDVSVAMLARPGANILLPRPGFPIYELCAAFRGVEVRHYDLLPEKGWEVDLDAVEALADQNTVALAIINPGNPCGNVYSYHHLEKIAETAKRVGTIVISDEVYGHLAFGSKPFVPMGVFGSTVPVLTLGSLSKRWIVPGWRLGWFVTNDPSGTFREPKVVERIKKYFDLLGGPATFLQAAVPQIIANTEEIFFEKTIDNLRHTADICCKEIEDIPCIFCPYKPEGSMAMMVKLNLSLLEDISDDIDFCFKLAKEESVIILPGTAVGLKDWLRITFAADPSALGEGMRRIKSFYQRHARKL

SEQ ID NO: 6328 - protein, 137 aa, Brassica napus
  misc_feature (101)..(101): Xaa can be any naturally occurring amino acid
  misc_feature (128)..(128): Xaa can be any naturally occurring amino acid
MVQTKKFRGVRQRHWGSWVAEIRHPLLKRRIWLGTFETAEEAARAYDEAAVLMSGRNAKTNFPLNNNNTGDTSEGKTDISASSSSSSLSSILSAKLRKCCXSPSPSLTCLRLDTASSHIGVWQKRAGXKSDSSWVMT

SEQ ID NO: 6329 - protein, 483 aa, Streptococcus pneumoniae
MLYFMYRIIERRLSMKKKLVFPNLFWWGAASSGPQTEGQYGKVHENVMDYWFKTHPEDFFDNVGPLVASNFFHTYTEDFHLMKEIGVNSFRTSIQWSRLIKNLETGEPDPKGIAFYNAIIEEAKKNQMDLVMNLHHFDLPVELLQKYGGWESKHVVELFVKFAKTAFTCFGDKVHYWTTFNEPMVIPEAGYLYAFHYPNLKGKGKEAVQVIYNLNLASAKVIQLYRSLELDGKIGIILNLTPAYPRSNSPEDLEASRFTDDFFNKVFLNPAVKGTFPERLVKQLERDGVLWSHTEKELQLMKSNTVDFLGVNYYHPKRVQAQANPEEYQTPWMPDQYFKEYEWPERRMNPYRGWEIFPKAIYDIAMIVKEEYGNIPWFISENGMGVENEARFIDENGVIDDVYRIEFYEEHLRWLHKAIEEGSHCFGYHAWTAFDCWSWNNAYKNRYGFISVDLETQKRTIKSSGRWYRKVSDNNGFEVEIEE

SEQ ID NO: 6330 - protein, 250 aa, Unknown
  x Aranda deborah
MGRGRVELKMIENKINRQVTFAKRRKRLLKKAYELSVLCDAEVALIIFSNRGKLYEFCSSTSMLKTLEKYQKCNFGSPESTIISRETQSSQQEYLKLKNRVEALQRSQRNLLGEDLGPLGSKELEQLERQLDSSLRQIRSTRTQFMLDQLADLQRREQMLCEANKTLKRRFEESSQANQQQVWDPSNTHAVGYGRQPAQHHGEAFYHPLECEPTLQIGYHSDITMATATASTVNNYMPPGWLGQISGSYE

SEQ ID NO: 6331 - protein, 601 aa, Mycobacterium avium
MCGVTGEVRLDGRAPDVAAVSAMAAVLTPRGPDAGGAWSQGRVALGHRRLKIIDLTEAGAQPMVDSELGLSIAWNGCIYNYKELRSELSGYGYRFFSHSDTEVLIKAYHRWGDDFVSHLFGMFAFAIVERDSGRVLLGRDRLGIKPLYLTEDSHRVRFASTLPALLAGGGVDTRIDPVALHHYMSFHSVVPAPATILRGVRKVPPASLVAIEPDGKRTVTTYWAPDFTRHADRADWSERDWEDAVLSTLRLAVKRRLVADVPVGCLLSGGVDSSLIVGLLAEAGQHGLSTFSIGFESAGGVKGDEFQYSDIVAQRFETNHHQIRIDSDRMLPALDGAIGAMSEPMVSHDCVAFYLLSQEVARHVKVVQSGQGADEVFAGYHWYPPMGEPAAATLDGAVAQYRRAFFDRDTAGVAQLVGPGILAPGDPSLRFVTEHFAQAGAETGIDRALRLDTTVMLIDDPVKRVDNMTMAWGLEGRVPFLDHELVELAATCPPEYKIAHEGKGVLKQAARRVIPSEVIDRPKGYFPVPALTHLEGPYLDMDRDALYAPTAKERGLFNTDAVDALLANPNGKLTPLRGNELWQIALLELWLQRHGVTGPVA

SEQ ID NO: 6332 - protein, 447 aa, Bacillus halodurans
MSIIQFPKEMKWGVATASYQIEGAINAGGRGASIWDVFAKTPGKVKNGDNGDVACDSYHRYEEDIEIMKDLGVDMYRFSVAWPRIFPNGTGEVSREGLDYYHRLVDRLTENGIQPMCTLYHWDLPQALQEKGGWDNRDTIDAFVRYAEVMFKEFGDKINHWITFNELWCVSFLSNYIGVHAPGNTDLQLATNVAHHLLVAHGKAVQSYRKMGLDGQIGYAPNVEWNEPFSNQMEDAEACKRGNGWFIEWFMDPVFKGAYPSFLVEWFEKKGITVPIEAGDMETIQQPIDFLGINYYTGSVARYKENEGLFDLEKVDAGYEKTDIGWNIYPEGFYKVLYYITEQYGQIPIYITENGSCYNDEPVNGQVKDEGRIRYLSQHLTALKRSMESGVNIKGYMAWSLLDNFEWAEGYSMRFGIVHVNYRTLERTKKDSFYWYKQMIANQFFEL

SEQ ID NO: 6333 - protein, 476 aa, Bacillus cereus
MQNKIIVMFQKDFRLYDNPALFKATQSGEVVPVYVHDETFSMGSASKWWLHHAIIDVKKQLEALGSTLIIRKGSTEEEILSLIEQLGITAVYWNICYDPDRLQFNQNMKMMLEDKGITCKEFNSHLLLEPWMIKKKDNTEYKVFTPFYNAFQKQVISKPISKVQSIKWGSSLPESLSVTELHLLPTIPWTSHIESIWDPTEEGAYKTCKKFFSSKLASYSEGRDFPNQNAHSMLAPYLSFGQISVRWMYHYLINKSTERQCSLFEKQVNSFIRQLIWREFSYYLLYHYPFTVYKPLNKNFEHFPWNNEEELLTVWQKGETGYPFIDAGMRELWQTGFMHNRARMAVASFLVKHLLIPWQEGAKWFMDTLLDADIANNTMGWQWVAGSGADASPYFRIFNPITQGEKFDKDGEYIRKWVPELKDMPNKYIHKPWEAPEHILQKANIKLGDTYPLPVVDHKAARERALCAYKSMKEFV

SEQ ID NO: 6334 - protein, 154 aa, Carica papaya
MSLIPSFFGNRGSSIFDPSSLDVWDPFKDFPFPSSSISRENSAFVNTSVDWEETPEAHVFRADLPGLKKEEVKVELEDDRVLQISGERHVEKEDKNDTWHRVERSSGKFSRRFRLPENVKMDQVKASMENGVLTVTVPKAEAKKPDVKAIEISG

SEQ ID NO: 6335 - protein, 375 aa, Unknown
  Shewanella sp. MR-4
MRILETIMNKPPIIWLNVTLFSLTFLSAIILVPWYGLAHGYGASEWIAFVVLAFASGLSITAGYHRLWSHKAYKAHPAVRFLYALGGALALQNSALHWASDHRVHHKHVDDNDKDPYSANMGFWYSHIGWMLREYQAQRYHDYQNVRDLQNDRIVMWQHKHYLALVILMNIGLPALLGWFTGNIAGMLLMAGLLRLVVVHHCTFFINSLAHVWGSQPYTDKNTARDNGFLAMLTYGEGYHNFHHIFENDYRNGIKWWHYDPTKWLIKALSWVGLATDLRTSPQERIESARLQMQLLHAKNKVIHLPNADEIIEKIQQEYELMKEHLLEYYQAKKALLEAKRKQLVDQQLLLQVEELKTRFLTQQKSWKSLTASYS

SEQ ID NO: 6336 - protein, 447 aa, Arabidopsis thaliana
MSGSRRKATPASRTRVGNYEMGRTLGEGSFAKAKYAKNTVTGDQAAIKILDREKVFRHKMVEQLKREISTMKLIKHPNVVEIIEVMASKTKIYIVLELVNGGELFDKIAQQGRLKEDEARRYFQQLINAVDYCHSRGVYHRDLKPENLILDANGVLKVSDFGLSAFSRQVREDGLLHTACGTPNYVAPEVLSDKGYDGAAADVWSCGVILFVLMAGYLPFDEPNLMTLYKRICKAEFSCPPWFSQGAKRVIKRILEPNPITRISIAELLEDEWFKKGYKPPSFDQDDEDITIDDVDAAFSNSKECLVTEKKEKPVSMNAFELISSSSEFSLENLFEKQAQLVKKETRFTSQRSASEIMSKMEETAKPLGFNVRKDNYKIKMKGDKSGRKGQLSVATEVFEVAPSLHVVELRKTGGDTLEFHKFYKNFSSGLKDVVWNTDAAAEEQKQ

SEQ ID NO: 6337 - protein, 416 aa, Arabidopsis thaliana
MGLFGTKKIGKYEIGRTIGEGNFAKVKLGYDTTNGTYVAVKIIDKALVIQKGLESQVKREIRTMKLLNHPNIVQIHEVIGTKTKICIVMEYVSGGQLSDRLGRQKMKESDARKLFQQLIDAVDCCHNRGVYHRDLKPQNLLLDSKGNLKVSDFGLSAVPKSGDMLSTACGSPCYIAPELIMNKGYSGAAVDVWSCGVILFELLAGYPPFDDHTLPVLYKKILRADYTFPPGFTGEQKRLIFNILDPNPLSRITLAEIIIKDSWFKIGYTPVYHQLSDSIKDNVAEINAATASSNFINAFQIIAMSSDLDLSGLFEENDDKRYKTRIGSKNTAQETIKKIEAAATYVSLSVERIKHFKVKIQPKEIRSRSSYDLLSAEVIEVTPTNCVIEISKSAGELRLYMEFCQSLSSLLTAEVS

SEQ ID NO: 6338 - protein, 150 aa, Zea mays
  misc_feature (121)..(121): Xaa can be any naturally occurring amino acid
  misc_feature (134)..(134): Xaa can be any naturally occurring amino acid
HLYHPQHILYRQKEQFSDGVGYNWIDGLKSFTEQQVTDEMMNNAAQMFPYNTPVNKEAYYYRMIFERLFPQDSARETVPWGPSIACSTPAAIEWVEQWKASNDPSGRFISSHDSAATDHTXAVSRRWPTAAATXANGTVNGKDVAVAIAV

SEQ ID NO: 6339 - protein, 204 aa, Triticum aestivum
  misc_feature (127)..(127): Xaa can be any naturally occurring amino acid
MVQSKKKFRGVRQRHWGSWVSEIRHPLLKRRVWLGTFETAEEAARAYDEAAILMSGRNAKTNFPVPRSANGEIIVAPAVARDGRGGVGSSSSGAAGASSLSQILRAKLRKCCKTPSPYPSPASDLDXPKKSTLGVWQKARGAPAPNSKLGHEPSRLNKEAGRTAGGPPQRPNGQPRGPGNSFGPSHEHPPPTGLPRSVRPTGRD

SEQ ID NO: 6340 - protein, 155 aa, Codonopsis lanceolata
MALIPSIFGGRRSNVFDPFSHDIWDPFQGLSSALANARDQETAAIANTRIDWKETPEAHVFKADLPGLKKEEIKVEVEDGRVLQISGERSKEQEEKTDTWHRVERSVGKFHRRFRLPENAKVDQVTASMENGVLTVTVPKKEEKEPEVKAIDISG

SEQ ID NO: 6341 - protein, 187 aa, Arabidopsis thaliana
MALISDELYKSMERICKGNYVKVDSLNTKCYKLIKDYQKCIHKLNKYHILLPDCDITSPDCFLYRYTLITFWANNKSVREALQVNKGSIGKWVQCNYKNISYNYDIKSSVAYHMKNSIDGYRSLIYNGDHDMMVPFLATQAWIRSLNYSITDDWKPWMINDQIAGYTRSYSNKMTFATIKASLLVST

SEQ ID NO: 6342 - protein, 547 aa, Escherichia coli
AAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEAALHATRAAVEEGVVAGGGVALIRVASKLADLRGQNADQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 6343 - protein, 368 aa, Saccharomyces cerevisiae
MARTITFDIPSQYKLVDLIGEGAYGTVCSAIHKPSGIKVAIKKIQPFSKKLFVTRTIREIKLLRYFHEHENIISILDKVRPVSIDKLNAVYLVEELMETDLQKVINNQNSGFSTLSDDHVQYFTYQILRALKSIHSAQVIHRDIKPSNLLLNSNCDLKVCDFGLARCLASSSDSRETLVGFMTEYVATRWYRAPEIMLTFQEYTTAMDIWSCGCILAEMVSGKPLFPGRDYHHQLWLILEVLGTPSFEDFNQIKSKRAKEYIANLPMRPPLPWETVWSKTDLNPDMIDLLDKMLQFNPDKRISAAEALRHPYLAMYHDPSDEPEYPPLNLDDEFWKLDNKIMRPEEEEEVPIEMLKDMLYDELMKTME

SEQ ID NO: 6344 - protein, 131 aa, Zea mays
LSDEAWKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 6345 - protein, 785 aa, Candida albicans
MNTNLLFIPLKQSSVLDLGDELRQVITNNYFQPASSFNSDLIYITQLRNQVAQIKNVNDELGKTSQDDSILLEYLQVLNTLQNKFSDDCVEFAWFDTLAYGPQGPYRYRSLKIEKLNVIYQIGSLYSQIAISESRHTDIGLKRACHYFQLSAGCFMFINNFLIETIKNKNDPLVLSIPLSMQSSTIQCLEYLMLAQAQETIWQKAINNNSMKDSVVARLSIQTSEYYSKALDFGNSSDLIKLEWINHMKVKKLHFLAAAHLRSSTIAADSFQYGEQVAHLRVASQAVDQALKSKKYVNSLVLEDLQGLADVIKVRLRTAEKDNDLVYLKIVPQEKELKTIIGVSMVKSIIPEAFEQKPESNTEIFKELLPYVIIHVAQAMRERQDEYVQTKFHTPISSLNNMLVKFLIDRDLPSSIDSIQQPENIPDSVIHHSQEILKTGGVDFIDKAFKELDKLKLECNHLLQECETRIDLDRSEDDMLRRKQGSTRWTRKSTDDAAQELIKKVDKMKQYLLQANNGDGFVLKKFYDIKPALDVYSSGYKALSQYIPNSQYIELPEQLSIVISDLRSCLARANTLESERKEFLQTLEIRSRDNSILPKLITEYNSNRSKYQTENGEFNFNAFESVYEKHMKLFDSDIKYIARTRDSQMTLEHEIDSINQKFVQEFKSLQNSSNEKRQQVLQYLETAYEKFLEIINNLTEGSKFYTDFIEKGSAVLQECEEYLYRRRVESRDLELAISNSFQQQQQVQEQNEQLSVPRNYSNDKLISPKTSKPGLWNPNSDIQFS

SEQ ID NO: 6346 - protein, 78 aa, Triticum aestivum
MVGFFRSGNLASRVFDRQFLSPRPGATVNTVRQFYENLVPSYTIYDIDCPRLFVFASSTDEWESYPCGPLSPKTNQRF

SEQ ID NO: 6347 - protein, 157 aa, Brassica napus
MMDGVTGGDSKSGEATTAPPLRNPHPATLLGANALPPPFLSKTYDMVEDPASDAIVSWSPANNSFVVWDPPEFSRSLLPRYFKHNNFSSFVRQLNTYGFRKVDPDRWEFANEGFLRGQKHLLKTISRRKSTHGHGTSSSNTQSHQGSHGFVIFMRRG

SEQ ID NO: 6348 - protein, 131 aa, Zea mays
LSDETWKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 6349 - protein, 393 aa, Nicotiana benthamiana
MDGSGQQSDTMMSDAGAEQPPPAAQPVAGMDNIPATLSHGGRFIQYNIFGNIFEVTAKYKPPILPIGRGAYGIVCSALNSETIENVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVHPDAIDLVETMLTFDPRRRITVEGALAHPYLNSLHDISDEPICMTPFSFDFEQHALTEEQMKELIYRESLAFNPEYQHM

SEQ ID NO: 6350 - protein, 285 aa, Lactobacillus gasseri
MNFHSIEDTYTLNNGVEIPIIGFGTWQTPDGDIAKHAVEVALNAGYRHIDTAAAYGNEKSVGQAIKKSGINRHDLFITTKLWNADHGYQSTKAAIDRSLQNLKVDYLDLYLIHWPNPVAMRDHWAEANAESWRAMEEAVQAGKIRAIGVSNFRKRHLDELLKTAEIKPVVNQIMLNPSDLQSDVVKVNNKLGLLSEAYSPLGTGGLLGNETVKEIASEVGKSPAQVLIRWSLEHGFLPLPKSVHDKYIQANVEVFDFNLNSEQMNKLDSLHGVSGLATDPDTANF

SEQ ID NO: 6351 - protein, 117 aa, Zea mays
  misc_feature (27)..(27): Xaa can be any naturally occurring amino acid
RKHRIVSLVSALLILLALAVSSTRNAXDVPGSENDLHLQELARFAVDEHNKKANALLGFEKLVKAKTQVVAGTMYYLTIEVKDGEVKKLYEAKVWEKPWEKFKELQEFKPVEEGASA

SEQ ID NO: 6352 - protein, 206 aa, Oryza sativa
MASRRRTLLKVIILGDTGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDSGNSRVVSEKKAKAWCASKGNIPYFETSAKDGTNVEEAFQCIVKNALKNEPEEELYVPDTVDVVGGNRAPRSSGCC

SEQ ID NO: 6353 - protein, 608 aa, Ashbya gossypii
MSNANHHHQQQKMYTGGRNMPHGMHRPGSIPIGQRIGKYQVIKTLGEGSFGKVKLAHHVSTGQKVALKIINKKVLAKSDMQGRIEREISYLRLLRHPHIIKLYDVIKSKDEIIMVIEYAGNELFDYIVQRDKMSENEARRFFQQIISAVEYCHRHKIVHRDLKPENLLLDEHLNVKIADFGLSNIMTDGNFLKTSCGSPNYAAPEVISGKLYAGPEVDVWSSGVILYVMLCRRLPFDDESIPVLFKNISNGVYSIPKFLSQGAANLIKRMLIVNPLNRITIHEIMEDEWFKVDLPDYLVPVDMKADATSKPGTDDERIDEALVAVLANTMSYDKDEIYEALEDPNQTDPTVLEIRDAYLLLKENKSLIDGLRSNKQKLDQLDTFLSQSPPTFESHSQLGPGSGFQAALGGSQHGDQNPHQVKRLASRQRTYQLSFSEQQDEDSTIAILPSSLPQIHRANMVAQGSPAAVKISPLSNKKSKTRWHFGIRSRSYPLDVMGEIYLALKNLGAEWAKPSEEDLWTIRVRWKYDVGTQQNERIPDLMRMVIQLFQIETNNYLVDFKFDGWESSSGNPISSSSTDDEMSTFSAYPFLHLTTRLIMELAVNSQSS

SEQ ID NO: 6354 - protein, 433 aa, Neisseria meningitidis
MPSETARPLYADTCAAHTLVWFRQNLRIRDNAALCAAVAEGLPVIGIWIDDAETDNPRRAAFYRQSAAELAQGLAGRGIPLYTAASPAELVRLAVRLNIRAVIADESHTFADKLADNALWHELNKHGIALTFVNDRAVFGKTDLIPDGGTAHTDFDRYREVWLDRFSKQPPAGPDLFAAYRQPFPENLSAPPPAALSDGIFLPQNSGETAAWRQWRRFLEQADSYSVLKDFPSRKHTSLMGAYLSAGCISPRLLARESLERRLNAWADNIIRRDFFLQLALQHTDDDPSDGNPEHTLRLTLWQQGRTGIPIIDAAMRCLHKTGSLHPALRRLSADFFCHVLNLPRREGEIWFARQLTDFDAAINQGNWRLAASRHTCPDIAAAAHKTDPDGTFVRRHIPELAHLSADTVHTPWRFACSVDTHGYPAHPVAGIP

SEQ ID NO: 6355 - protein, 229 aa, Unknown
  uncultured Pseudomonas sp.
HFNRENIPERRVHAKGSGAFGTFTVTKDITQYTSAKLFESVGKQTPTFLRFSTVGGERGSADTERDPRGFALKFYTEEGNWDIVGNNTPVFFIRDPLKFPDFIHTQKRLPQSNLKSAQMMWDFWSHSPEALHQVTILFSDRGIPDGYRHMHGFGSHTYSLINAQGERHWVKWHYKTKQGIKNLAPAEAARLAGTDPDYAQRDLFGAIERGDFPKWRVCIQIMTEAQANA

SEQ ID NO: 6356 - protein, 265 aa, Triticum aestivum
  misc_feature (58)..(58): Xaa can be any naturally occurring amino acid
  misc_feature (66)..(66): Xaa can be any naturally occurring amino acid
  misc_feature (92)..(92): Xaa can be any naturally occurring amino acid
MSSSAMEALHALIPEQHQRDVEAAAALSGATSGEEGGHVLQGWAKRNRSPPQRSEEEXNLALCLLXMLSRGGKAARAGPPSPRRSLAPVPAXEFKCSVCGKSFSSYQALGGHKTSHRVKQPSPPADPAAAPLVALPAVAAVLPSAEPATSSTAASSDGTTNRVHRCSICHKEFPTGQALGGHKRKHYDGGVGAAASSTELLAAAAAESEVGSTGYGSSAARAFDLNIPAVPEFVWRPCAKGKMMWEDDEEVQSPLAFKKPRLLTA

SEQ ID NO: 6357 - protein, 190 aa, Anthoceros punctatus
DEHGEVVAEIRRSDLEPYLGLHYPATDIPQASRFLFMKNRVRMIADCFSPPVKVIQSKDLPQPVSLAGSTLRAPHGCHAQYMGNMGSIASLVMAVVINDNDEDFNGRGYQQKGRKLWGLVVCHHTTPRAVPFPLRSACEFLMQVFGLQLNMEVELAAQMREKHILRTQTLLCDMLLRDAPIGIVTQSPNI

SEQ ID NO: 6358 - protein, 516 aa, Methanocaldococcus jannaschii
MMCGINGIIRFGKEVIKEEINKMNKAIKHRGPDDEGIFIYNFKNYSIGLGHVRLAILDLSEKGHQPMGYNVDEDKIIYRDDELDRADIIIVYNGEIYNYLELKEKFNLETETGTDTEVILKLYNKLGFDCVKEFNGMWAFCIFDKKKGLIFCSRDRLGVKPFYYYWDGNEFIFSSELKGILAVKEINKKENINKDAVELYFALGFIPSPYSIYKNTFKLEARQNLIFDLDKREIRKYYYWELPDYKPIYDKKKLIEEGKKLLYDAVKIRMRSDVPVGAFLSGGLDSSTVVGVMREFTDLSKLHTFSIGFEGKYDETPYIKIVVDYFKTQHHHYYFKERDFEELIDKYSWIYDEPFGDYSGFPTYKVSEMARKFVTVVLSGDGGDEVFGGYMTHLNGYRMDFIRKLPKFLRVVGSKLPVKKDLNGIANLYLLKEAFRLSLINPEEFYAESIKEDAIRPEIYKKWTIEKLRYCLNKGDNKLGEALRIFDLLFNTLCDNFLVKVDRASMLTLWKLEVHF

SEQ ID NO: 6359 - protein, 204 aa, Triticum aestivum
HEAFPTPPRSANHRLLLPPPFSPLRSSPPARAFFIRVSGRGMADDDSGSPRGGGGVREQDRFLPIANISRIMKKAVPANGKIAKDAKETLQECVSEFISFVTSEASDKCQKEKRKTINGDDLLWAMATLGFEEYVDPLKIYLQKYRDMEGDSKLTSKSGEGSVKKDIIGAHSGATSSNAQAMVQHGAYAQGMGYMQPQYHNGDT

SEQ ID NO: 6360 - protein, 154 aa, Zea mays
MSLVRRGSVFDPFSVDLFDPFDSVFRSIVPSSSSAAAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 6361 - protein, 91 aa, Quercus suber
MSLVPNFFNRRSNVFDPFSLDVWDPFEGFPPLSSHSNFPSETSSFAAAKLDWKETPNAHVFADVPGQKKEEVKVEIEDRRVLQISGERSQD

SEQ ID NO: 6362 - protein, 437 aa, Triticum aestivum
  misc_feature (92)..(92): Xaa can be any naturally occurring amino acid
MPSASSAVPSAAAPGDESQSLAAPKLLLGRYELGGLLGRGASAKVYRARDILTGRDVAIKSFPNPRAGAREGEGSAGSAAIEREAAILSRLXRHRHVVRLHEILGTRKKVHFVLDLAAGGELFSLVDSDGRMTEDLARHYFRQLVSAVRYCHSRGVYHRDIKPENLLLDGDGDLKVADFGLGAIADESLHHTLCGTPAYVAPEILSKQGYHPAKVDIWSCGVVLFVLAAGYLPFNDASLINMYRKIYAGRFRCPNWFSPALRHLLRRILDPNPSTRIDTDGIMEHPWFRHGASGDGELEELMRGHEEEAWFKTEFKEDMARDMTAFDILAFSPGSDLSGLFGAGPGTERVFVGEPAAAVLARVEDAGKKQGHRVRREGKGRAGPVYVEAEAGGIVAKVTVFRIADAVSVVEVVKGHGAEAAAFWSDWLEPAVKPQAV

SEQ ID NO: 6363 - protein, 128 aa, Zea mays
QSDETRKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRR

SEQ ID NO: 6364 - protein, 131 aa, Zea mays
QSDETWKMSDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 6365 - protein, 270 aa, Spirulina platensis
MTIATETKLKLDWMTIVFMAFLHIGALFVLVPSNFSWAAVGLALFLHWVTGGLGITLGFHRLITHRSFETPKWLEYFLAFCGTLACQGGPIQWVGLHRMHHLYSDQTLDPHDSNKGFWWSHMGWMLREIPADADVPRFTKDINEDPVYLFLQNYFIPIQVALGVVLYLLGGWPLVVWGIFFRIVVVFHCTWFVNSATHKFGYQTYQSNDNSKNCWWVALVTYGEGWHNNHHAFQYSARHGLKWWEIDLTWMTIQLLQFLGLAKKVKLVEN

SEQ ID NO: 6366 - protein, 234 aa, Solanum tuberosum
MAREKIKIKKIDNITARQVTFSKRRRGLFKKAEELSVLCDADVALIIFSSTGKLFDFASTSMKDILGKYKLQSASLEKVDEPSLDLQLENSLNMRLSKQVADKTRELRQMRGEELEGLSLEELQQIEKRLEAGFNRVLEIKGTRIMDEITNLQRKGAELMEENKQLKHKMEIMKGKLPLLTDMVMEEGQSSESIITTNNPDQDDSSNASLKLGGTTAVEDDCSITSLKLGLPFS

SEQ ID NO: 6367 - protein, 467 aa, Listeria monocytogenes
MLYSEDDKRKQESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKDMSYLGTSTVGSSEACMLGGLAMKFRWRNNAEKRGLDIQAKRPNLIISSGYQVCWEKFCVYWDVDMRVVPMDKNHLSLDVDKVFDLVDEYTIGVVGILGITYTGKFDDIQLLDEKVEAYNATNEHQLVIHIDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTALYLAKTVEKSGYFEIINDGANLPIVCYKMKEGLDVEWTLYDLADQLLMKGWQVPAYPLPADLSDTIIQRFVCRADLGYNVAEEFAADFADAIHNLEHARVLYHDKERNDSYGFTH

SEQ ID NO: 6368 - protein, 544 aa, Bacillus cereus
MAKDIKFSEEARRSMLRGVDTLANAVKVTLGPKGRNVVLEKKFGSPLITNDGVTIAKEIELEDAFENMGAKLVAEVASKTNDVAGDGTTTATVLAQAMIREGLKNVTAGANPMGLRKGIEKAVTAAIEELKTISKPIEGKSSIAQVAAISAADEEVGQLIAEAMERVGNDGVITLEESKGFTTELDVVEGMQFDRGYASPYMITDSDKMEAVLDNPYILITDKKISNIQEILPVLEQVVQQGKPLLIIAEDVEGEALATLVVNKLRGTFNVVAVKAPGFGDRRKAMLEDIAILTGGEVITEELGRDLKSATVESLGRAGKVVVTKENTTVVEGVGSTEQIEARIGQIRAQLEETTSEFDREKLQERLAKLAGGVPVIKVGAATETELKERKLRIEDALNSTRAAVEEGIVAGGGTSLMNVYTKVASIVAEGDEATGINIVLRALEEPVRQIAINAGLEGSVVVERLKGEKVGVGFNAATGEWVNMLESGIVDPAKVTRSALQNAASVAAMFLTTEAVVADKPEPNAPAMPDMGGMGMGGMGGMM

SEQ ID NO: 6369 - protein, 455 aa, Arabidopsis thaliana
MMMNRDILFHQQQQQQMEENMSNLTSASGDQASVSSGNRTETSGSNINQHHQEQCFVPQSSLKRKRNQPGNPDPEAEVMALSPKTLMATNRFICEVCNKGFQRDQNLQLHKRGHNLPWKLKQRSNKDVVRKKVYVCPEPGCVHHHPSRALGDLTGIKKHFFRKHGEKKWKCEKCSKKYAVQSDWKAHAKTCGTKEYKCDCGTLFSRRDSFITHRAFCDALAEESARAMPNPIMIQASNSPHHHHHQTQQNIGFSSSSQNIISNSNLHGPMKQEESQHHYQNIPPWLISSNPNPNGNNGNLFPPVASSVNTGRSSFPHPSPAMSATALLQKAAQMGSTKSTTPEEEERSSRSSYNNLITTTMAAMMTSPPEPGFGFQDYYMMNHQHHGGGEAFNGGFVPGEEKNDVVDDGGGETRDFLGLRSLMSHNEILSFANNLGNCLNTSATEQQQQQHSHQD

SEQ ID NO: 6370 - protein, 76 aa, Zea mays
LSDETWKMGDIVHTLTNRRWLEKCVTYAESHDQALVGDKTIAFWLMDKDMYDFMALDRPSTPTIDRGIALHKMIRL

SEQ ID NO: 6371 - protein, 221 aa, Solanum tuberosum
MVRQKIQIKKIDNLTARQVTFSKRRRGLFKKAQELSTLCDADIGLIVFSATGKLFEYSSSSMMQLIEKHKMQSERDSMDNPEQLHSSNLLSEKKTHAMLSRDFVEKNRELRQLHGEELQGLGLDDLMKLEKLVEGGISRVLRIKGDKFMKEISSLKKKEAQLQEENSQLKQQSQARLNEEGQNVIEQGHSADSITNNRSLVNSHQDYNDSDTSLKLCLAFP

SEQ ID NO: 6372 - protein, 227 aa, Momordica charantia
MGRGKIEIKRIENTTNRQVTFCKRRNGLLKKAYELSVLCDAEVALIVFSSRGRLYEYSNNSIKTTIGRYKKACSDSSATSSVTELNTQYYQQESAKLRQQIQMLQNSNSNLVRHLMGDSLSALTVKELKQLENRLERGITRIRSKKHEMLLAEIEYLQKREIELENENVCIRTKIAEVERLQQANMVSGQELNAIQALASRNFFTPNMMEGGAVTFSHQDKKMLHLG

SEQ ID NO: 6373 - protein, 676 aa, Ralstonia eutropha
MDQYPRLMAPLSVAGITLRNRIVMGAMHTRLETLDRPHERLAAFYGARARGEAGLILTGGYAPNPAGVFEPGAPLLCERSQLAEHRAITGAVHAAGGHIALQIVHAGRYAKHHLCVGPSAERARINPIAPRELTTEEVWQTIEDFANTAELAWEGGYDGVEIMGSEGYLINQFTAPFTNQRTDEFGGSFEARIRFPLEVLKAIRRRVVDRFLVVYRISAVDLIEGGMTGAEVAELARRVEANGADIINTGVGWHESAVPTIAASVPRSAWAYAIENVKRAVDIPVIASNRINTPDGAEALLSSGCADMVSMARPLLADPDFARKTRVGKAAEINTCIACNQACLDRIFTDRTATCLVNPRAGREIEFMPKPPEGTKRIAVVGGGPAGMSFAINASERGHRVTLFEAGNELGGQLNMARVVPGKNEFNEMLRYFRTRLDGLGVTVHLGRFVKAGELLEAGFDTIVIATGVRPRSPGFPGVDHPKVLSYVDVLARGAAVGQRVAIIGAGGIGFDVAEFLLGDAEESLDPASFLATWGVDPSLSTSGGLSESAETAAPAHARREVHMFQRKPEALGKRLGKSTGWILKSRLKRANVAMASGAVYERVDDDGLHYTIDGKTHVLQVDNVILCAGQESERGLYEALRSSGANVHVIGGADVASELDALRAIDQATRLAMTV

SEQ ID NO: 6374 - protein, 153 aa, Funaria hygrometrica
MALSLFGGRGSSILDPFEFGSVWDPFSVLENGPSRRFASDAHAVANTRIDWRETPEAHVFKADLPGLKKEEVKVQVVEGRTLEISGERKKEEVQKGDTWHRVERAQGSFMRRFRLPEGTNVDEVKAQVQDGVLTVTIPKLQKPKPQVRQIEIA

SEQ ID NO: 6375 - protein, 521 aa, Ashbya gossypii
MAIGMLRRNSSGTAVSVLQGRVLRTRRLSSVKDGSRFVPAEPMTLADVNENVVKAKYAVRGKIPTRAEELERRLEEHPGSLPFSKIIQANIGNPQQLGQKPLTFYRQVISLMQNPQLLEMPAEWLQQAFKADVVVRARRMLQDAGGSVGAYSASQGVKGYRRTVAQFIERRDGIPANPDNVYLTAGASSAVSCLLSTFCKGPETGVLIPIPQYPLYTATITQNNAVALPYYLNEADGWSTNPDEMERVILDSKKRNIAPKCLVVINPGNPTGSVLSVKDMEAILTLAAKYGIVVIADEVYQDNVFGDAKFHSMRKVLKNLQLREPTLYKNVQLASLHSISKGLSGECGQRGGYMELIGFREELRKVFVKLASISLCPVVTGQALVDLMVGPPSQGDPSYEQYTQETRSIYHELEERSQLLWKTFCSLEGIECNMPQGALYLFPKLHLPQKAIEAAQKLGIPADELYCSELLDETGICTVPGTGFGQIPGTYHVRTTFLPPGTKWIESWKDFHKKFYDKYRD

SEQ ID NO: 6376 - protein, 447 aa, Candida glabrata
MATNEEFIRTQIFGTVFEITNRYSDLNPVGMGAFGLVCSATDTLTNQQVAIKKIMKPFATAVLAKRTYRELKLLKHLRHENLICLQDIFLSPLEDIYFVTELQGTDLHRLLQTRPLEKQFVQYFHYQILRGLKYVHSAGVVHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPSDVIDTICSENTLKFVTSLPHRDPIPFSERFKTVEPDAVDLLEKMLVFDPKKRITAADALAHPYLAPYHDPTDEPVAEAKFDWHFNDADLPVDTWRVMMYSEILDFHKIGGTDGQIDTSATFDDQVAAATVAAAQAQAHALAQAQMSQNMIDPNQLLNEDGTPVSGSIAENSSNSATTNLNGAAAGMNSASDTINEYANQAVHFANEFQQ

SEQ ID NO: 6377 - protein, 725 aa, Erwinia carotovora
MSAFSEAINSLFSGHYADPFSLLGMHHSSKGLEVRALLPDADAAWVVDASNGRKIVELERVDGRGFFCGLVPNRKHDFHYQLAVTWREETWVIEDPYRFGPLLQDMDIWLLAEGTHLRPYERLGAHLETLDGVEGTRFAVWAPNAQRVSVVGQFNFWDGRRHPMRLRKENGIWELFLPDVKAGQLYKYEMIDSHGSVRLKADPYAFEAQMRPDTASLITPLPEKVPTNEARREANSLRSPISIYEVHLGSWRRHTDNNFWLSYQELANQLIDYVQYMGFTHVELMPINEHPFDGSWGYQPLGLYAPTRRFGTASDFRAFVDALHGAGINVLLDWVPGHFPGDEYGLAQFDGTALYEYSDPREGYHQDWNTLIYNYGRHEVRNYLAGNALFWMERYGIDGLRVDAVASMIYRDYSRSEGEWVPNHYGGKENLEAIAFLRYTNHTLGHAAPAAITLAEESTDYPGVTLPPDCNGLGFHYKWNMGWMHDTLTYMQLDPVHRKHHHDLLTFGMLYAYSENFVLPLSHDEVVHGKRSLLDRMPGDVWQKFANLRAYYGFMWAYPGKKLLFMGCEFAQGREWNHDASLDWHLLDEPEGWHRGVQALVRDLNHYYRQQPSLYQLDFQPQGFEWLVVDDRENSVFAFIRRDEQGNEVLVVSNFTPVPRYGYRIGINQPGGWREVMNTDSVHYNGSDQGNVGTIYSEEWGSHQRQHSLVLTIPPLATLYLVKEA

SEQ ID NO: 6378 - protein, 503 aa, Triticum aestivum
MEAGGKDGNPLKNYRIGKTLGIGSFGKVKIAEHIKTGHKVAVKILNRRKIKNMEMEEKVKREIKILRLFMHPHIIRLYEVIEAPADIYVVMEYVKSGELFDYIVEKGRLQEEEARRFFQQIISGVQYCHRNMVVHRDLKPENLLLDNNCDVKIADFGLSNVMRDGHFLKTSCGSPNYAAPEVISGKLYAGPEVDVWSCGVILYALLCGTLPFDDENIPNLFKKIKGGIYTLPSHLSGPARDLIPRMLVVDPMKRITIREIREHPWFEAQLPRYLAVPPPDTAQQVKKIDEESLVKVISLGFDKNLLVESIHNRLQNEATVAYYLFLDNKSRTTTGYLGAGYQEAMESSFSPITPSETQSPAHGNRQQPYMESPVGLRPHFPADRKWALGLQSRAHPREVMTEVLKALQELNVYWKKIGHYNMKCRWSPPGFPGQENMSHTNYNFSAEPIETDDLGDKLNLIKFELQLYKTRDEKYLLDLQRASGPHLLFLDLCAAFLAQLRVL

SEQ ID NO: 6379 - protein, 297 aa, Leptospirillum ferrooxidans
QIQGYVQTPGIHSPEQIEGWKTVTQRVHQKGGLIYLQLWHVGRISHPDFLGGNLPVAPSAIAPRGMTTYTPTGPKEIPTPRALEISEIHQIVQQYKTAAQNARDAGFDGVEVHGANGYLLDQFLEDSTNLRNDLYGGSLENRARLLFEVMEAVGEVWGSQRVGVRLSPGGTFNDMHDSNPQKTFGYVLQKLSKMDLAYVHLIEPAIPEGEHPTPDLSARFFRPLYSGTLIVAGEYTREKGTQILKSGLADLVAFGRPFLANPDLVERFKKGAALNSFDPATFYGGGVAGYTDYPVLD

SEQ ID NO: 6380 - protein, 479 aa, Bacillus thuringiensis
MSKVIFPKGFLWGGAIAANQVEGAYVEDGKGLTTVDLLPTGENRWDIMKGNIHSFTPVEGEFYPSHEAIDFYHRYKEDIALFAEMGFKALRVSIAWTRIFPNGDDEKPNEAGLQFYDNLFDELLKHDIEPVVTMAHFDVPIHLVEKYGSWRSRKLVDFFETYAKTIFNRYKDKVKYWMTFNEINMLLHLPFMGAGLAFKEGDNKKQIQYQAAHHQLVASALAVKACHEIIPDAKIGCMLAAGATYPYTCNPDDIQRAMEQDRESFFFIDVQARGAYPGYAKRFFTDNNVTIEMEKEDEAILKEHTVDYIGFSYYASRATSTDPEVLKSITSGNVFGSVENPYLEKSEWGWTIDPKGFRITANQLYDRYQKPLFVVENGLGAIDQLNDEDEVNDAYRIDYLEKHMIEMSEAIQDGVDIIGYTSWGPIDLVSASTGEMKKRYGYIYVDKDNEGKGSLKRSKKDSFNWYKEVIATNGGSLES

SEQ ID NO: 6381 - protein, 892 aa, Methanosarcina mazei
MPDLFKGLFGKKSNELFIILAVGLLFTFFASYFGLFESIVLFVEEYNPRKLGGLLTLSVYLAFALGIFSLRRWMELENALVLQEKTEESLKEKDKRYRALFEHSNDAIIILNGEKVLDLNKKGREAFGLGARELDNISIGSLLSEKDLPAVRDALKTTLENGSACFEMKFRKQNGEVIDVEVSSSFLSLEEGEIQCVARDITTRKKAEKNERESRERLKKIIDNALCGILLVDASTHEIVDANPAAVEAIGLPGHRLTGNVCHKFICPVEEGKCPITDFKQSVDKSERMLLNGKGESFPVLKSVVPVKIGENEYLIESFIDLSERKKTEEELLQAKLAAESANRAKSEFLTNMSHELRTPLTAIIGFSDVMLGGISGEFSEQNKKFLNNIANSGKHLLTLINNILDLSKIEAGKMELEFEMFSVSEVFNDTRAVTSALALKKDISMKYNVDSEILVYADRVRFKQIIYNLVSNAIKFTPDRGSVIVSALKTEDSVRISVSDTGIGISEENQKLLFQPFRQIDASINRHYEGTGLGLALVKKFVNLHGGRVWAESEPGKGSTFEFELPLKCGITSETRINNPDASKKIASSPAEKTVPENHVSDKPAFEKPEREENIKPEANNKSRLPEIIEPSGDSGEKNLVMVVEDDEMAKELLTITLSEAGYRVVTVSSGREALLLARELKPSVITLDIMLPGVSGWDILKNLKHDSATSDIPILVISMNDEKNCSILWGAVDHLIKPVEKERLLSSLQKVKGAINAKSSPRVLIVDDEPTIVELFSSIIKEEGYEPVCAYGGKEAVDKIRNGHPDIIILDLMMPHFTGFDLIKVLKENPETIDIPVIVCTAKELTFEEKDQLNRNVSYIMKKGNITREVLLSVLQKVEDKKFKSKQTNS

SEQ ID NO: 6382 - protein, 322 aa, Colwellia psychrerythraea
MQRLAPALRQDNVPLDLISLIKTILAATKEISFRVSQGHLGDVMGSTLDENIQGEVQKQLDVVANELFKDILLESGFVKAISSEEEDHSVAGDENGKYIVSFDPLDGSSNIDINSLIGTIFSIHEAPKDIAAGDDDMFKQAGDKQVCAGYVLYGPSTMLVMTTGSGTHFYVLDRTHGGFLLVERNVQVPADTQEFAVNMSNQRFWQAPMQNYISDLLAGDTGPREKNFNMRWIAAMVGDIHRVLCRGGIFTYPADSRKPEQPYKLRLMYEANPMAFLLEQAGGLAMTSEGRIMDIEPNSIHQRVEVIMGSKNEVEKCLSYYN

SEQ ID NO: 6383 - protein, 587 aa, Brassica napus
MYRLISSIASKARVARNCTSQIGSRLSSTRNYAAKDIRFGVEGRALMLRGVEELADAVKVTIPPKGRNVIIEQSWGAPKVTKDGVTVAKSIEFKDRVKNVGASLVKQVANRPTQLNRCLGDGTTCATVLTRAIFTEGCKSVAAGMNAMDLRRGIKLAVDTVVTKLKSRARMISTSEEIAQVGTISANGDRELVTDCKAMESVGKEGVITIQDGKTLFNELEVVEGMKIDRGYISPYFITNQKNQKCELEDPLILIHEKKISNLNSMVKVLELALKSQRSLLIVAADLESDALAVLILNKLRAGIKVCAVKAPGFGENRKANMHDLATLTGAQVITEELGMNLEKIDLSMLGNCKKITVSKDDTVFLGWGAGDKKAIGERCEQIRSMVEASESDYDKEKLQERLAKLSGGVAVLKIGGASESEVGEKKDRVTDALNATKAAVEEGIVPGGGVALLYASKELDKLSTANFDHKIGVQIIQNALKTPVYTIASNAGVEGAVIVGKLLESDNPDLGYDAAKGEYVDMVKSGIIDPVKVIRTALVDAASVSSLLTTTEAVVTEIPTKEDASPAMGGGGGGMGGMGGMGGMGF

SEQ ID NO: 6384 - protein, 957 aa, Cryptococcus neoformans
MSVQSPLIAVPRKTTTDVDWATPIRHVIAASYGEDPNSYAEECAVLQRCRQDAVRGAGNDQTARDLLYKYFGQLELLELRFAEIKVSFPWNDAFTDKLTTQTSLAFEKASIIHLISSILSSLAQSASRSDPEGLKRAYYNPRATAGMLTYINENFLHAPSTDLSREVVHLLIGIMMAQAAEIFTEKLVEEKKSASLVARSANQTASMYTSVVDEMKEFQGKGVFDRNWLYVLQIKAKLFGSLTQYYKATSDSAAGKHGTALVRLKIANSLIQDAQKQASSFIYTFVAASTPSLPHDAANALNEIVKAHATVCGEAKEQAVKDNDLIYHEVLPSEASLPAIEKLPPAAPITIQDVYGNQEVTKLIGPDIFLRLVPLAVHESASVYSEEKAKLVRAEVDKVELAEGEIQAGLDHLNLPEEIDRWRQFLEGDTNDDVPLSQQLKSLVDSVGDVRQVENDLGRLDGERGACERELRELNGALDAESRECERMRAKYTPNFTQSPSGPQTANLRSNLSANLSALSSASTSDAHLQSLWQSIQPSISLLSSGPSNLERAARDITEGNSQKIDKTVSLLDLDDEEVDRKALGQEEKDALRKAVDDGREKLDRLKKIRAERDEVLRDLKEKIQTDDVSNLLLLNRRSQNVEPQLFASELEKFRPYQTRLAAAVSASRSILQELDMLVAQVHKGTGFREILRKEKDRQRIIRDWEKRLIEAGESYAEIRAGLGKGLSYYDSLRRVIEDLRMEVQRFTNSREQERRNMVSDIETRQRLGGTSPSTGGVVANRGLEERLAALKMEAPPQPPRLGTTSTPNLPPPPGRGSSNVTSSYLPPPPPPKPQSNPYDFSTLAGFGSFATPSVSSPQHVYPSQPQQAYNQQSYIPPQQNPYYPPPPSRPTYASPPFAPQQPPMQSGHSPYAPPPGHAPQPQQPQYPSSQNQQQRQGYEYPGYGQQGGYGGGYGQY

SEQ ID NO: 6385 - protein, 476 aa, Unknown
  Magnetococcus sp. MC-1
MVQHSPTVIVWFRRDLRLSDNPALLAATAMGQVLPVYIHENNQQEGGGGAWRWGLQQALAALNADLQGKLCCYVGDPARLLPEVAHAVGATGVYWNRLYTPQAIKRDRAIKQSLIERGLQVRSFNGSLLWEPWQVLKADKTPYKVFTPYYRRGCLVQDVPRQPMDAPPTVTWATLPAAAPAPSMQALDALLLGDVSWHKKWHGIWSMGEEAAQTRFEHFLSHGLACYDQGRDFPGRDCTSRLSTALQYGLLSPNQVWYGLEHAKADEHSVDKFRSELAWREFAYYQLFHFPSLPHKNFQPKFDHFPWLEDEVALGRWQTGQTGIPIVDAGMRELWQTGVMHNRVRMLVGSFLVKNLLLDWRAGAAWFKDCLVDYDLAINSASWQWVAGCGADAAPYFRIFNPVTQGEKFDRNGTYTRRFVPELANLPDQYLFKPWMAPASILRQAGVRLGQDYPEPLVDLAASRAQALAAFQALKI

SEQ ID NO: 6386 - protein, 384 aa, Haloarcula marismortui
MLAAASAVIRLASESSAMTALFSPLELRETTVPNRVMVSPMCQYSCDARDGLATDWHRTHLGSRAVGGAGLVMTEATAVEARGRISPEDLGIWSDEHAAALEPITGFISEQGSVPGIQLAHAGRKASIERPWDGHDPLQPDDGGWEVVGPSDDPWPYEDTEAPPTTALDQDGIEAVIDSFRTAAERALDAGFEVAEVHAAHGYLLHQFLSPVTNHREDDYGGDFKGRTRLTREVTAAVRDVWPDDKPVFVRISATDWLPDRDAWTVEDSVRLSDRLADIGADFIDVSGGGIHPESRPDYAGPNYQLQYAEQIRAETESDIAVGAVGGITTPEQAEAVIANDRADMAIVGREHLRDPYFTMTAAKELDATDEIEGPPQYRRAWGF

SEQ ID NO: 6387 - protein, 210 aa, Eucalyptus occidentalis
MVRGKIQLRRIENTTSRQVTFSKRRNGLLKKAYELSVLCDAEVAVIIFSQKGRPYEFSSNSEIQKTIDRYRRSTYDMDTYKTNLDQCILHLKQETTDMERKIELLEVSLRKLSGECLGSCSIDEIQMIGDQLERSLSSIRARKAQLFDDQIQHLQAKERSLKEENAKLLAKCLANPGQSTAHPRAAALHSRSSRSTDVETRLFIGLPELN

SEQ ID NO: 6388 - protein, 227 aa, Eucalyptus occidentalis
MAREKIQIKKITNATARQVTFSKRRRGLFKKAEELSVLCDADVALIVFSSSGKLFEYCSSSMKEILERHHSHSENLGKLDQPSLKLQLVENGDYSRLSKEVAEKGHQLRQMRGEELQGLNIDELQQLEKSLEAGLNRVIEKKGEKIMKEITDLQQKGAKLMEENKRLKQQVTEISGRKTTATDSETIINEEGLSSESITNVCSSSSGPPQEDDSSDISLKLGLPYNG

SEQ ID NO: 6389 - protein, 131 aa, Zea mays
QSDETCKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 6390 - protein, 153 aa, Funaria hygrometrica
MALSLFGGRGNSVFDPFEFGSVWDPFTVLESGPSRQLASDVQAVASTRIDWRETPEAHIFKADLPGLTKEEVKVQVLEGRTLEICGERKKEEVQKSDTWHRMERAQGSFMRRFRLPEGTNTDDVKAQVQDGVLTVTVPKVQKPKPQVRQIEIA

SEQ ID NO: 6391 - protein, 128 aa, Arabidopsis thaliana
  misc_feature (8)..(8): Xaa can be any naturally occurring amino acid
  misc_feature (47)..(47): Xaa can be any naturally occurring amino acid
MESKTFWXVTLLLCGTIQLAICRSEEKSTEKTMMLGGVHDLRGNPAXENSGEIESLARFAIQEHIKQQNKILEFKKIVKAREQVVAGTMYHLTLEAKEGDQTKNFEAKVWVKPWMNFKQLQEFKESSS

SEQ ID NO: 6392 - protein, 149 aa, Funaria hygrometrica
MAIYVNRRNNIWNMPDPMDIMMNFFEDTPARSIARDAHALASTNVDWKETPTEHVIKADLPGLKKEEVHVQVEGDRTLSISGQRKHEEVQKTDTWHRVERSSGQFMRKFRLPENANLEQISAQVQDGVLTVKIPKLEKQKPHSRTIEIG

SEQ ID NO: 6393 - protein, 146 aa, Funaria hygrometrica
MALSLFGRGSGSFFDPFDLSLLESGPSRQFARDAHAVPNTQIDWRETPEAQSSKADLPGLKKEEVKVQLVDGKTLEISGERRKEEVHKDDTWHRVERAHGSFLRRFRLPDNSNVEAVEAQVQDGVLTVTIPKIQKPKPQVRQIEIA

SEQ ID NO: 6394 - protein, 147 aa, Thermotoga maritima
MLLGRREDIFRPFRELQREIDRLFDDFFRTEVRPAKEFFAPDMDVYETDDEVVIEVEIPGIDRKDVKITVEENILKISGEKKLEREQKGKNYYYVERSAGKFERAIRLPDYVDVEKIKAEYKNGVLTIRVPKKEERKKKVIEVEVQE

SEQ ID NO: 6395 - protein, 248 aa, Glycine max
MGRGRVELKRIENKINRQVTFAKRRNGLLKKAYELSVLCDAEVALIIFSTRGKLYEFCSTNSMLKTLERYQKCSYGAVEVSKPGKELESSYREYLKLKARFESLQRTQRNLLGEDLGPLNTKDLEQLERQLDSSLKQVRSTKTQFMLDQLADLQNKEHMLVEANRSLTMKLEEINSRNQYRQTWEAGEQSMPYGTQNAHSQGFFQPLECTPTLQIGSDYRYIPEASEQQLAATTQAQQVNGFIPGWML

SEQ ID NO: 6396 - protein, 592 aa, Streptomyces avermitilis
MMTHAGVLGTRFTVWAPNARGVRVCGNFCRWDGAAFPMRSLGSSGVWELFVPGIGEGELYKFEITRPDGTHTVRADPMARRAEVPPATASIVTESSYAWADGAWMAARGERPVHESPFSVYEVHLPSWRPGLTYRQLAEQLPAYVADLGFTHVELLPVAEHPFGGSWGYQVTGFYAPTARLGTPDDFKYLVDALHRAGVGVLMDWVPAHFPRDDWALAEFDGRPLYEPEDPQRAAHPDWGTLEFDYGRKEVRNFLVANAVYWCEEFHIDGLRVDAVASMLYLDYSREEGQWSPNEFGGRDNPDAVAFLQEMNATLYRRVPGVITIAEESTAWDGVTRATHDNGLGFGLKWNMGWMHDSLGYVQHEPVHRKYHHHEMTFSMVYAYSENYVLPISHDEVVHGKQALVSKMPGDWWQRRANHRAYLGFMWAHPGKQLLFMGQEFAQGAEWSPEHGPEWWLLDDEYHSAGDHRGMRDLVRDLNTLYRAEPALWERDTDPSGFAWVVGDAAEDNVFAFLRHAADGTPLLAVSNFSPVVRHDYRLGVPDDIPAWQEALNTDAARYGGSDLICPDPVKPESGEIRLTLPPLATVWLRPA

SEQ ID NO: 6397 - protein, 496 aa, Nicotiana tabacum
MVLSKTASESDVSIHSTFASRYVRTSLPRFKMPENSIPKEAAYQIINDELMLDGNPRLNLASFVTTWMEPECNKLMMDSINKNYVDMDEYPVTTELQNRCVNMIAHLFNAPLGDGETAVGVGTVGSSEAIMLAGLAFKRKWQNKMKAQGKPCDKPNIVTGANVQVCWEKFARYFEVELKEVKLSDGYYVMDPEKAVEMVDENTICVAAILGSTLNGEFEDVKRLNDLLIEKNKETGWDTPIHVDAASGEFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGLEKSGRFNIISKEIGVPLVAFSLKDNSQHNEFEISETLRRFGWIIPAYTMPPNAQHVTVLRVVIREDFSRTLAERLVIDIEKVLHELDTLPARVNAKLAVAEANGSGVHKKTDREVQLEITTAWKKFVADKKKKTNGVC

SEQ ID NO: 6398 - protein, 538 aa, Staphylococcus aureus
MVKQLKFSEDARQAMLRGVDQLANAVKVTIGPKGRNVVLDKEFTAPLITNDGVTIAKEIELEDPYENMGAKLVQEVANKTNEIAGDGTTTATVLAQAMIQEGLKNVTSGANPVGLRQGIDKAVKVAVEALHENSQKVENKNEIAQVGAISAADEEIGRYISEAMEKVGNDGVITIEESNGLNTELEVVEGMQFDRGYQSPYMVTDSDKMVAELERPYILVTDKKISSFQDILPLLEQVVQSNRPILIVADEVEGDALTNIVLNRMRGTFTAVAVKAPGFGDRRKAMLEDLAILTGAQVITDDLGLDLKDATIDMLGTASKVEVTKDNTTVVDGDGDENSIDARVSQLKSQIEETESDFDREKLQERLAKLAGGVAVIKVGAASETELKERKLRIEDALNSTRAAVEEGIVAGGGTALVNVYQKVSEIEAEGDIETGVNIVLKALTAPVRQIAENAGLEGSVIVERLKNAEPGVGFNAATNEWVNMLEVGIVDPTKVTRSALQHAASVAAMFLTTEAVVASIPEKNNDQPNMGGMPGMM

SEQ ID NO: 6399 - protein, 134 aa, Brassica napus
MGSEGPKAITIHVTGFKKFLGVSENPTEKIANNLKSYVEKRGLPSGLSLGSCTVLETAGEGAKSQLYQVLESSVVVSGDNKNTIGTVVWLHLGVNSGSTKFAIERQAVNEAHFRCPDQLGWQPQRLPIVVEDGS

SEQ ID NO: 6400 - protein, 505 aa, Clostridium thermocellum
MDVTGKSLKRILLSLAVFCILITGPGIACAEEATTQEKEILFSDYFKSMMDMAQDKYKGEITEKQMLEGALKGIFSTMDSYTVYYTVEESQDFFTDINGSYTGIGVVMSEVDGKIVIDKVYPSSPAEEAGIKKGDVIAQVDGKSVENLSLEEVAGLIKGPSGTKVVIGVLRNGTDGVIELEVTRRQIIINPVTHKIEGDIGYIKLESFNSNASKAMEEALKQMDKNNIKKIILDLRDNPGGDVGQAVSIARKFVKKGLITKLDFKSESQKDEEYYSYLEELKYKLVVLVNENSASASEILAGAIQDTGSGILVGTTTFGKGKVQNLYPILTPEAVEKYRKETGETFVNGYDLLEKHGIYPSDEEIIGWVKITTGEYYTPNGRMIDGVGLEPDVYVENEPEGKYKILEGVEKLRKVTKPSLNAQSEDVLNAEKILSALGYDVDTPDNLMDEKTVKAVAEFQRDCGLYSYGVLDFATQQALNDKLDELLLVKNRDKQYEKAVELLEN

SEQ ID NO: 6401 - protein, 57 aa, Glycine max
  misc_feature (4)..(4): Xaa can be any naturally occurring amino acid
  misc_feature (6)..(6): Xaa can be any naturally occurring amino acid
  misc_feature (8)..(8): Xaa can be any naturally occurring amino acid
  misc_feature (15)..(15): Xaa can be any naturally occurring amino acid
  misc_feature (17)..(17): Xaa can be any naturally occurring amino acid
  misc_feature (22)..(23): Xaa can be any naturally occurring amino acid
  misc_feature (26)..(27): Xaa can be any naturally occurring amino acid
  misc_feature (30)..(30): Xaa can be any naturally occurring amino acid
  misc_feature (42)..(42): Xaa can be any naturally occurring amino acid
  misc_feature (45)..(45): Xaa can be any naturally occurring amino acid
LAIXNXAXNEANFRXPXEMGWXXQKXXIVXSDGGISRTRETXLPXVEITKALAEKGI

SEQ ID NO: 6402 - protein, 131 aa, Zea mays
QSDEARKMGDIVHTLTNRRWLEKCVTYAESHDQALVGDKTIAFWLMDKDMYDFMALNRPSTPTIDRGIALHKMIRLITMGLGGEGYLNFMGNEFGHPEWIDFPRGPQRLPSGKFIPGNNNSYDKCRRRFDL

SEQ ID NO: 6403 - protein, 147 aa, Funaria hygrometrica
MDFPLFQILSFPDELEKSLNPQSQKYVRDTKAMVSTAVDVKELPDAYIFVADMPGLKSADVKVQLENDNVLVIGGTRKREEPDPKVKYIRMERNSGSFMRKFTLPQNSNLDKIAASCVNGILTVTVPKIPPPEPAKPRTIEVTMGNQ

SEQ ID NO: 6404 - protein, 507 aa, Xanthomonas campestris
MRPGHLMVLALLAPTLIAPPVFAQSVLTRDNGAKVGDNQNSQTAGATGPTLLQDVQLIQKLQRFDRERIPERVVHARGTGVKGEFTATADLSSLTKAKVFSAGEKTPVFVRFSSVVHGNHSPETLRDPHGFATKFYTSEGNWDLVGNNFPTFFIRDAIKFPDMVHAFKPDPRTNLDDDSRRFDFFSHVPEATRTLTLLYSNEGTPAGYRFMDGNGVHAYKLVNAQGEVHYVKFHWKTLQGIKNLDPKQVAAVQAKDYSHLTNDLVGAIKKGDYPKWDLYVQVLKPEDLAKFDFDPLDATKIWPDVPEQKVGQMVLNKNVDNFFQETEQVAMAPANLVPGIEPSEDRLLQGRIFSYADTQLYRIGANGLSLPVNRPRVAVNNGNQDGQGNIGQTTSGVNYEPSRLEPRPQDTAARYSELPLSGTTQQAKITREQNFKQAGELYRSYSKKDRADLVQSFGESLATTDTESKHLMLSFLYKADPEYGTGVTRVAKGDLARVKQLASSLQD

SEQ ID NO: 6405 - protein, 161 aa, Funaria hygrometrica
MDFVVFDTDPFLTTLHQLVHEPGSDLERKIKRQRRNHHDEPRHVTIATPVDVKEIKDAYLFVADVPGLQKTDIEVQVENENVLTMRGKRKLDEKVNEKEEDTKFIRMERSPVKLLRKFTLPSDANADAITANCVDGVLTVTVPKIPPPEPAKSKTVQIAVD

SEQ ID NO: 6406 - protein, 71 aa, Zea mays
QSDETWKMSDIVHTLTNRRWLEKCVTYAESHDQALVGDKTIAFWLMDKDMYDFMALDRPSTPTIDRGIALH

SEQ ID NO: 6407 - protein, 470 aa, Zea mays
  misc_feature (389)..(389): Xaa can be any naturally occurring amino acid
MPNGGGKRWLLLLPLSRWVLLLGSLQLPADGGSGHVVTRMRGFNGPLPFYLETGYVEVDEQQGVQLFYYFVRSERDPYEDPLLLWLSGGPGCSGISGLAYEIGPLKFDARGQGEFPTLLYRPETWTKVSNIIFEDSPVGTGFSYAKSEEGLETGDTKQVKQLVIFLRKWLQDHPRIVMNPLYIAGDSYSGLIIPTLALEIDRSIELGEKIFSGLKGYIAGNPLTGGQFDTDSQIPYFHAMGLVSDELYKNARENCGGKYSAPLNAVCAEAVQAINNCTRDINKQYILDPACPDDDLLSPKTVAETDGTSRLMLESADFLLGSKCAEALYILSYAWGNDDTVQESLGIRKGTIGAWKRYSHALPYNYDIQSVVDYHSRLATKGYRALIYXSGDHDAVVPHVGTQAWIRYLNLTIVDDWRPWYVGGQVAGFTRSYASGLTFATVKGAGHVAPLYKTLECQKMFITWISGNPL

SEQ ID NO: 6408 - protein, 533 aa, Bacillus halodurans
MKDQNQDPNKRSDNETDETLTNRQGHPVTNNQHVRTVGDRGPTTLENYDFLEKISHFDRERIPERVVHARGAGAHGYFESYGTYGDEPISKYTRAKVFTEKGKQTPVFVRFSSVIHGGHSPETLRDPRGFAVKFYTEDGNWDLVGNNLKIFFIRDPLKFPDLVHAFKPDPVTNVQDGERIFDFISQTPEAMHMITFLFSPWGIPANYRMMQGSGVNTYKWVNEEGNAVLVKYHWEPKQGIKNLTQKEAEAIQAKNFNHATLDLYEAIEDGDYPEWELYVQIMSDDAHPELDFDPLDPTKLWYKDQFPWVPVGRMVLNKNPENYFAEVEQAAFGTGVLVDGLDFSDDKLLQGRTFSYSDTQRYRVGANYLQLPINAPKKRVATNQRDGQMEYHVDIGPKQNPHVNYEPSLLNGLKEAKQDGQDHTPYVEGELQRASIDRQNDYGQAGETYRRLSDWERDDLILNLVNTLAPCHEDIQKQMIDHFSQCDPEYGRRVKEGLEKQKGADTHRQPQGGADGDAAMHAAEALGHPSDPY

SEQ ID NO: 6409 - protein, 547 aa, Vibrio parahaemolyticus
MAAKDVKFGNDARVKMLEGVNVLADAVKVTLGPKGRNVVLDKSFGAPTITKDGVSVAREIELEDKFQNMGAQMVKEVASKANDAAGDGTTTATVLAQAIVNEGLKAVAAGMNPMDLKRGIDKAVAAAVEQLKELSVECNDTKAIAQVGTISANSDASVGNIIAEAMERVGRDGVITVEEGQALQDELDVVEGMQFDRGYLSPYFINNQEAGSVELENPFILLVDKKISNIRELLPTLEAVAKASRPLLIIAEDVEGEALATLVVNNMRGIVKVAAVKAPGFGDRRKAMLQDIAILTGGTVISEEIGLELEKVTLEDLGQAKRVSITKENSTIIDGAGEEAMIQGRVAQIRQQIEDATSDYDKEKLQERVAKLAGGVAVIKVGAATEVEMKEKKDRVEDALHATRAAVEEGVVAGGGVALIRAASKIVDLEGDNEEQNVGIRVALRAMEAPIRQITKNAGDEDSVVANNVKAGEGSYGYNAATGEYGDMLEMGILDPTKVTRSALQFAASVAGLMITTEAMVTDLPQKESAGMPDMGGMGGMGGMGMM

SEQ ID NO: 6410 - protein, 168 aa, Sinorhizobium meliloti
MNVRDLIPWGRAQGQVPASYRDNDRNPFLALHREMNRLFDDAFRSFETRLPISGFSGFAGGWPSVEVSDRDKEIKVTAELPGLDEKVVELSLSDGVLSLRGEKRAETEDQENQFSERYYGRFERRIALGYEVDESKVNATFRNGVLTVTLPKTEQAQSKAKRIAINGR

SEQ ID NO: 6411 - protein, 546 aa, Leptospira interrogans
MAKDIEYNETARRKLLEGVNKLANAVKVTLGPKGRNVVIDKKFGAPTITKDGVTVAKEIELEDPLENMGAQMVKEVSTKTNDVAGDGTTTATILAQSIINEGLKNVTAGANPMSLKRGIDKAVTAAVESIQKRAVKIENKKDIANVASISANNDNTIGNLIADAMDKVGKDGVITVEEAKSIETTLDVVEGMQFDRGYISPYMVTDAESMVATLNDPFILIYDKKISSMKDLIHILEKVAQAGKPLVIISEEVEGEALATIVVNTLRKTISCVAVKAPGFGDRRKSMLEDIAILTGGQVISEDLGMKLENTTLQMLGRANKVTVDKENTTIIEGKGQTKEIQGRIGQIKKQIEDTTSEYDREKLQERLAKLAGGVAVIHVGAATEVEMKEKKARVEDALSATRAAVEEGIVPGGGLTLLKAQEAVGSLKLDGDEATGAKIIFRALEEPIRMITSNAGLEGSVIVEHAKAKKGNEGFNALTMVWEDMIQAGVVDPAKVVRSALQNAASIGSMILTTEVTITDKPDKDAPNPMAGMGGGGMGGMGGMM

SEQ ID NO: 6412 - protein, 121 aa, Glycine max
  misc_feature (95)..(95): Xaa can be any naturally occurring amino acid
  misc_feature (98)..(98): Xaa can be any naturally occurring amino acid
MVQSRKFRGVRQRNWGSWVSEIRHPLLKRRVWLGTFETADEAARAYDEAAILMSGRNAKTNFPVGENQMGNHSSSTSSSSTTTLSAVLSAKLRKXCKXPSPSLTCLRLDTENSHIGVWQKR

SEQ ID NO: 6413 - protein, 1112 aa, Gibberella zeae
MADIMIPNVRSPLSEASNRINSNHPPQEAHRYKPRHDRPPASTNNPPRASYGHPAAYFSGRPPPTQPQSTGPKPQGNPTLKPPTDMDDDRRHSGASYDSSGSGHSKKNYKTHIGPWQLGKTLGKGSSARVRLCRHNVTHQLAAVKIVNRRMAYLVQDSSLAALSKWDNNLPEQIDGEIRVPMAIEREVAILKLIEHPHIMKIYDIWENRSEVYLILEYIDQGDLFTFINMKGRLSEEVSVYFFRQIISAISYCHSFNICHRDLKPENILISANLKIKIADFGMAALHQTDTHRLNTACGSPHYAAPELLKNRQYRGDKADLWSMGVILFAMLTATLPFDDPDIRVMMSKTKKGQYEMPDYLSPEAEDLIRRMLQVNPDRRITLKEIWRHPLVKKYAYLDNLDDLNSQPPDIRKGFQYTPVPAQDVDSQLVRQLRSMWHTFSENDLKLKLTCDEPNDQKAFYWLLYQYREQQLEDFKPEIAHSTSDYHHMKPGTWKKHPQAASLSKKTTMALTPGNQKGFEVDQVRAVDVEHQLEPPPQDAYYHREARCRPCTAVDKARRMHATRATNEESTSRMSGSVPPYVTEQGSTYQLEMARPFTPDVSELPSTVLPKTKDRHEAQVNTKRASGQAMRIALGSRYASEIFKEELRHFSSNIAKDCDEAFKSSLIEEDSIAGSLTEPDRTQYESTPISFTIDAPDESAPDILDLTAKSFSNRPLPPLPTPLQGHDERSLAPTPIGSRPTTGDSHLEELRAEQVKVAQPVILTRHAERRVVSAPAYHQKSKMNPALPSINETGAISNDKARIVSAPPHTPTKRGVDRIRGIEYLSQVENSIRVVNSPGDESPVKMPKPLNVRKKFCDSEEEEEDVMVKRASKVESTHGRESVDWQDCNSYLTSSDGKRSDSTTTDAPSKKKTFNFNFWKSNKQRDSIMSITKEPDDKEERPSVELSVVGKTNTSTKVSQSRWHESNSGPVRNIEVKQNWLARLFRVKPATDHICMTISRRRARQEVTILLREWRKYGIRDIQVDKQRNIVFARVADKNFLNLKEVSFAAEVITVIEHGKKQPLSIIRFTQERGAASSFYRVVDTMRMMFETRALVISDKNKQKMMIKTLNS

SEQ ID NO: 6414 - protein, 512 aa, Ralstonia eutropha
MQGADTPAHARPPYRIDHQFDRGLVWFRRDLRSTDHAALHYALKHCREVWCVFVFDRDILDPLLARGLKGDRRVDFIRASLIELDATLRAAGGGLIVMNDSAASAIPALARELGVQAVFANHDYEPDAVARDAAVRDSLAGDARVLFTFKDQVIFERDEILTSQGKPFAVFTPYKNAWLKTIQPFDLRPYPIEPYLHALAPLPSKRLVPLPSLEDLGFAPSNLAEVAMPTGSSGGQALFEEFTSRMGDYGRRRDYPALRGPSYLSVHLRFGTVSIRTLARAAHGAVLRGGADSAGAATWLSELVWRDFYFMILHHHPRVAAGEAFHPAYDIIRWRDGETGDRYFESWRDAATGYPLVDAAMLQIRQSGYMHNRLRMVTASFLVKDLGVDWRRGEHYFADQLNDFDFAANNGGWQWAASTGCDAQPWFRIFNPVTQSEKFDPQGRFIRKYLPQLAALPDKYVHAPWTAPQDVLLAAGVRLGENYPRPLVQHDVARKETLERYAVVKEWRRPEG

SEQ ID NO: 6415 - protein, 537 aa, Buchnera sp.
ARVKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTVFKNELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMDLEKSTLEDLGQAKRVVINKDTTTIIGGVGEKHAIQSRIGQIRQEIQEATSDYDKEKLNERLAKLSGGVAVLKVGAATEVEMKEKKARVEDALHATRAAVEEGVVAGGGVALVRVAGKISTLRGHNEDQNVGIRVALRAMEAPLRQIVSNSGEEPSVVTNNVKDGKGNYGYNAATDEYGDMIDFGILDPTKVTRSALQYAASVAGLMITTECMVTDLPKEDKSSDIGSSPAGGMGGMGGMM

SEQ ID NO: 6416 - protein, 457 aa, Staphylococcus epidermidis
MAIGVILNRVFRLNNNPLFDYIYSNKESINHCYFIIPTEEFEEEAKKKAQYYYGSIQKFMYELQRYDIEPFLMSYDKLIDFCKKQAIDKVVVAGDIMSYHHEEYDILHQRKRFKQANIQVISLRANHYFNPRKTYNKQGEPYKVFTSFYRKWRPYLMIRDEYDYHLEDISKVVVKSQHKIKEDYHSYGISERDVQNRWSEFLSQDIENYKENREYLPEVLTSQLSIYLAYGMIDIIQVFNDLLQNYDKNEQNYETFIRELIFREFYYVLMTNYPETAHVAFKEKYQQLKWSYNEENFKLWKDGNTGFPIIDAAMEELKTTGFMHNRMRMVVSQFLTKDLFIDWIWGESFFKQKLIDYYAASNVHGWQWSASTGTDAVPYFRMFNPIRQSERFDNNARYIKTYIPRLNQVDAKYLHDTHKFEQQIKGQGVEIGKDYPKQMIDHKESRQRVMSEFKALD

SEQ ID NO: 6417 - protein, 803 aa, Sorghum bicolor
MAAFAVSGAALGGAVRAPRLTGGEEGSLVSRRTGPFLTRAGGARVGGSGTHGAMRAAAASSRKAVVVAEDENDGLASKADSAQFQSDELEVPDVTEETMRDAGVADAQALNRVRVVPPPSDGQKIFQIDPMLQGYKYHLEYRYSLYRRIRSDIDEHEGGSEAFSRSYEKFGFNRSAEGITYREWAPGALSAALVGDFNNWDPNADLMSKNEFGVWEIFLPNNADGTSPIPHGTRVKVRMDTPSGIKDSIPAWIKYSVQAPGEIPYDGLYYDPPEEVKYVFKHPKPKRPKSLRIYETHVGMSSPEPKINTYANFRDEVLPRIKKLGYNAVQIMAIQEHSYYGSFGYHVTNFFAPSSRFGTPEDLKSMIDRAHELGLLVLMDVVHSHASSNTLDGLNGFDGTDTHYFHSGPRGHHWMWDSRLFNYGNWEVLRFLLSNARWWLEEYKFDGFRFDGVTSMMYTHHGLQVTFTGSFNEYFGFATDVDAVVYLMLVNDLIHGLYPEAVTIGEDVSGMPSFALPVQDGGVGFDYRMHMAVADKWIEFLKQSDEAWKMGDIVHTLTNRRWLEKCVTYAESHDQALVGDKTIAFWLMDKDMYDFMALDRPATPTIDRGIALHKMIRLITMGLGGEGYLNFMGNEFGHPEWIDFPRGPQRLPSGKFIPGNNNSYDKCRRRFDLGDADYLRYRGMQEFDQAMQHLEQKYGFMTSDHQYISRKHEEDKMIVFEKGDLVFVFNFHCNNSYFDYRIGCRKPGMYKVVLDSDAGLFGGFGRIHHAAEHFTTDCSHDNRPHSFSVYTPSRTCVVYAPVE

SEQ ID NO: 6418 - protein, 233 aa, Haemophilus influenzae
MLFALPALNDNYIWLYQRENLPLIIVDLPETDKLFAWLDKQNATIEAVLLTHEHEDHTQGVSAFKKRYPTVPIYGPQECEKKGATQVVNEGKILTAHYQIDVIPTGGHTKQHVSFLVDNHLFCGDALFSAGCGRVFTGNYAQMFDGLQRLNTLPDETIVCPAHEYTLGNLAFAETVLVEKSAVEKQRIFVETQRAENKPSLPTTLKLEREINPFLQAKTLEEFTALRKAKDIF

SEQ ID NO: 6419 - protein, 394 aa, Capsicum annuum
MDGPAQQTDTVMAEAAAAQQPAPPSQPVAGIDNIPATLSHGGRFIQYNIFGNVFEVTAKYKPPIMPIGKGAYGIVCSALNSETNEHVATKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPRNLLLNANCDLKICDFGLARVTSETDFMTEYVVTRWYRPPELLLNSSDYTAAIDVWSVGCIFMELMDRKPLFPGRDHVQQLRLLMELIGTPSEAEMEFLNENAKRYIRQLPLYRRQSFVEKFPHVNPAAIDLVEKMLTFDPRRRLTVEDALAHPYLTSLHDISDEPVCTTPFSFDFEQHALTEEQMKELIYREGLAFNPEYQHM

SEQ ID NO: 6420 - protein, 548 aa, Unknown
  Buchnera sp. N27
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAAISAVEELKNLSVPCSDSKAITQVGTISANADEKVGALIAEAMEKVGNDGVITVEEGTGLQNELEVVKGMQFDRGYLSPYFINKPETGVVELENPYILMADKKISNVREMLPILESVAKSGKPLLIISEDLEGEALATLVVNSMRGIVKVAAVKAPGFGDRRKAMLQDISVLTGGSVISEELAMDLEKSTLEDLGQAKRVVINKDTTTIIGGVGEKQAIQSRISQIRQEIQEATSDYDKEKLNERLAKLSGGVAVLKVGAATEVEMKEKKARVEDALHATRAAVEEGVVAGGGVALVRVAGKISNLRGHNEDQNVGIRVALRAMEAPLRQIVSNSGEEPSVVTNNVKDGKGNYGYNAATDEYGDMIDFGILDPTKVTRSALQYAASVAGLMITTECMVTDLPKEDKTSDASSSPAGGMGGMGGMM

SEQ ID NO: 6421 - protein, 775 aa, Hordeum vulgare
SKLSLPVSAPRDFTMATAQDGADDLPIYDLDPKFAGFKDHFSYRMKKYRDQKHLIDEHEGGLEEFSKGYLKFGINTENDATVYREWAPAAKEAQVIGDFNNWNGSGHRMTKDNFGVWSIRISHVNGKPAIPHNSKVKFRFHRGDGVWVDRIPAWIRYAIADASKFGAPYDGVHWDPPTSERYVFKHPRPQKPDAPRIYEAHVGMSGEKPEVSTYREFADNVLPRVKANNYNTVQLMAIKEHSYYASFGYHVTNFFAASSRSGTPEDLKYLVDKAHSLGLRVLMDVVHSHASSNMTDGLNGYDVGQNTQESYFHTGERGYHKLWDSRLFNYANWEVLRFLLSNLRYWMDEFMFDGFRFDGVTSMLYNHHGINMSFSGDYKEYFGLDTDVDAVVYMMLANHLMHKLLPEATIVAEDVSGMPVLCRSVDEGGVGFDYRLAMAIPDRWIGYLKNKDDLEWSMSGIAHTLTNRRYTEKCIAYAESHDQSIVGDKTMAFLLMDKEMYTGMSDLQPASPTIDRGIALQKMIHFITMALGGDGYLNFMGNEFGHPEWIDFPREGNNWSYDKCRRQWSLVDIDHLRYKYMNAFDQAMNALDDKFSFLSSSKQIVSDMNEEKKVIVFERGDLVFVFNFHPNKTYDGYKVGCDLPGKYKVALDSDALMFGGHGRVAHDSDHFTSPEGIPGVPETNFNNRPNSFKILSPPRTCVAYYRVEEKAEKPKDGGAAFWGKLLRDTSMLKLLASKDATDGEAISGSEKVSTGDGSVKRGINFVFRSPDKDNK

SEQ ID NO: 6422 - protein, 447 aa, Oryza sativa
MAATKSKAAKKGAPLLGKYELGRLLGRGTFAKVYHARSLAPGADPVAVKVLDKPDLAAAGAGMATRVLREVAAMRRLRHPNVLRLHEVLATRSKVYLVMELAPGGDLLSRLASLPSRRLPEHAARRVFLQLVSALIYCHARGVSHRDVKPQNVLLDAHGNLKVSDFGLAALPDSLRDDGRLHTACGTPAFAAPEVLRRKAYDGAKADAWSCGVILFVLLAGHLPFDDSNIADMCRKAHRREYALPRWVSQPARRLVSRLLDPNPATRLAGAELATHPWFKRSLSLDSQLGSLLGGQPERELAFQAPPPLNAFDIISMSPGLDLSGLFGESKRRREKRFVTTASPERTVERLGQAGAKLGYFMVGKKGVERLPLGGLSGLVAMSMEMSEVSPSMMLVELRLEGGDDGDGDGGAEEFGWEELRAELGDDVVMAWHGCDGGKKDKEGILL

SEQ ID NO: 6423 - protein, 209 aa, Streptomyces coelicolor
MAPRIERLVTSGQFSLDGGTWDVDNNVWLVGDDHEVVVIDAAHDADAIAAAVGDRRLTAIVCTHAHNDHVDAAPALAERTGATIWLHRDDLPLWQQTHPDRAPDAWLTDGLVIEAAGADLTVLHTPGHAPGAVCLYDPGLGTVFTGDTLFQGGPGATGRSYSHFPTIIDSIRDKLLVLPPETEVRTGHGDSTTIGAEAPHLEEWIKRGH

SEQ ID NO: 6424 - protein, 130 aa, Zea mays
LSDETRQMSDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFD

SEQ ID NO: 6425 - protein, 439 aa, Pseudomonas fluorescens
MLHLSRLTSLALTIALVIGAPLAFAAQPAPAVAPAGTAATSKAPLPLEELRTFAEVMDRIKAAYVEPVDDKTLLENAIKGMLSNLDPHSAYLGPEDFAELQESTSGEFGGLGIEVGAEDGFIKVVSPIDDTPASKAGIQAGDFIVKINGAPTRGQTMTEAVDKMRGKIGQKITLTLVRDGGTPFDVTLARAVIQVKSVKAQLLESGYGLIRITQFQVKTGEEVSKALAKLRKDNGKKLNGIILDLRNNPGGVLQAAVEVVDHFITKGLIVYTKGRIANSELRFSATGKDESEAVPMVVLINGGSASASEIVAGALQDQKRAVVMGTTSFGKGSVQTVLPLNNDRALKITTALYFTPNGRSIQAQGIVPDIEVRRAKITNEADSDYFKEADLQGHLGNGNGGADKPTGSGGKAKAMPQDDDYQLAQALSLLKGLSITSGR

SEQ ID NO: 6426 - protein, 1123 aa, Solanum tuberosum
MSSSRPSQSSTTSSRSKHSARIIAQTSIDAKLHADFEESGDSFDYSSSVRVTNVAEGEQRPKSDKVTTAYLHQIQKGKFIQPFGCLLALDEKTLKVIAFSENAPEMLTMVSHAVPSVGEHPVLGIGIDIRTIFTGPSGAALQKALGFGEVSLLNPVLVHCKNSGKPFYAIVHRVTGSLIIDFEPVKPYEVPMTAAGALQSYKLAAKAITRLQSLPSGSMERLCDTMVQEVFELTGYDRVMGYKFHDDDHGEVVSEITKPGLEPYLGLHYPATDIPQAARFLFMKNKVRMICDCRAKHVKVVQDEKLPFDLTLCGSTLRAPHYCHLQYMENMNSIASLVMAVVVNDGDEEGESSDSSQSQKRKRLWGLVVSHNTTPRFAPFPLRYACEFLAQVFAILVNKELELENQFLEKNILRTQTLLCDMLMRDAPLGIVSQSPNIMDLIKCDGAALLYKNKIHRLGMNPSDFQLHDIVSWLCEYHTDSTGLSTDSLYDAQFPGALALGDAVCGMAAVRISDKDWLFWYRSHTAAEVRWGGAKHEPGEKDDGRKMHPRSSFKQFLEVVKTRSIPWKDYEMDRIHSLQLILRNAFKDADAVNSNTISIHTKLNDLKIDGMQELEAVTAEMVRLIETASVPIFAVDVDQGVNGWNTKVAELTGLPVDEAIGKHLLTLVEDSSVDTVNKMLELALQGQEERNVEFEIKTHGPSRDSSPISLIVNACASKDVRDSVVGVCFIAQDITGQKSIMDKFTRIEGDYRAIIQNPHPLIPPIFGTDQFGWCSEWNSAMTMLTGWRRDDVMDKMLLGEVFGTQAACCRLKNQEAFVNFGVILNNAITGQESEKIPFGFFARYGKYVECLLCVSKRLDKEGAVTGLFCFLQLASHELQQALHVQRLSEQTALKRLKVLAYIRRQIRNPLSGIIFSRKMLEGTSLGEEQKNILHTSAQCQRQLDKILDDTDLDSIIEGYLDLEMLEFKLHEVLVASISQVMMKSNGKNIMISNDMVEDLLNETLYGDSPRLQQVLANFLLVSVNSTPSGGKLSISQKLTKDRIGESVQLALLEFRIRHTGGGVPEELLSQMFGSEADASEEGISLLVSRKLVKLMNGEVQYLREAGRSTFIISVELAVATKSS

SEQ ID NO: 6427 - protein, 221 aa, Arabidopsis thaliana
  misc_feature (86)..(86): Xaa can be any naturally occurring amino acid
  misc_feature (118)..(118): Xaa can be any naturally occurring amino acid
  misc_feature (127)..(127): Xaa can be any naturally occurring amino acid
MGQQNLIYSFVARGTVILVEYTEFKGNFTAVAAQCLQKLPSSNNKFTYNCDGHTFNYLVENGFTYCVAAVESVGRQIPMAFLERGXEDFNKRYGGGKATTAQANSLNREFGSKLKEHXMQYCVDHPXDEISKLAKVKAQVSEVKGVMMENIEKVLDRGEKIELLVDKTENLRSQAQDFRTTGTQMRRKMWLQNMKIKLIVLAIIIALILIIVLSVCHGFKC

SEQ ID NO: 6428 - protein, 279 aa, Bacillus cereus
MKNLQSTTTLHNGVEMPWFGLGVFKVEEGPELVEAIKSAIKAGYRSIDTAAIYGNEAAVGEGIRAGIEATGISREELFITSKVWNADQGYEETIAAYEESLKKLQLDYLDLYLVHWPVEGKYKDTWRALETLYKEKRVRAIGVSNFQIHHLQDVIKDAEIKPMINQVEYHPRLTQKELQAFCKEQGIQMEAWSPLMQGQLLDNETLQEIAEKHGKTTAQVILRWDLQNGVITIPKSTKEQRIIANADVFNFELTKEDMEKIDALNQNHRVGPDPDNFDF

SEQ ID NO: 6429 - protein, 504 aa, Solanum tuberosum
MSSRGGGIAESPYLRNYRVGKTLGHGSFGKVKIAEHLLTGHKVAIKILNRRKMKTPDMEEKLRREIKICRLFVHPHVIRLYEVIETPTDIYVVMEYVKSGELFDYIVEKGRLQEDEARKIFQQIIAGVEYCHKNMVVHRDLKPENLLLDARRNVKIADFGLGNIMRDGHFLKTSCGSPNYAAPEVVSGKLYAGPEVDVWSCGVILYALLCGTLPFDDENIPNLFKKIKSGVYTLPSHLSPLARDLIPRMLIVDPMKRISVPDIRQHQWFKIHLPRYLAVPPPDARQHLKKLDEEILQQVSRMGLDRDQLLDSLQKRIQDDATVAYYLLYDNRSMASSGYLGAEFQESVDCYSPGLFPNLDLQLSTGNGVSEESLRRPFRKEKMWLVGLQSPANPKEIMNQVLGTLLELNVRWKKIGHYNMKCLWCHDLHLHSMANNHMNDDDHFISNATAISTHLQPQPTVKFEMQLYKTEDEKYLLDLQRISGPQFLFLDFCAGFIRQLEGPQ

SEQ ID NO: 6430 - protein, 323 aa, Sporidiobolus salmonicolor
MVGTTTLNTGASLELVGYGTWQAAPGEVGQGVKVAIETGYRHLDLAKVYSNQPEVGAAIKEAGVKREDLFITSKLWNNSHRPEQVEPALDDTLKELGLEYLDLYLIHWPVAFPPEGDITQNLFPKANDKEVKLDLEVSLVDTWKAMVKLLDTGKVKAIGVSNFDAKMVDAIIEATGVTPSVNQIERHPLLLQPELIAHHKAKNIHITAYSPLGNNTVGAPLLVQHPEIKRIAEKNGCTPAQVLIAWAIVGGHSVIPKSVTPSRIGENFKQVSLSQEDVDAVSKLGEGSGRRRYNIPCTYSPKWDINVFGEEDEKSCKNAVKIK

SEQ ID NO: 6431 - protein, 131 aa, Zea mays
LSDEARQMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 6432 - protein, 641 aa, Listeria monocytogenes
MKFNSMFSPIDIGPMKVPNRFVVSPMCNNYANTDGTLSDTSLAYYKERALGGFGLITFEATVVDVRAKGGANKACLYSDHQIASFKRVIDVCHDAGAKISVQLQHAGPEGNSKVSGYPLRAASAIASAAGRNTPEAISREELYELIELYGEAALRAKKAGADAVEVHCAHGYLVSSFLSARTNKRVDEFGGCFENRMRLPRLIIESIRKRVGHSIAILCRINSTDGVDGGLSVQDSATVAAYLEDCGLDGLHVSRSVHIRDEYMWAPTVLHAGFSSDLVTQIKRAVSIPVITVGRFTEPHYAELMVREGRADLVAFGRQSLADPETPNKAAAGKLDELLPCIACLQGCVANMYAGKPITCLVNPLLGRESEAYLPKTPSKKVVVIGGGVGGLYAGWMAGSRGHDVTVYEASDMIGGQMRLAAYPPGKGDLTNMVRSYIKKCEQFDVEIKTNTPVTPELIQEVAPDAVIIATGATPLVLPIPGIEDAGLIHAVDLLDGKEKCGQKVLVVGGGMVGSETAAFLGEAGHDVTVVELRDEVGADVISEHRKFLMRDFDEYKIKSVTNAKVTSFFEDGVTYSLADNKEHRIDGFDSVVLAMGSRAYNPLEETIKKIVPETYVIGDAIRARRALDATKEALDAVLQL

SEQ ID NO: 6433 - protein, 157 aa, Chlamydomonas reinhardtii
MALSNYVFGNSAADPFFTEMDRAVNRMINNALGVAPTSAGKAGHTHAPMDIIESPTAFELHADAPGMGPDDVKVELQEGVLMVTGERKLSHTTKEAGGKVWRSERTAYSFSRAFSLPENANPDGITAAMDKGVLVVTVPKREPPAKPEPKRIAVTGA

SEQ ID NO: 6434 - protein, 348 aa, Solanum tuberosum
ADFGLGNIMRDGHFLKTSCGSPNYAAPEVVSGKLYAGPEVDVWSCGVILYALLCGTLPFDDENIPNLFKKIKSGVYTLPSHLSPLARDLIPRMLIVDPMKRISVPDIRQHQWFKIHLPRYLAVPPPVARQHLKKLDEEILQQVSRMGLDRDQLLDSLQKRIQDDATVAYYLLYDNRSMASSGYLGDEFQESVDCYSPGLFPNLDLQLSTGNGVSEESLRRPFRKEKMWLVGLQSPANPKEIMNQVLGTLLELNVRWKKIGHYNMKCLWCHDLHLHSMANNHMNDDDHFISNATAISTHLQPQPTVKFEMQLYKTEDEKYLLDLQRISGPQFLFLDFCAGFIRQLEGPQ

SEQ ID NO: 6435 - protein, 208 aa, Glycine max
MEAETSNGGGIGGLYVKVMTDDQMELLRQQISVYATICEQLVEMHKAVTTQQDLAGLRLGNLYCDPLMACSGHKITARQRWTPTPLQLQILERIFDEGNGTPSKQKIKDITIELGQHGQISETNVYNWFQNRRARSKRKQLTPAPNVVEPEVESPKEKKTRAEGFQVQPYENSSPHRIKDMYIQSPDIGFDQLLGKIEVASCYSSYFL

SEQ ID NO: 6436 - protein, 247 aa, Unknown
  Gerbera hybrid cultivar
MGRGRVELKRIENKINRQVTFAKRRNGLLKKAYELSVLCDAEVALIIFSNRGKLFEFCSTSNMLKMLERYQNCTYGSMEVDRSTPNAEQSSYKEYMKLKAKYESLQQYQRQLFGEDLGPLSLKELEQLERQLDSTLRQIRSIRTQSMLDRLSELQVKERMWVEANKALQNKLEEVYAENQAGPSWAAGEHHSSYGQEHQHQHQSQGFFQPLDCNSNLQIGYNTVDSSHITASTNGQNLNGLIPGWML

SEQ ID NO: 6437 - protein, 496 aa, Staphylococcus aureus
MDDKQHTTSSDDERAENATSNQDQQTNSSKRVHLKRWQFISILIGTIIITAVITVVAYIFINQKISGLNKTDQANLNKIENVYKILNSDYYKKQNSDKLSKAAIDGMVKELKDPYSEYLTKEQTKSFNEGVSGDFVGIGAEMQKKNDQIMVTSPMKGSPAERAGIRPKDVITKVNGKSIKGKALDEVVKDVRGKENTEVTLTVQRGSEEKDVKIKREKIHVKSVEYKKKGKVGVITINKFQNDTSGELKDAVLKAHKDGLKKIVLDLRNNPGGLLDEAVKMANIFIDKGKTVVKLEKGKDTEAIQTSNDALKEAKDMDISILVNEGSASASEVFTGALKDYNKAKVYGSKTFGKGVVQTTREFKDGSLLKYTEMKWLTPDGHYIHGKGIKPDVTIDTPKYQSLNVIPNTKTFKVGDDDKNIKTIKIGLSALGYKVDNESTQFDQALENLVKAFQQANKLEVTGEFNKETNNKFTELLVEKANKHDDVLDKLINILK

SEQ ID NO: 6438 - protein, 247 aa, Unknown
  Gerbera hybrid cultivar
MGRGRVELKRIENKINRQVTFSKRRNGLLKKAYELSVLCDAEVGLIIFSSRDKLYEFGSVGVMKTLERYQRCCFNPQDNNNERETQSWYQEVSKLKAKFESLQRTQRHLLGEDLGPLSVKELHNLEKQLEGALTQARQRKTQIMVEQMEELRRKERELGDMNKHLKIKVSHELSTFDAEGQGYRAQLPCPWNSGTNNTFTMHPSQSNPMDCQQEPILQIGYNQFMHGEGSSVQRNMVGENGIHGWVL

SEQ ID NO: 6439 - protein, 562 aa, Sinorhizobium meliloti
MPPPLPERRHLICACVGTYCGCGSNPPSGSSPFVPASFFVPAEGTAEPRCGGVSSPRSRAGFSPRIRALISSPVSVSYSSKPSARATNSLTAGPRGGIMLQDYQLIEKLAHQNRERIPERVVHAKGWGAFGSLKITGDISQYTRAKCLQPGAETPMLARFSTVAGEQGAADHERDVRGFALKFYTDEGNWDLVGNNTPVFFIRDPYKFPDFIHTQKRHPKTNLRSATAMWDYWSLSPESLHQVTILMSDRGLPQTPMHMNGYGSHTYSFWNDAGERYWVKFHFKTQQGHKFFTNEEGEAVIGKTREGYQESLFYAIENGEFPRWTVQVQIMPELDVEKTPYNPFDLTKVWPHADYPPVEIGVLELNRNPENYFAEIENAAFSPSNIVPGIGFSPDKVLQARIFSYADAHRYRLGTHYEHIPVNQPRCPVHHYHRDGQMNTYGGIRTGNPDAYYEPNSFNGPAEQPLAKEPPLRIDGDMSRYDHRVGNDDYVQVRALFGLFDEGQKSRLFSNIAAAMGGVPGEIIERQLIHFARVHPEYEAGVRQALKTAHGYEADTISTAAE

SEQ ID NO: 6440 - protein, 146 aa, Medicago sativa
MASDSFTDKNAVFRKLKTKSENKSCFDCNAKNPTWASVTYGIFLCIDCSAVHRSLGVHISFVRSTNLDSWSPEQLKMMSFGGNSRAQVFFRQHGWNGDGKVEAKYTSRAAELYKQLLSKEVAKSMSEEAALSAPPAASSQSAQGAN

SEQ ID NO: 6441 - protein, 357 aa, Candida glabrata
MGKKIVFNISSDFQLKSLLGEGAYGVVCSAVHKPTGEIVAIKKIVPFDKPLFALRTLREIKILRRFQHENIISIFDIQKPESFEKFNEVYIIQELMQTDLHRVIATQTLTDDHIQYFIYQTLRAIKTLHGSNVIHRDLKPSNILINSNCDLKVCDFGLARIIDSGENGDNEVDKIGMTEYVATRWYRAPEVMLTNAKYSRAMDIWSCGCILGELFLKRPLFPGKDYRHQLLLIFGLIGTPDSSDKSMECIESRRARQYIASLQKYPPVRPLQKAFPGVNPVGVDLLSRMLVFDPRERISADDALAHPYLSTYHVPEDEPAGEPIPPDFFQFDQYKEVLTTKDLKKLLWNEIFHEQAT

SEQ ID NO: 6442 - protein, 547 aa, Myxococcus xanthus
MAAKEIFFHQSAREAILRGVRTLSDAVAVTLGPKGRNVVIEKSFGSPTITKDGVTVAKEIDLENKFENMGAQMVKEVASKTSDKAGDGTTTATVLARAIYEEGLKLVAAGHSPMDLKRGIDKAVEVVVGELKSLSKPTADKKAITQVGTISANGDETIGAIIADAMEKVGKEGVITVEEAKGLETTLDVVEGMQFDRGYVSPYFVTNRERMEAVLEDPYILISEKKVSSMQDMIPLLEQVARSGKPLIIIADDIEGEALATLVVNKIRGVLNVCAVKAPGFGDRRKEMLQDIAVLTGGTVVSEDLGHKFETLTLTDLGRAKRVTVDKDNTTVVDGVGTKAAIEGRIKLIRTQIDSVTSDYDREKLQERLAKLVGGVAVINVGAATETEMKEKKARVEDALHATRAAVEEGIVPGGGVAYLRALPALEKLKPGGEQDFGVAIIRRALQEPLRKIASNAGVEGAVVINKVREGTGAFGYNARTEVYEDLEKAGVIDPTKVERTALQNAASVASLLLTTEAMVAERPKGKAKGGGAGAGMPDYGGDDMDY

SEQ ID NO: 6443 - protein, 398 aa, Kluyveromyces lactis
MSFMNFEPKPLADTDIFKPIKIGNTELKHRVVMPALTRMRALHPGNVPNPDWAVEYYRQRSQYPGTMIITEGAFPSAQSGGYDNAPGVWSEEQLAQWRKIFKAIHDNKSFVWVQLWVLGRQAFADNLARDGLRYDSASDEVYMGEDEKERAIRSNNPQHGITKDEIKQYIRDYVDAAKKCIDAGADGVEIHSANGYLLNQFLDPISNKRTDEYGGSIENRARFVLEVVDAVVDAVGAERTSIRFSPYGVFGTMSGGSDPVLVAQFAYVLAELEKRAKAGKRLAYVDLVEPRVTSPFQPEFEGWYKGGTNEFVYSVWKGNVLRVGNYALDPDAAITDSKNPNTLIGYGRAFIANPDLVERLEKGLPLNQYDRPSFYKMSAEGYIDYPTYEEAVAKGYKK

SEQ ID NO: 6444 - protein, 143 aa, Manihot esculenta
VYREWAPAAQEAQVIGDFNGWIGSNHRMEKNEFGVWSINIPDSGGNPAIHHNSRVKFRFKHGDGVWVDRIPAWIRYATVDPTNLQPYDGVYWDPPPPERYQFNYPRPPKPQAPRIYEAHVGMSSSEPRINTYREFADDVLRRI

SEQ ID NO: 6445 - protein, 711 aa, Bacillus halodurans
MDKDQQGTESSENKKNEQLEPFKVDHKNTKLTTNQGVRVSDTDDSLKAGDRGPTLMEDFHFREKMTHFDHERIPERVVHARGFGAHGYFQVYEPMTEYTKASFLQDPNVKTPVFVRFSTVVGSRGSADTVRDVRGFATKFYTEDGNYDLVANNIPIFFIQDAIKFPDVVHALKPEPHNEIPQASAAHDTFWDFVVSNTETAHMIMWLLSDRAIPRSFRMMEGFGVNTFRFVNEQGKARFVKFHWKPKLGVHSLVWDEAQKLAGKDPDFHRRDLWEAINMGEYPEYELGVQMIEEEDEFSFDFDILDPTKFWPEEMVPVKLIGKMTLNRNQDNFFAETEQVAFHAGNVVPGIDFSNDPLLQGRLFSYLDTQLLRLSGPNFHEIPINRPIAPVNNNQRDGFHRMTIDKGAVSYSPNTLRNNSPEPASDQEHGYVHYMEKVEGQKIRRRSESFNDHFSQATLFWNSLSTAEKQHLIKAFHFEVGSVKDKNLKQRVVEMFNQVDGKLAAEIAKGIGVNPPTTPGGTGVTASSPAVSQENTIKLARTRKVAVLIDHGFAFDEVSQVVTALQSAGLGVDLVSKQLGMISSAEGEQLEANKSFATTGAIMYDALYIGGGAQSISSLNLYSESKTFVDEAFKHAKTIGATNEGIELLIAAQVQGITFAGPDSNDHVVNDLGIITIQTDKDFKAFTDEMIHAIAQHRHWMREFKDGKLSG

SEQ ID NO: 6446 - protein, 548 aa, Unknown
  Buchnera sp. 150
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGVVELENPYILMADKKISNVREMLPILESVAKSGKPLLIISEDLEGEALATLVVNSMRGIVKVAAVKAPGFGDRRKAMLQDISVLTGGSVISEELAMDLEKSTLEDLGQAKRVVINKDTTTIIGGVGEKQAIQSRISQIRQEIQEATSDYDKEKLNERLAKLSGGVAVLKVGAATEVEMKEKKARVEDALHATRAAVEEGVVAGGGVALVRVAGKISNLRGHNEDQNVGIRVALRAMEAPLRQIVSNSGEEPSVVTNNVKDGKGNYGYNAATDEYGDMIDFGILDPTKVTRSALQYAASVAGLMITTECMVTDLPKEDKTSDASSSPAGGMGGMGGMM

SEQ ID NO: 6447 - protein, 431 aa, Thermus thermophilus
MTENAEKFLWGVATSAYQIEGATQEDGRGPSIWDAFAQRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRFFLDPILGKGYPESPFRDPPPVPILSRDLELVARPLDFLGVNYYAPVRVAPGTGTLPVRYLPPEGPATAMGWEVYPEGLHHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 6448 - protein, 537 aa, Unknown
  Buchnera sp. 168
ARVKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTVLKNELEVVKGMQFDRGYLSPYFINKPETGVVELENPYILMADKKISNVREMLPILESVAKSGKPLLIISEDLEGEALATLVVNSMRGIVKVAAVKAPGFGDRRKAMLQDISVLTGGSVISEELAMDLEKSTLEDLGQAKRVVINKDTTTIIGGVGEKQAIQSRISQIRQEIQEATSDYDKEKLNERLAKLSGGVAVLKVGAATEVEMKEKKARVEDALHATRAAVEEGVVAGGGVALVRVAGKISNLRGHNEDQNVGIRVALRAMEAPLRQIVSNSGEEPSVVTNNVKDGKGNYGYNAATDEYGDMIDFGILDPTKVTRSALQYAASVAGLMITTECMVTDLPKEDKTSDASSSPAGGMGGMGGMM

SEQ ID NO: 6449 - protein, 222 aa, Solanum macrocarpon
MVRQKIQIKKIDNLTARQVTFSKRRRGLFKKAQELSTLCDADIGLIVFSATGKLFEYSSSSMMQLIEKHKTQSERDNMNGSEQLKSSNLQSEKKTYAMLSRELVEKNRELRQLHGEELQGLGLDELMKLEKLVEGGISRVLKIKSDKFTREISSLKKKEAQLQEENSQLKHQSQARLNEEGQNAIEQGHSADSITNNRSLVSSHQDYDDSDTSLKLGLGFPY

SEQ ID NO: 6450 - protein, 537 aa, Buchnera sp.
ARVKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTVFKNELEVVKGMQFDRGYLSPYFINKPETGVVELENPYILMADKKISNVREMLPILESVAKSGKPLLIISEDLEGEALATLVVNSMRGIVKVAAVKAPGFGDRRKAMLQDISVLTGGSVISEELAMDLEKSTLEDLGQAKRVVINKDTTTIIGGVGEKQAIQSRISQIRQEIQEATSDYDKEKLNERLAKLSGGVAVLKVGAATEVEMKEKKARVEDALHATRAAVEEGVVAGGGVALVRVAGKISNLRGHNEDQNVGIRVALRAMEAPLRQIVSNSGEEPSVVTNNVKDGKGNYGYNAATDEYGDMIDFGILDPTKVTRSALQYAASVAGLMITTECMVTDLPKEDKTSDASSSPAGGMGGMGGMM

SEQ ID NO: 6451 - protein, 252 aa, Gentiana triflora
MDSQNQEIESSNSRKSGRGKIEIKRIENKTNRQVTFCKRRSGLLKKAYELSVLCDAEVALIVFSSSGRLYEYANNSAKGTIERYKKACGDSTSAGSVSEANIQFYQQEANQLRKNIRDIQSSNRHILGEGLDELSFKQIKNLEGRVEKGIARVRSRKNELLAAEIELMKKREIELQNANLYLRAKQITENDQQRVQAEQQQMNFMPASDYQTNNNNIASEPNYQEVHNFIPVNFLDHNQHYSSQDPTALQFV

SEQ ID NO: 6452 - protein, 459 aa, Helicobacter pylori
MVLLTMTKRLFKGLLAISLAVSLHGGEVKEKKPVKPVKEDPQELAAKRVEAFSRFSNVVTEIEKKYVDKISISEIMTKAIEGLLSNLDAHSAYLNEKKFKEFQAQTEGEFGGLGITVGMRDGVLTVIAPLEGTPAYKAGVKSGDSILKINNESTLSMSIDDAVNLMRGKPKTSIQITVVRKNEPKPLVFNIVRDIIKIPSVYVKKIKDTPYLYVRVNSFDKNVTKSVLDGLKANPNIKGVVLDLRGNPGGLLNQAVGLSNLFIKEGVLVSQRGKNKEENLEYKANGRAPYTNLPVVVLVNGGSASASEIVAGALQDHKRAIIIGEKTFGKGSVQVLLPVNKDEAIKITTARYYLPSGRTIQAKGITPDIVIYPGKVPENENKFSLKEADLKHHLEQELKKLDDKTPISKEADKDKKSEEEKEVTPKMINDDIQLKTAIDSLKTWSIVDEKMDEKVPKKK

SEQ ID NO: 6453 - protein, 536 aa, Unknown
  Buchnera sp. 389
ARVKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGYDGVITVEEGTGLQNELEVVKGMQFDRGYLSPYFINKPETGVVELENPYILMADKKISNVREMLPILESVAKSGKPLLIISEDLEGEALATLVVNSMRGIVKVAAVKAPGFGDRRKAMLQDISVLTGGSVISEELAMDLEKSTLEDLGQAKRVVINKDTTTIIGGVGEKQAIQSRISQIRQEIQEATSDYDKEKLNERLAKLSGGVAVLKVGAATEVEMKEKKARVEDALHATRAAVEEGVVAGGGVALVRVAGKISNLRGHNEDQNVGIRVALRAMEAPLRQIVSNSGEEPSVVTNNVKDGKGNYGYNAATDEYGDMIDFGILDPTKVTRSALQYAASVAGLMITTECMVTDLPKEDKTSDASSSPAGGMGGMGGM

SEQ ID NO: 6454 - protein, 1065 aa, Cryptococcus neoformans
MSRVPSGSQQPQYTQQPLYHPSSVHSQSTPIQQTHQQYHPHTGQPMTFQGDAHAYSYDRQSQINTWQANPGAAGSMEYHSAVAGSSRGADPYQPYSQSHRSSPSQSVTASRTQPASAQQYTPWAPVQTSATTPSSRGGGVKLEDLMSSDSRAGGKNQPLSGIPLSVSASFDTRSQFSAGPQGASAEKEKDKERDKATQQQGPSEFIKKLYKMLEEEQAQYGNSRTKKGEKGKRGSVGWGANGTSFVVWDMNDFTTKILPQTFRHSNFSSFVRQLNKYGFSKIKHVDAGTGSIKENIWEFQHPNFQAGGKSDLESIKRKPVAPKKANNQEGDENSPRHIGLSNEDQTRMHLMEDRINMLEDALAKSRSEADEARMREMAMMGLVRDMIGHIAASESEAIGSPAATTGHSPRVLHLLKSLDNLARAYPPEMYHSNIARQPTTMPYTPAQPQSHQSFLNAAYNPAFSGNSVGGAAQAQASPHTDGTGSRGSFSGPSTGEIKPPASSSRLRAASNAGAAPSGSVNASVPLASQPTGNPPAGPVARAEDPAEDVIEIPNQMQDMYGGESVGIAPLFVETPAWLTEGTTVPLTMYRKQSDGQVLKAVYQAFAAGGKLPAGEGQDEDGNAIASGSSTSAAEIMAGSSQMGLQQSYGAGSSTSTGIPLPMEGSPSSESSSRKGKGKKSRGTSLKEQRESKLKPHWAQTPRILVVEDDIVYRTLSKKFLQKFGCETETVENAQGAVDKMNGTKYDLVLMDIFFGPNMDGRKATSLIRQFNNYTPIISMTSNAQPQDVDSYYQSGMNDILAKPFTKNHLFTILDKHLVHLRHAQLYERLIPLGVGVPPLSDQHVQEALAVSAANLQNTNGQLQLENGPTAETQNEQQDSNGELELGIRNPLAGSGWSDEAYQLVLAQFLQTGVMPDITTISAVSSSPNPNGIDGTIGTSIVFGESSGFSRKRSIEAISDDNWDGQAQTSASVQAQAQAQAQAQAQAQAQAQAQAQAQAQAQTQAQVQNTIMQGDQQQGMSLQMPMNVGMGMEVNMGNMPESGMMNQDISNGSDGREAKRARGMAG

SEQ ID NO: 6455 - protein, 279 aa, Staphylococcus epidermidis
MTNDVQILNNGYPMPAVGLGVYKIADEQMEEVVRTALDAGYRAFDTAYFYGNEKALGSALKHSNVERDELFITSKLWNDYQGYDQTIEYFNKSLDNLGLDYLDLFLIHWPCENDQLYIESYKALEHLYEEGKIKAIGVCNFKIHHLEKLMKETKITPQVNQIELHPYFNQQDVQDFCDEHDIKVTAWMPLMRNKGLLDDPVITDIAHRYDKTPAQIVLRWHLAHNRIIIPKSQTPKRIKENFDIFDFNLELTDVAEIDSLNKNARQGKDPDDVSIGDLK

SEQ ID NO: 6456 - protein, 119 aa, Brassica napus
MFFTSRLLSLPRRNMVLSRTSIDSNDTVSSTFGSRYDLIALPTYHIGDSSILVDAAYHIIKYDLMRASNPRLNLVSFVTTCMESTCDKLIMDFINRSYVDMDQYPVITELNKRCLNMIT

SEQ ID NO: 6457 - protein, 249 aa, Gentiana triflora
MDYPPRQEFDSSSSRKSGRGKIEIKRIENATNQQVTFCKRRSGILKKAYELSVLCDAEVALIVFSTRGRLYEYASSSVRGTIERYKKACADTTNSGSISEANTQFYQQQSNKLRKDIKEIQKANRNMLGEGVESIQPKDLKKIEGNLERAIGKIRTRKNELLFAEIELMQKREMELQNANLYLRAKIAENERATTDPHMNLMPASASEYHHHQSMASHSFDDVRSFIPVNLLEPNQHYSRQDPTALQLV

SEQ ID NO: 6458 - protein, 311 aa, Magnaporthe grisea
MTDITSYKFNHTMLKVKDPKASIAFYKHLGMDLLSEYKVPDHKLELYFVAGDSAISASHGTHQSDREGVLELSYSYGIENTSGGDQEPRGLRPVCLSVDNVKTTCKALCDAGYRINCNSEEETAHVLDPDGFWIKLIAHRSLGRIDDTATADCKGSKVHHTMIGVRDKNVSRKFYEQVFGMTWKYEQHSTQAGRDRFLLGCGKPHTSGPSVDISKPDVKCEGLLELLCSEDTKNKDGMEHHNGNLEPDDPGHICISVDDVHAACERLESLGVQWQKRLMDGPFRVAFVHDPDGNLIEIIQNEMYKPVKHEA

SEQ ID NO: 6459 - protein, 579 aa, Phaseolus vulgaris
MCGILAVLGCSDSSQAKRVRVLELSRRLKHRGPDWSGLHQYGDCYLAHQRLAIVDPASGDQPLFNEDKTIAVTVNGEIYNHEELRKQLPNHTFRTGSDCDVIAHLYEEHGENFVDMLDGIFSFVLLDTRDNSFIVARDAIGVTSLYIGWGLDGSVWISSELKGLNGDCEHFESFPPGHLYSSKEREFRRWYNPPWFSEAIPSAPYDPLALRHAFEKAVIKRLMTDVPFGVLLSGGLDSSLVAAVTARYLEGTNAAKHWGTKLHSFCVGLEGAPDLKAAREVADYIGTVHHEFHYSVQDGIDAIEDVIYHIETYDVTTIRASIPMFLMSRKIKSLGVKWDICGEGSDEIYGGYLYFHKAPNKEEFHQETCRKIKALHKYDCLRANKSTFAWGLEARVPFLDKEFIEVAMNVNPEYKMIKKEEGRIEKWVLRRAFDDGEHPYLPKHILYRQKEQFSDGVGYGWIDGLKGHAEKHVTDRMMLNAANIFPFNTPTTKEAYYYRMIFERFFPQDSARLSVPGGPSVACSTAKAVEWDAAWSNNLDPSGRAALGVHASAYGNQVKAVEPEKTIPKMEVSPLGVAI

SEQ ID NO: 6460 - protein, 620 aa, Unknown
  Nostoc sp. PCC 7120
MTFFTTRYLRGGYCMKIGAHYLGNGECEFTVWSPTLNSVAVQILKPEEKLIPLKAQGEGYWQIKVNDVYPGTLYRYQLNDQEAFADPASQYQPEGVHGASQVVDHKFEWTDKTWSGISLESMIFYELHVGTFTPEGTFTTIIPRLPELRELGINAIELMPIAQFPGDDHIEPDLAYRNWGYDGVYPFAVQNSYGSPADLKNFVNACHENGIAVVLDVVYNHFGPEGNYMGQFAPYFTRTYKTPWGNAMNFDDAYSQGVRNYFIQNALYWLGEFHIDGLRLDAIQAIYDLGAKHFLWELAEAVHNFSQGGTWKRHLIAESDLNNPQIIRPVESGGYGLDAQWSDDFHHALHALLTGDRQGYYQDFGKCADLAKAYADTFVYDWRYAPHRKRFHGISCRDRPLSQFSVCIQNHDQIGNQMQGERLSERISFAGLKLAAGAVLLSPYLPLLFMGEEYGETAPFIYFVSHSDLDLIQAVRAGRKEEFEAFHYAEDPPDPESAETFLRCKLNWELRHQGQHKVLWDWYRQLIHLRKTHPALLNYDRDNIEATSDEDKQIVVVRRWCESREVILAMNFNTSPVSLVLTIEKSARKLLDSADSEGFETLSVGEEVVLQPTSLVLYEV

SEQ ID NO: 6461 - protein, 244 aa, Gentiana triflora
MGRGKVELKRIENKINRQVTFAKRRNGLLKKAYELSVLCDAEVALIIFSNRGKLYEFCSGSSTTETVERYQRYTYGLQDAGHPSDDPQNSYQEYVKLKARVEVLQGYHRNFLGEDLGSLSCKELEHLEHQVETSLKQVRSTKTSFMLDQVADLQRKEEMLAEENKALRGKLDERANQVPLRLSWEGRQQAPTGYNNVPAHTQGFFQPLGLNSTLQMGYNQGGAEGNYNVHAGNNINGFMPGFMN

SEQ ID NO: 6462 - protein, 548 aa, Buchnera aphidicola
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGKNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMELEKSTLEDLGQAKRVVISKDTTTIIGGVGEKHTIQSRISHIRQEIQEATSDYDKEKLNERLAKLSGGVAVLKVGAATEVEMKEKKARVEDALHATRAAVEEGVVAGGGVALVRVAGKTSNLRGQNEDQNVGIRVALRAMEAPLRQIVSNSGEEPSVVTNNVKDGKGNYGYNAATDEYGDMIDFGILDPTKVTRSALQYAASVAGLMITTECMVTDLPKEDKSSDSNSSPAGGMGGMGGMM

SEQ ID NO: 6463 - protein, 453 aa, Arabidopsis thaliana
MSGSRRKATPASRTRVGNYEMGRTLGEGSFAKVKYAKNTVTGDQAAIKILDREKVFRHKMVEQLKREISTMKLIKHPNVVEIIEVMASKTKIYIVLELVNGGELFDKIAQQGRLKEDEARRYFQQLINAVDYCHSRGVYHRDLKPENLILDANGVLKVSDFGLSAFSRQVREDGLLHTACGTPNYVAPEVLSDKGYDGAAADVWSCGVILFVLMAGYLPFDEPNLMTLYKRVRICKAEFSCPPWFSQGAKRVIKRILEPNPITRISIAELLEDEWFKKGYKPPSFDQDDEDITIDDVDAAFSNSKECLVTEKKEKPVSMNAFELISSSSEFSLENLFEKQAQLVKKETRFTSQRSASEIMSKMEETAKPLGFNVRKDNYKIKMKGDKSGRKGQLSVATEVFEVAPSLHVVELRKTGGDTLEFHKVCDSFYKNFSSGLKDVVWNTDAAAEEQKQ

SEQ ID NO: 6464 - protein, 922 aa, Pseudomonas fluorescens
MQEKGVLKKLGIKGRVLLLTLLPTSLMALVLGGYFTWTQQSDLQTQLMQRGEMIAEQLAPLVAPAMGHGDAELLERIATQSLEQPDVRAVTFLAPDRSPLAHAGPTMLNQAPSGDSAHLLRRSGNDATRYLLPVFGKHRNLAGELIPQESDRLLGWVELELSHNGMLLRGYRSLFASLLLIGAGLAGAALLALRMGRTINRPLSQIKQAVAQLKDGHLETRLPPLGSQELDELASGINRMAGTLQNAREELQHSVDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDHIPFNLRDLLQDTLTILAPAAHAKQLELVSLVYRDTPLSLVGDPLRLKQILTNLVSNAIKFTREGTIVARAMLEEENDDSVQLRISIQDTGIGLSNQDVRALFQAFSQADNSLSRQPGGTGLGLVISKRLIEQMGGEIGVDSTPGEGSEFWISLNLPKTRDDAEDLPAAPLLGRRVAVLENHELARQALQHQLEDCGLDVTPFNTLESLTNGVTGAHQTDQAIDLAVLGITSNDMPPERLNQHIWDLEHLGCRVLVLCPTTELTLYHLSVPNPHSQLQSKPACTRKLRRALSDMVNPRQSRSEPGEPLSSRAPKVLCVDDNPANLLLVQTLLEDMGAKVLAVESGYAAVKAVQSESFDLVLMDVQMPGMDGRQSTETIRQWESERHCTPLPIVALTAHAMANEKRALLQSGMDDYLTKPISERQLAQVVLKWTGLALRNQAPDRGGESLLGNQELPILDHEEGLRLAAGKADLAADMLAMLLASLEADREAIRTARDHQDQNALLERVHRLHGATRYCGVPQLRAACQRSETLLKQDDPKASAALDELERAINRLAAQAKISA

SEQ ID NO: 6465 - protein, 625 aa, Musa acuminata
MDGCDCIEPQWPADELLIKYQYISDFFIALAYFSIPLELIYFVKKSSFFPYRWVLIQFGAFIVLCGATHLINLWTFALHSRTLAIVMTVAKVSTAVVSCATALMLVHIIPDLLSVKTRELFLKNKAEELDREMGLIRTQEETEGNVRMLTHEIRSTLDRDTVLKTTLVELGRTLDLKDCMLWMPSHSGTSLQLSHTLHHQIPTGSAVPINLPVVNQIFSSNHAMIIPHTCRLARIWPLSVRHVPPEVAAVRVPLLHLSNFQISDWSELSTKSYAVMVLILPSDSGRKWHVHELELVEVVADQVAVALSHAAILAESMRARDLLTEQNVALYLARQEAELAIRARNDFLAVMNHEMQTPLHATITLSSLLLETELSPEQRSMVETVLKSSSLLATLINDILDLSRLEDGRLELEIGDFNLHSVFREVMNFIKPIRAVKKLQVSLMLSPDLPLYAIGDEKRLMQIMLNVAANAVRFTKEGDISLTASVARTDYLREFRALDFYPVASDGHFYLRVTIKDTGCGISHQDLPNLFTKFSQSQNVSSQGYSGNGLGLAICERYVSLMQGHIWVESDGIGKGCTATFVVRLRLCENPDGSQQKILPLPWKKQTQKFSSSRGMPTDPGGLFD

SEQ ID NO: 6466 - protein, 466 aa, Glycine max
  misc_feature (411)..(411): Xaa can be any naturally occurring amino acid
MTSRSGQGSSGGGSSRTRVGKYELGRTLGEGNFAKVKFARHVETRENVAIKILDKEKLLKHKMIAQIKREISTMKLIRHPNVIRMYEVMASKTKIYIVLEFVTGGELFDKIARSGRLKEDEARKYFQQLICAVDYCHSRGVFHRDLKPENLLLDANGVLKVSDFGLSALPQQVREDGLLHTTCGTPNYVAPEVINNKGYDGAKADLWSCGVILFVLMAGYLPFEETNLSALYKKIFKAEFTCPPWFSSSAKKLINKILDPNPATRITFAEVIENDWFKKGYKPPVFEQANVSLDDLDSIFSDSTDSQNLVVERREEGPMAPVAPVTMNAFELISKSQGLNLSSLFEKQMGLVKRETRFTSKCSADEIISKIEKAAGPLGFDVKKNNCKLKIQGEKTGRKGHLSVATECCFXILEVAPSLYMVELRKSEGDTLEFHKFYKNLATGLKDIVWKAEPIDEEKDGANPSK

SEQ ID NO: 6467 - protein, 684 aa, Botryotinia fuckeliana
MMEKGGDMAGPSANNSSDFVSIHTQHTCTFSRRDGANIEISSLTDVSFTGPKIIQVRKYLVRMLEDPTYESIVRWGEAGESFVVLENEKFTKQILPKHFKHSNFASFVRQLNKYDFHKVRQNNEDNTQSPYGQNAWEFKHPEFQANKKDSLDNIRRKAPAPRKVAQSNEETYPAHAQQQMDLLGNQLAATQQQLQGLSRSYQDLAQLNIMLLQQVVDAQKFIKNHEGVMHGLVGHLFSQDAQRRNGRAPGLSNGAGPNMLGRPTEDGHPSTPLLQARSLLGQLSAENFPSKELEQMSHDYHLRQDYSTPPNDPGGLVSMPPISESVTAPSAGYSMDKSELDNLVYPVGAIVGIDPIDQQHVNNIPYALPPQGLMPRDSMPPAELMPQPPRAPGPRKKGMVSIWGERKPRILLVEDDQVCARIGTKFLESFECGVDIARDGLEAVSKINLGAENHFDLILMDIIMPHLDGVSATVCIREIRANIPIIAMTSNIRTDDIEMYFRYGMNDVLPKPFTKEGMMKALEKHLAHFRKDAPSIGFSSPGPMSHPGGFVTPTQSQSHPPLGLNMGQLTATQSIVDDTASGKSPQTATSWQSPIQLPGGSPVVTSAPGSYMQPTNGMRDPSYSVTPTHPHSQSGFAPPLSGLGNQRPPHRRGISDISGASTPDGNSDQKRQRMYAPPGNYQQG

SEQ ID NO: 6468 - protein, 634 aa, Bipolaris oryzae
MPPKRKSNGIPHNVKSANKYTDASGNAPNKRSRIAKPLDKASTNSAPLIDAIVRNSKNGAPGDAVKKEEGNFDHSRPEERAGIVDRQYYPAEMSNERCAMYNANEIPRPIAILEKTLKDTKQRRDKIQSGNENGHGDAVMHWFKRDLRVRDNTGLSKAAELAKSKGIGLVAVWIMSPQDWEAHLVSPPKCDFELRSVQLLKQELEELDIPLYIETVHERKNIKKRLVEMALEWNVKSVFCNLEYEPDELRREERLVRMMLEKGINMDPQHDDCVVPPGSLKTGTGKQYAVYTPWYRAWIAYLHAHPHLLNERSMPEKNPTGFREKFTKLFDSRVPDLPDCKSLTAEEKERFHHLWPAGEAAAIDRLERFLTEKVIKYKDTRNFPALNSTGRISAHHAAGTLAARTSVRMARDINSVKKLDGGKEGIKGWIGEVAWRDFYRHVLVHWPYVCMNKPFKYEYTNIEWEYNDAHFEAWTQGRTGYPIVDAAMRCLKHTGYMHNRLRMITASFLAKHLLLDWRLGEQYFITHLIDGDFASNNGGWGFSASTGVDPQPYFRIFNPWTQSEKFDEQGEFIRLWVKELEDVQGAAIHNPYQAKGEAAKIAKKNGYPEPIVEHKFARERCLARYKAGIGRETA

SEQ ID NO: 6469 - protein, 283 aa, Listeria monocytogenes
MKTVKLNNGVEVPILGFGTYQITDAAEAEQAVKDAIETGYRHIDTAQSYMNEEAVGRGIVASGVDRKELFITTKIWVENVSYKGVMSSFDRSLKRLGLDYIDLLLIHQPFNDVYGAWIAMEELQASGKIRAIGVSNFSPDRVIDLAAFNEVTPQVNQIEVNPFQQQAANLAVLRKEGVAIEAWAPFAEGKNDIFNNPVLTKIGAKYGKSAAQVILRWLVEQDIIVLAKSVKPERMAQNLAIFDFELTEADKGEIASLDQGESQFFSHADPEMVKWMASRKLNV

SEQ ID NO: 6470 - protein, 286 aa, Listeria monocytogenes
MILPGNGTIPYIGLGVFQVTEQEFIAGAVEKAIEVGYRLFDTAAVYNNEAIVGQAIASSAVSREELFISSKVWNGDLGYDETLFAFERTLRNLKLDYLDLYLIHWPVAGKYRDSWRAMERLHDEKLIKSIGVANFKQHHLSDLLVAANEKPVLNQVETHPLLPQNDLRKYLVEQNIAHAAWSPLAKGILMQNPVITEIAKKHQASVDQVILQWHLNRNTIIFPKSITSSRIEENSRLSYFQLDASDMEKIDRLETGKRVGPDPDDLEYFLSSIERERAYLASENEE

SEQ ID NO: 6471 - protein, 495 aa, Zea mays
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFCTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTHEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAPPVPIPARPVVGKRQKETIQKPNDFKQPGERYRSWDANRQERFVRRFADSLGHPKVSQELRSIWIDLLSKCDASLGMKIATRLNMKPNM

SEQ ID NO: 6472 - protein, 396 aa, Bartonella koehlerae
LGQAIVQEGVKAVAAGMNPMDLKRGIDAAVDEVVANLFKKAKKIQTSAEIAQVGTISANGAAEIGKMIADAMEKVGKEGVITVEEAKTAETELEVVEGMQFDRGYLSPYFVTNAEKMVTDLDDPYILIHEKKLSNLQSLLPVLEAVVQSGKPLLIIAEDVEGEALATLVVNKLRGGLKIAAVKAPGFGDRRKAMLEDIAILTSGQVISEDIGIKLENVTLDMLGRAKKVNISKENTTIIDGAGQKSEISARVNQIKVQIEETTSDYDREKLQERLAKLAGGVAVIRVGGATEVEVKEKKDRVDDALNATRAAVEEGIVAGGGTALLRAANALTVKGSNPDQEAGINIVRRALQAPARQIATNAGEEAAIIVGKVLENNADTFGYNTATGEFGDLIA

SEQ ID NO: 6473 - protein, 279 aa, Bacillus cereus
MKNLQSKAVLNNGVEMPWFGLGVFKVEEGPELVEAVKSAIKAGYRSIDTAAIYGNEKAVGEGIRAGIEATGIAREELFITSKVWNADQGYETTIAAYEESLKKLGLDYLDLYLVHWPSEGKYKDTWRALETLYKEKRVRAIGVSNFQIHHLQDVMKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 6474 - protein, 302 aa, Zea mays
  misc_feature (292)..(292): Xaa can be any naturally occurring amino acid
MSNAASTTPLLAHYKMGKFDLSHRVVLAPLTRERSFGNVPQPHAILYYQQRATKGGLLIAEATGVSDTAQGYKDTPGIWTKKQVEAWKPIVDGVHAKGGIFFCQVWHVGRVSNHTFQPNGQAPISSTDKPIKPATRADGIGLAKVSTPRRLTTDEIPLVIDDFRVAARNAIEAGFDGVEIHGAHGYLIDQFLKDQVNDRTDKYGGSLENRCRFALEVVQAVADEVGADKIGIRLSPFASYSDASDSNPEALGLYMAQALNKLEILYCHMVEPRMVNIGEKLETPHSLRAMRXAFRGTFIVAG

SEQ ID NO: 6475 - protein, 164 aa, Triticum aestivum
TGATTIMRSDLVYDCGQSLNPAVDLGQVEGAFVQGVGFFTNEDYATNADGLVVHDGTWTYKIPTVDTIPKQFNVELISSARENKRVLSSKASGEPPLLLAASVHCAMREAIRAARTDFSVNSPLTFQMDVPATMADVKELCGLDVVERHLQSLSSAAEVPTPVA

SEQ ID NO: 6476 - protein, 118 aa, Candida glabrata
MGNTTEDDIDKQIELREQDRWLPINNVARLMKNTLPETAKVSKSAKECMQECVSEFISFVTSEASDRCAQDRRKTINGEDILISLHALGFENYAEVLKIYLAKYRQQQALKNNYEEDS

SEQ ID NO: 6477 - protein, 222 aa, Physalis peruviana
MVRQKIQIKKIDNLTARQVTFSKRRRGLFKKAQELSTLCDADIGLIVFSATGKLFEYSSSSMMQLIEKHKMQSERDNMDSVEQLQSSNLQSEKKTHAMLSREFVDKNRELRQLHGEELQGLGLEELMKLEKLVEGGISRVLKIKGDKYMREISSLKKKEAQLQEENSQLIHQSQARLNEGGQNVIEQGHSADSIANNLSLVNSHQDYDDSDTSLKLGLAYPY

SEQ ID NO: 6478 - protein, 443 aa, Zea mays
MEDAMAADGKSVLQGRYELGRVLGHGNFGRVHAARDLRTGRSVAVKVVAKDKLERAGMAEQIKREIAVMKMVSHPNIVELHEVMATRSKIYLALELVRGGELFSRIARAGRVREDVARCYFRQLVAAVDFCHGRGVFHRDLKLENLLLDEVGNLKVADFGLSALAGHARSDGLLHTACGTPSYVAPEVLGGKGYDGAKADLWSCGVILYVLLVGSLPFHEDNLMVMYRKMQRGEFLCPPWVSADARKLIGELLDPDPSTRITVARLVETPWYRKPLPVLPPLNLKEPTPDARRATSDKEEPEVLNAFHLISFSEGFDLSPLFDQGRGGGVGRSSAGGIRFVTREAASSVVSRLESLVTGRGANMRVTKSGSRGVRLEAVSRGRSGARLAVAAEIFSVAPSVLLVDVKKDGGDTMEYRSFCSEELRPALKDIVWASSQDTPGAA

SEQ ID NO: 6479 - protein, 207 aa, Fusobacterium nucleatum
MRVKCFHLGAYGTNCFLAYDENNIAYFFDCGGRNLEKVYEFISEHNLDLKYIVLTHGHGDHIEGLNDLASHYPEAKVYIGEEDKDFLYNSELSLSDAIFGEFFKFKGEIHTVKESDMVGDFKVIDTPGHTIGSKSFYYEKDKILISGDTLFRRSYGRYDLPTGSLEMLCHSLKKLSKLPDETVVYNGHTDNTTIGEERRFLERVGIL

SEQ ID NO: 6480 - protein, 222 aa, Physalis peruviana
MVRQKIQIKKIDNLTARQVTFSKRRRGLFKKAQELSTLCDADIGLIVFSATGKLFEYSSSSMMQLIEKHKMQSERANMDSLEQLQSSNLQSEKKTHAMLSREFVDKNRELRQLHGEELQGLGLEELMKLEKLVEGGISRVLKIKGDKYMREISSLKKKEAQLQEENSQLIQQSQARLNEEGQNVIEQGHSADSIANNLSLVNSHQDYNDSDTSLKLGLAYPY

SEQ ID NO: 6481 - protein, 246 aa, Glycine max
  misc_feature (19)..(19): Xaa can be any naturally occurring amino acid
MEFPTEAILSEGSISQKKXGRGKLEIRGIENTTNRQVTFCKRRNGLLKKAYELSVLCDAEVALVVFSSRGRLYEYANNSVRGTIERYKKACAASTNAESVSEANTQFYQQEASKLKRQIRDIQNLNRHILGEGLSSLSLKELKNLESRLEKGLSRVRSRKHETLFADIEFMQKREIELQNHNNFLRAKIAENERAQQRQQDMIPGTECESTIPNSQSYDRNFFPVNLIDSNNNQYSRQDQTALQLV

SEQ ID NO: 6482 - protein, 731 aa, Mycobacterium tuberculosis
MSRSEKLTGEHLAPEPAEMARLVAGTHHNPHGILGAHEYDDHTVIRAFRPHAVEVVALVGKDRFSLQHLDSGLFAVALPFVDLIDYRLQVTYEGCEPHTVADAYRFLPTLGEVDLHLFAEGRHERLWEVLGAHPRSFTTADGVVSGVSFAVWAPNAKGVSLIGEFNGWNGHEAPMRVLGPSGVWELFWPDFPCDGLYKFRVHGADGVVTDRADPFAFGTEVPPQTASRVTSSDYTWGDDDWMAGRALRNPVNEAMSTYEVHLGSWRPGLSYRQLARELTDYIVDQGFTHVELLPVAEHPFAGSWGYQVTSYYAPTSRFGTPDDFRALVDALHQAGIGVIVDWVPAHFPKDAWALGRFDGTPLYEHSDPKRGEQLDWGTYVFDFGRPEVRNFLVANALYWLQEFHIDGLRVDAVASMLYLDYSRPEGGWTPNVHGGRENLEAVQFLQEMNATAHKVAPGIVTIAEESTPWSGVTRPTNIGGLGFSMKWNMGWMHDTLDYVSRDPVYRSYHHHEMTFSMLYAFSENYVLPLSHDEVVHGKGTLWGRMPGNNHVKAAGLRSLLAYQWAHPGKQLLFMGQEFGQRAEWSEQRGLDWFQLDENGFSNGIQRLVRDINDIYRCHPALWSLDTTPEGYSWIDANDSANNVLSFMRYGSDGSVLACVFNFAGAEHRDYRLGLPRAGRWREVLNTDATIYHGSGIGNLGGVDATDDPWHGRPASAVLVLPPTSALWLTPA

SEQ ID NO: 6483 - protein, 387 aa, Bacillus anthracis
  misc_feature (343)..(343): Xaa can be any naturally occurring amino acid
MGENHDKQRQSLLGKDFNENGERNEQAILHSQTVGSRGPVLEQDSVLHEALQEFIHEKILERPVHVKGFGAFGYFQTIYPMSEHTKLSFLQHSNEKVPVMVRFSLAVSTKGTPDTARNVRGFSTKFYTKEGIFDLLCNHIPVFSVRDPMRFPETIQALSPSPKNNLLDPNRFWSFVARAPESIHFVVHLYSDNGTAKSFRRIPGHSVNTYVWRNAEGNRKYVKYHWYPFEGVQSITNEEANKLAAENPDYSGKDLYDAIANGKPVEYGLYVQLMDPKDEAHLSYDPLDDTKAWDEKAYPLIPVGKMVLNKNPENYMEQVEKVAFSPSNLLNGAELSDDKMLQXRANIYSDSQRRRIGPEFRKLAINQQQDWTPANQITSGDGRYVER

SEQ ID NO: 6484 - protein, 239 aa, Solanum macrocarpon
MAREKIKIKKIDNITARQVTFSKRRRGLFKKAEELSVLCDADVALIIFSATGKLFDFASTSMKDILGKYKLQSASLEKVEQPSLDLQLENSLNMRLNKEIADKTRELRQMRGEELEGLSLEELQQIEKKLEAGFNRVLEIKSTRIMGEITNLQRKGAELMEENKQLKQKMEIMKKGKLPLVTEMVMEDGQSSESIITSNNVCSSNSGPPPDQDDSSKIGGNAVEDDCSITSLKLGLPFS

SEQ ID NO: 6485 - protein, 333 aa, Alkalilimnicola ehrlichei
MDQSRMTLGRFLAQQCPQDEKGKALALLLRQVGDSCRRIADAVAGGALREMTGAADNVNVQGEEQKKLDVFANDVLIEGCNWGGTVAGMASEEEDDIYTLPEGEPRGPWLLLFDPLDGSSNIDVNVSVGTIFSVLPAPDTGRDPVNEDLLQPGHRQVAAGYAVYGPSTVLVLTLGDGVYAFTLDRGQGEWFLTSSKMKVPEQTAEFAINCSYQRIWPAPIKRYIEECLDGEEGPRGKRFNMRWIASMVADLHRIFTRGGVFLYPADEKRPNGRLRVLYEINPMSMLMEQAGGEAFTGKERALDLQPEALHQRSGLMLGSREEVEVLRRYYAEQ

SEQ ID NO: 6486 - protein, 420 aa, Thermus thermophilus
MGPLLVWHRGDLRLHDHPALLEALARGPVVGLVVLDPNNLKTTPRRRAWFLENVRALREAYRARGGALWVLEGLPWEKVPEAARRLKAKAVYALTSYTPYGRYRDAKVQEALPVPLHLLPAPHLLPPDLPRAYRVYTPFARRFLGVEAPLPAPEALPKGPEEGEIPREDPGLPLPEPGEEAALAGLRAFLEAKLPRYAEERDRLDGEGGSRLSPYFALGVLSPRLAAWEAERRGGEGARKWVAELLWRDFSYHLLYHFPWMAERPLDPRFQALPWQEDEALFRAWYEGRTGVPLVDAAMRELHATGFLSNRARMNAAQFAVKHLLLPWKRCEEAFRHLLLDGDRAVNLQGWQWAGGLGVDAAPYFRVFNPVLQGERHDPEGRWLKRWAPEYPSYAPKDPVVDLEEARRRYLRLARDLARG

SEQ ID NO: 6487 - protein, 152 aa, Zea mays
MSLVRRSNVFDPFSMDLWDPFDTMFRSIVPSAVSTDSETAAFASARIDWKETPEAHVFKADLPGVKKEEVKVEVEDGNVLVISGQRSREKEDKDDKWHRVERSSGQFVRRFRLPENAKVDQVKAGLENGVLTVTVPKAEEMKREVKAIEISG

SEQ ID NO: 6488 - protein, 210 aa, Sophora affinis
YDRVMAYKFHEDDHGEVIAEITKPGLEPYLGLHYPATDIPQAARFLFMKNKVRMIVDCHAKHVKVLQDEKLPFDLTLCGSTLRAPHSCHLQYMANMDSIASLVMAVVVNDSDEDGDSSDAVQPQKRKRLWGLVVCHNTTPRFVPFPLRYACEFLAQVFAIHVNKEIELEYQLIEKNILRTQTLLCDMLMRDAPLGIVSQSPNIMDLVKCD

SEQ ID NO: 6489 - protein, 439 aa, Arabidopsis thaliana
MEENMSNLTSASGDQASVSSGNRTETSGSNINQHHQEQCFVPQSSLKRKRNQPGNPDPEAEVMALSPKTLMATNRFICEVCNKGFQRDQNLQLHKRGHNLPWKLKQRSNKDVVRKKVYVCPEPGCVHHHPSRALGDLTGIKKHFFRKHGEKKWKCEKCSKKYAVQSDWKAHAKTCGTKEYKCDCGTLFSRRDSFITHRAFCDALAEESARAMPNPIMIQASNSPHHHHHQTQQNIGFSSSSQNIISNSNLHGPMKQEESQHHYQNIPPWLISSNPNPNGNNGNLFPPVASSVNTGRSSFPHPSPAMSATALLQKAAQMGSTKSTTPEEEERSSRSSYNNLITTTMAAMMTSPPEPGFGFQDYYMMNHQHHGGGEAFNGGFVPGEEKNDVVDDGGGETRDFLGLRSLMSHNEILSFANNLGNCLNTSATEQQQQQHSHQD

SEQ ID NO: 6490 - protein, 170 aa, Sophora affinis
YDRVMAYKFHEDDHGEVISEVTKPGLEPYLGLHYPATDIPQASRFLFMKNKVRMIVDCRAKHVKVLQDKKIPFDLTLCGSTLRAPHSCHLQYMENMNSIASLVMAVVINDNDEDGDSSDAVQPQKRKRLWGLVVCHNTTPRFVPFPLRYACEFLAQVFAIHVNKELELEY

SEQ ID NO: 6491 - protein, 495 aa, Staphylococcus xylosus
MSNNKKLTSLFGAPVSDRENSMTAGPRGPLVMQDWYFLEQMAHFDREVIPERRMHAKGSGAFGTFTVTNDITQYTSASIFSEVGKQTEMFARFSTVAGERGAADAERDIRGFALKFYTDEGNWDLVGNNTPVFFFRDPKLFASLNHAVKRDPRTNMRSAQNNWDFWTSLPEALHQVTILMSDRGIPKGYRNMHGFGSHTYSMYNDKGERVWVKFHHRTQQGIENLQPDEAAKIIADDRESSQRDLFEAIENKDYPKWKTYIQVMTEEQARNHKDNPFDLTKVWYKGDYPLIEVGEWELNRNPDNYFQDVEQAAFAPTNIVPGIDFSPDKMLQGRLFSYGDAQRYRLGVNHWQIPVNQPKGVGVENICPFSRDGQMRILDNNQGGGTHYYPNSDGSFEDQPEFKKPGLKVEGEAYEYDFRQDDDNYFEQPGRLFRLQSKEQQERIFENTANEMQGTTLEVQHRHIRHCYKADSEYGKGVARALGVDINDVDLEIKD

SEQ ID NO: 6492 - protein, 165 aa, Zea mays
  misc_feature (101)..(101): Xaa can be any naturally occurring amino acid
MDGRMFGLETPLMVALQHFLDVPDGDAGAGGDKASGAAAGGGPTRTYVRDARAMAATPADVKELPGAYAFVVDMPGLGTGDIKVQVEDERVLVISGERRRXEREDAKYLRMERRMGKFMRKFVLPDNADMDKISAVCRDGVLTVTVEKLPPPEPKKPKTIEVKVA

SEQ ID NO: 6493 - protein, 681 aa, Arabidopsis thaliana
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENRIGGGSTTSSYLQNHHEILNWRRLSQTG

SEQ ID NO: 6494 - protein, 594 aa, Arabidopsis thaliana
MVHSKKFRGVRQRQWGSWVSEIRHPLLKRRVWLGTFDTAETAARAYDQAAVLMNGQSAKTNFPVIKSNGSNSLEINSALRSPKSLSELLNAKLRKNCKDQTPYLTCLRLDNDSSHIGVWQKRAGSKTSPNWVKLVELGDKVNARPGGDIETNKMKVRNEDVQEDDQMAMQMIEELLNWTCPGSGSIAQEISIVVIMILMKACDKGDFDLVSHTSLRSHQNSQTSENTPPSPPQNHRRKRGKNITNMGKGGSLSEGVIKNIIISYTYVAIWIFLSFTVIVYNKYILDKKMYDWPFPISLTMIHMSFCSTLAFLLIKVFKFVEPVSMSRDTYLRSVVPIGALYSLSLWLSNSAYIYLSVSFIQMLKALMPVAVYSIGVLFKKEGFKSETMMNMLSISFGVAIAAYGEARFDVWGVILQLGAVAFEATRLVMIQILLTSKGITLNPITSLYYVAPCCLAFLFIPWIVVEFPILRDTSSFHFDYLIFGTNSFCAFALNLAVFLLVGKTSALTMNVAGVVKDWLLIAFSWSVIKDTVTPINLFGYGIAFLGVAYYNHAKLQALKAKEAQKTAQQVDEETGRLLEEREGNEGGRKNEPED

SEQ ID NO: 6495 - protein, 739 aa, Glycine max
MESCNCIDPQVPADDLLMKYQYISDFFIALAYFSIPLELIYFVKKSAVFPYRWVLVQFGAFIVLCGATHLINLWTFRIHSRTVAVVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRAVKISPNCPVARLRPYAGKYMPGAVVAVRVPLLHLSNFQIYDWPEVSTRSYALMVLMLPSDSARQWHVHELELVEVVADQVAVALSHAAILEESMRARDQLIEQNVALDLARREAETAIRARNDFLAVMNHEMRTPMHAVIALSSLLQETDLTAEQRLMVETILKSSNLLATLINDVLDLSRLEDGSLQLEAATFNLHSLFREVLNLIKPVASVKKLSLTSHVASDLPMYAIGDEKRLMQTILNVVGNAVKFSKEGCISITAFVAKPESFRDARIPDFLPVPSDNHFYLRVQVKDSGSGINPQDIPKLFTKFAQNQSLTRNPAGSGLGLAICRRFVNLMEGHIWVESEGIGKGCTVTFIVKLGIPDRSNEFKLPFVPKVPGNHGSTNFAGLKVLVMDDNGVSRTVTKGLLMHLGCDVTTASSSEECLRVVSLEHEVVFMDVCTGLDGYELAVRIHEKFTKHQDRPLIVALTGNTKKVTKENCMRVGMDGLILKPVSVDKMRGVLSELLERRVLFESV

SEQ ID NO: 6496 - protein, 249 aa, Physalis peruviana
MAREKIKIKKIDNITARQVTFSKRRRGLFKKAEELSILCDADVALIIFSSTGKLFDFSSSSMKDILGKYKLQSANLDKVDQPFLDLQLENSLNVRLRKQVADKTRELRQMKGEELEGLSLEELQQIEKRLEAGFNRVLEIKGTRIMDEIANLQRKGAELMEENKKLKQKMEMMKLGKLPLLTDMDCMVMEEGQSSDSIITTNNVCSSNTGPPPEDDSSNASLKLGCNNGLAPVDDDCSITSLKLGLPLS

SEQ ID NO: 6497 - protein, 1139 aa, Triticum aestivum
MSSSRSNNRPACSRGSSARSKHSERVVAQTPVDARLHAEFEGSQRHFDYSSSVSALNRSGASTSSAVSAYLQNMQRGRYIQPFGCLLAIHPESFALLAYNENAAEILDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDDNLSQPISLCGSTMRAPHGCHAQYMANMGSIASLVMSITINEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSTPSEGEIKKIVAWLLECHDGSTGLSTDSLLEAGYPGASALGEVVCGMAAIKISSKGFIFWFRSHTAKEIKWGGAKHEPGDADDNGRRMHPRSSFRAFLEVVKWRSVPWEDVEMDAIHSLQLILRGSLQDEDANDNNARSIVEAPSDDIKKIQGLLELKIVTNEMVRLIETATAPILAVDIVGNISGWNNKVAEITGLPTTEAIGMLLVDLVEGDSVEVVKQMLNSALQGTEEQNLEIKLKTMHQQESKGPVVLMVNACCSRDLSDKVVGVCFVAQDLTGHKMVMDKYTRIQGDYVAIVKNPNELIPPIFMINDLGSCLEWNEAMQKITGIKREDAIDKLLIGELFTLHDYGCRVKDQVTLTKLSILMNTVISGQEPEKLAFGFFNTDGKYMESLLTANKRTDAEGKITGALCFLHVASPELQHALQVQKMSEQAATHSFKELTYIRQELKNPLNGMQFTRKLLEPSDLTEEQRQLFASNVLCQEQLKKILHDNDLEGIEQCYMEMNTVEFNLEEALNTVLMQGMSVSKEKQISLDRDWPVEVSSMYLYGDNLRLQQVLADYLACTLQFTRPAEGPIVLQVIPKKEHIGSGMQIAHLEFRLVHPAPGVPEALIQEMFRHGPGVSREGLGLHISQKLVKTMSGTVQYLREAESSSFIVLVEFPVAQLNSKRSRPSTSKSNF

SEQ ID NO: 6498 - protein, 340 aa, Unknown
  Shewanella sp. ANA-3
MAQYYAQRASAGLIITEATQISDDSQGYSFTPGVYTEAQIDGWQKVTAAVHQAGGKIFNQIWHVGRVSHPIFQQGAAPIAPSAITPVGTKVWIVDEQHPEGQMVDCPEPREMTQADIDRVVADFANAGANAVAAGFDGIEIHGGNGYLIDQFLRTNSNHRTDAYGGTPEKRIRFLLEVVEAVSAQIGADKVGVRLAPYVTFKDMACPEIVDTILLAAKHLSALGVAYLHLSEADWDDAPQVPESFRIELRKVFKGSIIVAGRYDVERGNEVIEKGYADLVAFGRAFIANPDLPYRLANQLPLSPFDKGPLFGGSAAGYTDYPSYQAAMRAVFRSSDDEVA

SEQ ID NO: 6499 - protein, 98 aa, Dianthus caryophyllus
MATVGGIKDSGGSSAISLEIDELAKFAVDHYNSIENALLEFPRVVNTKEQVVAGTIYYITLEATDGGVKKLYEANVWVKPGVNFKEVQVFKYVGDAFG

SEQ ID NO: 6500 - protein, 247 aa, Physalis peruviana
MAREKIKIKKIDNITARQVTFSKRRRGLFKKAEELSILCDADVALIIFSSTGKLFDFSSSSMKDILGKYKLQSANLDKVDQPFLDLQLENSLNVRLRKQVADKTRELRQMKGEELEGLSLEELQQIEKRLEAGFNRVLEIKGTRIMDEIANLQRKGAELMEENKKLKQKMEMMKLGKLPLITEMECMVMEEGQSSDSIITTNNVCSSNTGPPPEDDSSNASLKLSCNNGLAPVDDDCSITSLKLGLS

SEQ ID NO: 6501 - protein, 1099 aa, Magnetospirillum magnetotacticum
MTTPAPLHRLLQRQLARASRGREGGAPDFETLLRLISDSYEEHDKERRLSDRSARLMEEELRAANQESRRQAKAHLQAILNTVGEGIVIADQTGTVVSVNPALLSIFGYERDEVIGNNIDMLIPLAALKAAGSSGMERIFDLGRESMALRRGGTSFPIELAAGDLTPTGSAQFVVIMRDISERKRIEREMAESEERFRDFAQSTSDWFWEMGPDLRFTGFSGQFTEHTRALPSHYVGHTRDEMISDDTPMEARLQNLADMEARRPFRDFVYHTKNMDGPGRFLRVNGKPVFDPSGEFKGYRGTASDITEEIEAADRLKASQAEIERLAERNNSILESVDDGIVGIDLNGRATFVNRAAAKLLDFEPAELVGSDILPLMALDMETAESLYQILLRLADSIRDDTASFKRRDGSPLPVEYIASPVMDKGNQVGVVLGFRDITQRRLVERQLREAKEAAEAGNRTKSEFLATMSHEIRTPMNGVIGMTGLLLDTKLTEEQRHFAETIRDSGESLLTVINDILDFSKMEAGKLDLDYTEFELVPLVESVVDILAPRAHAKGIEIASLIDPRLRMLVRSDPGRLRQVLMNLGGNAVKFTEKGGVSIEVTLLERPGAQPMVHFDVRDTGIGIPPEAQGRLFSMFMQVDASTARRYGGTGLGLAICRRLAELMGGEVGLESQPGKGSRFWMSVPMELLAPQSAAPPDLTGHRVLVVDDNPVNCDVIERQLRAFGVEVHACLDAGSGMGELTRAAAMGTPWEVAVIDSQMPVVTGSEMVRMMRAIPMLGGSRIIVTSSQGMPAEQQDGQPAIDAFLHKPLRQSTLLDTIGRVLGLSGPEEQPAAPAEEHNAPDSTAKRLRILVAEDNPVNQQVALGLLRKLGHTVDVVGDGAEALEAVRLLPYDVVLMDVQMPEMDGLEATRAIRSLASAAARIPIVAMTANAMRGDDQMCFDAGMDGYISKPIDRHKLAEALAKYSGAPEPKPAEPTSAQDSKAVDLDVLDALAADIEADTVVEILVKFMEDARTRHANAAVAAPEGDLEKVRREAHTIKGAAASLGLMAVRDACLALEQAARAGEGVAPLVVQLHDRIEALPGQLSTTAYALPPS

SEQ ID NO: 6502 - protein, 332 aa, Solanum tuberosum
DLPLKFPQRDLVIYEMHVRGFTNHESSETKYPGTYLGVVEKLDHLKELGVNCIELMPCHEFNELEYYSYNSVLGDSKFNFWGYSTVNFFSPMGRYSSAGLSNCGLGAINEFKYLVKEAHKRGIEVIMDVVFNHTAEGNENGPILSFRGIDNSVFYTLAPKGEFYNYSGSGNTFNCNNPMVRQFIVDCLRYWVTEMHVDRFRFDLASILTRSSSSWNAVNVYGNSIDGDVITTGTPLTSPPLIDMISNDPILRGVKLIAEAWDCGGLYQVGMLPHWGIWSEWNGKYRDMVRQFIKGTDGFSGAFAECLCGSPNLYQKGGRKPWNSINFVCAHD

SEQ ID NO: 6503 - protein, 198 aa, Sophora affinis
YDRVMAYSFHEDDHGEVVSEIRRSDLEPLLPVLHYPATDIPQAARFLFQQNRVRMICDCHAKPVNVIQSEELRQPLCLVNSTLRSPLGCHTQYMANMGSIASLVMAVIVNGNDTTRLWGLLVCHHTSPRYVPFPVRYACEFLMQAFGLQLYMEIQLASQMAEKRLLKTQTLLCDMLLRDAPFGIVTQSPNIMDLVKCD

SEQ ID NO: 6504 - protein, 336 aa, Pseudomonas fluorescens
MSRVTLSRYLIEQTRSNNTPADLRFLIEVVARACKEISHAVSKGALGGVLGSMGTENVQGEVQKKLDVLSNEILLEANEWGGHLAGMASEEMDNAYQIPGKYPKGAYLLVFDPLDGSSNIDINAPVGTIFSVLRCPNEYLSQNEALDEKAFLQPGTQQVAAGYAIYGPQTMLVLTLGHGVKGFTLDREMGSFVLTHEDITIPESTQEFAINMSNQRHWEAPVQRYVSELLAGEEGPLKKNYNMRWVAAMVADVHRILTRGGLFMYPRDSREPSKPGKLRLMYEANPMSFLVEQAGGASTDGHQRILDIKPEGLHQRVAVFLGSKEEVARATAYHKE

SEQ ID NO: 6505 - protein, 482 aa, Listeria monocytogenes
MSNTKFPDGFMWGGATAANQFEGGYNLGGKGLACADLFTGGTHTEPRRITAQLEESTFYPSHEAVDFYHHYKEDIKLMAEAGFKVFRMSINWTRIFPTGKEAEPNEEGLQFYEDVFNELKKHQIEPLVTIAHFDIPLALTNEVNGWASRDLIDYYLHFCEVIFKRYKHLVKHWLTFNEINTATMEIGNYLSLGIRHAEGDFLHQKDDPKVRYQALHHQFVASAKAVKLGHSINPDFMIGCMIAYMPRYPRTCEPSDVLLAKQTEAMHSHFCGDVHVKGYYPFYAKTFFKDNGIELEFDPEDEQILREGTVDFYTFSYYLTLCASNDPAYKNSGKSVIGGAENPYLKTNDWGMQTDPVGLRIALNDLYTRYNIPLMVVENGLGAFDKLEDDGTINDPYRIDYFKEHILQMHKAIQDGVDLIGFTIWGCIDLVSASTGEMAKRYGIIYVDKYDDGTGDYSRKKKASYYWYKDVISSNGEIGLEE

SEQ ID NO: 6506 - protein, 375 aa, Arabidopsis thaliana
MVMMKKMKGSQSFRQRLLLSTLSSTPISIDEIRADETIPGLRPHEVNLLRLLEIVTDDPVVDINETGTRLKYKPGTIVGGKNLVHSCSLSRSIGYYLEPLLLLGLFGKKPLSIRLKGITNDPRDASVDTFRSTTLNIIKRFGVPAEDLELKIEARGVAPNGGGEVLLTVPNIKTLSAVHWVEEGMVKKIRGTTFSTRVTSDFEHSMRFAARGIFNNLLPDVHIFQDHRAGAQAGKSPGYGISLAAETTTGCFISADTTVSCERPDETGELDVEKKERSPAEDTGVEVASWLLQEIEKGGVVDSTHQGLLFLLCALSEQDVSKVRVGTLSPYAVETLRNIKEFLGVKFAIKPDPLTGTVILKCTGSGLINLSRKLS

SEQ ID NO: 6507 - protein, 492 aa, Arabidopsis thaliana
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLNMFTFLFDDIGIPQDYRHMDGSGVNTYMLINKAGKAHYVKFHWKPTCGVKSLLEEDAIRVGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCVIEKENNFKEPGERYRTFTPERQERFIQRWIDALSDPRITHEIRSIWISYWSQADKSLGQKLASRLNVRPSI

SEQ ID NO: 6508 - protein, 312 aa, Triticum aestivum
  misc_feature (127)..(128): Xaa can be any naturally occurring amino acid
  misc_feature (132)..(132): Xaa can be any naturally occurring amino acid
  misc_feature (139)..(139): Xaa can be any naturally occurring amino acid
  misc_feature (214)..(214): Xaa can be any naturally occurring amino acid
  misc_feature (244)..(244): Xaa can be any naturally occurring amino acid
  misc_feature (262)..(262): Xaa can be any naturally occurring amino acid
  misc_feature (287)..(287): Xaa can be any naturally occurring amino acid
  misc_feature (300)..(300): Xaa can be any naturally occurring amino acid
  misc_feature (303)..(303): Xaa can be any naturally occurring amino acid
MATVRQSNGHGEAAAANGKSNGHAAANGKSNGHAAAAADWNFAGGEDGILARTGAKNSIRAIRYKISASVEESGPRPVLPLAHGDPSVFPAFRTAVEAEDAVAAALRTGQFSCYAAGVGLPAARRAXXEHLXQGGPYEXSADDIFLTAGGAQAIEVIIPVLAQTVGANILLPRPGYPNYEARAAFNKLEVRHFDLIPEKGWEIDIRLRWESIAXDKNTTAMLIINPNIPCGSVYSLTSIWAKSXEVGKKLRILVIADKCYGXLVLGIPHFIPWVSSRQFPCLVHKAXSKSLVMPGMALLXVAXHPTNFRNKL

SEQ ID NO: 6509 - protein, 160 aa, Citrullus lanatus
IIAKGHYTERAAASLLRTIVQIVHTCHSMGVIHRDLKPENFLLLSKDEDSPLKATDFGLSVFYKQGEVFKDIVGSAYYIAPEVLKRRYGPEVDIWSVGVMLYILLCGVPPFWAESEHGIFNAILRGHIDFTSDPWPTISPAAKDLVRKMLNSDPKQRLTA

SEQ ID NO: 6510 - protein, 136 aa, Brassica napus
  misc_feature (75)..(75): Xaa can be any naturally occurring amino acid
VDPRVRSKAFVSVTFLIVTLLLCRTIQSRSCRLDEKTTEKTMILGGVHDLRGNQNSGEIENLARFAIQQHNNREXQNKVLEFKKIVKAREQVVAGTMYYLTLEANEGGQAKNFEAKVWVKPWMNFKQLQEFKESSS

SEQ ID NO: 6511 - protein, 475 aa, Arabidopsis thaliana
  misc_feature (338)..(338): Xaa can be any naturally occurring amino acid
  misc_feature (374)..(374): Xaa can be any naturally occurring amino acid
MAAAVSTVGAINRAPLSLNGSGSGAVSAPASTFLGKKVVTVSRFAQSNKKSNGSFKVLAVKEDKQTDGDRWRGLAYDTSDDQQDITRGKGMVDSVFQAPMGTGTHHAVLSSYEYVSQGLRQYNLDNMMDGFYIAPAFMDKLVVHITKNFLTLPNIKVPLILGIWGGKGQGKSFQCELVMAKMGINPIMMSAGELESGNAGEPAKLIRQRYREAADLIKKGKMCCLFINDLDAGAGRMGGTTQYTVNNQMVNATLMNIADNPTNVQLPGMYNKEENARVPIICTGNDFSTLYAPLIRDGRMEKFYWAPTREDRIGVCKGIFRTDKIKDEDIVTLVDQFXSLLVMEQENVKRVQLAETYLSQAALGDANADAIGRXLSTVKQRKRSPPRKPAYEKLMEYGNMLVMEQENVKRVQLAETYLSQAALGDANADAIGRGTFYGKGAQQVNLPVPEGCTDPVAENFDPTARSDDGTCVYNF

SEQ ID NO: 6512 - protein, 467 aa, Listeria monocytogenes
MTSVMWFRRDLRVSDNKALYHACKEDDLLLLFQVNPAQFITGSPSHQAFFASVAHFKQEVDKTALLQIMFGEPVECLKQLKETLPSWDKVYFNRDETGYGAERDEAAKTFFDEQEIEVQAFHDSYLHSAEEVKKSPTEYYKIFTPYYKKWREEIKETPFKVTLKADNIRKENLFPKYEEQFAEMTCDLPILDSGEKTANTRLANFIKHDVADYDKARDFPELDKTSHLSRYLRTGEISVRTIWQALQENEATEGRAIFEKELCWRDFYNMIYVSFPNQKNEPIQENYRFIEWENNREFFKAWQDGKTGFPLVDAAMRQLKETGWMHNRLRMVTASFLTKDLLIDWRFGEKYFQQMLIDYDPASNIGGWQWAASTGTDAVPYFRIFNPTTQSQKFDPTGKFIRKYVKELANLPDKYIHQPEKMSEIEQKEYGLLLGKDYPFPLIDHKERRKLAIARYEFSKEHYRGNI

SEQ ID NO: 6513 - protein, 1282 aa, Gibberella moniliformis
MVDDAALAAAASIVASIAPDPRLPNSIPVGVASQVQLPGPDTPAKRKLELELQNLALRVGKLESQASATSPFPETPNEVIDTLFGEEAQAVAVRPKPKVFHAQGSLHSPHLPSYQLTEEALEGLREHVDDQSKLLDSQRQELAGVNAQLLEQKQLQERALEILEQERIATLERELWKHQKANEAFQKALREIGEIVTAVARGDLTMKVRMNTVEMDPEITTFKRTINAMMDQLQIFASEVSRVAREVGTEGLLGGQARIGGVDGTWKELTDNVREIASVTTAVAHGDLTKKIERPARGEILQLQQTINTMVDQLRTFASEVTRVARDVGTEGMLGGQADVGGVQGMWNDLTVNVNAMANNLTTQVRDIIKVTTAVAKGDLTQKVQADCRGEIFELKSTINSMVDQLQQFAREVTKIAREVGTEGRLGGQATVHDVEGTWRDLTENVNGMAMNLTTQVREIAKVTTAVAKGDLTKKIGVEVKGEIAELKNTINQMVDRLGTFAVEVSKVAREVGTDGTLGGQAQVANVEGKWKDLTENVNTMASNLTVQVRSISTVTQAIANGDMSQKIKVEANGEIQVLKETINNMVDRLSSFCYEVQRVAKDVGVDGKMGAQADVGGLDGRWKEITTDVNTMASNLTTQVRAFSDITNLATDGDFTKLVDVEASGEMDELKRKINQMISNLRDSIQRNTQAREAAELANKTKSEFLANMSHEIRTPMNGIIGMTQLTLDTDLTQYQREMLNIVNNLANSLLTIIDDILDLSKIEARRMVIEEIPYTLRGTVFNALKTLAVKANEKFLDLTYKVDSSVPDYVIGDSFRLRQIILNLVGNAIKFTEHGEVSLTIKESMGQNNVRPGEYAVEFVVEDTGIGIAQDKLDLIFDTFQQADGSMTRKFGGTGLGLSISKRLVNLMGGDLWVNSEHGKGSEFHFTCLVKLAPDDAALIEQQIRPYRGHQVLFVDKAQSQNATSIKPMLEKIGLKPVVVDSEKSPALTRLQSGGSLPYDAILVDSIDTARRLRAVDDFKYLPIVLLAPVVHVSLKSCLDLGITSYMTTPCKLIDLGNGMIPALENRATPSLADNTKSFEILLAEDNTVNQRLAVKILEKYHHVVTVVGNGWEAVKAVQSKKFDVILMDVQMPIMGGFEATGKIREYERGIGSHRTPIIALTAHAMMGDREKCIQAQMDEYLSKPLQQNHLIQTILKCATLGGPLLEKNRERELALHAETKSKHKEGGQGLLRPTLESRSFTSREPLLGNGKESPAILTTDEDPLARARLDLSDMRSLTN

SEQ ID NO: 6514 - protein, 184 aa, Oryza sativa
MLRRRGFCCCSGAPAAAAAALLLLAVAAAAPRAAGFHLGGDESVLVRGMLAAIRREQAEAEDAARFAVAEYNKNQGAELEFARIVKAKRQVVTGTLHDLMLEVVDSGKKSLYSAKVWVKPWLDFKAVVEFRHVGDSQSQSATAADDNAGQDTADPTVASRNDLHNTENNKVSVVLSTFSQTYSV

SEQ ID NO: 6515 - protein, 327 aa, Yarrowia lipolytica
MADQKEVDLDSVIDRLLEVRGSRPGKQVQLMEHEIRYLCTKAREIFIQQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFAMHGGLSPELNTMEQIRRVMRPTDIPDVGLLCDLLWSDPDKDITGWNENDRGVSFTFGPDVVLRFLQKHDMDLICRAHQVVEDGYEFFSKRHLVTLFSAPNYCGEFDNAGAMMSVDESLLCSFQILKPAEKKQKFVYSGMGGGRPVTPPRKQKKAGK

SEQ ID NO: 6516 - protein, 441 aa, Arabidopsis thaliana [sequence omitted]

SEQ ID NO: 6517 - protein, 424 aa, Hordeum vulgare
MVVTVAATGPDTAETLHSTTFASRYVRDQLPRYRMPENSIPKEAAYQIISDELMLDGNPRLNLASFVTTWMEPECGKLIMDSVNKNYVDMDEYPVTTELQVCWEKFARYFEVELKEVKLTEGYYVMDPKKAVEMVDENTICVAAILGSTLTGEYEDVKLLNDLLVEKNKETGWNVPIHVDAASGGFIAPFLQPELEWDFRLPLVKSINVSGHKYGLVYPGVGWVIWRSKDDLPEELIFHINYLGADQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIIGELDAHAVHAIKLSTAAAGGDGASKSAVDAATEAFKDLAGKKKAGVC

SEQ ID NO: 6518 - protein, 581 aa, Neurospora crassa
MCGIFACHNHPDVAKFKPTALKLSKAIRHRGPDWSGSVTCHNTILCHERLSIVGVESGAQPLTNADESIAVAANGEIYNHRLIRKHLKNPYHFKTTSDCEVIIPLYLEHGVDAPKHLDGMFSFVLYDKKQDRTIAARDPIGITTLYKGYNSQEPGTVYFASELKSLHPVCDKIEAFPPGHVFDSLTGETTRYFEPSWWDEKKCPQTPLDLKLLRETLEKSVRKRLMAEVPYGVLLSGGLDSSLVAAIAQRESLRLRKLAEEQAALNQEVDPEAQDKGEGLVGIDDENKLSTVTFLPQLNSFSIGLPGSPDNKAALEVAKFLGTKHHVMTFTIEDGLNALSDVIYHLETYDVTTIRASTPMYLLSRKIKAMGIKMVLSGEGSDEIFGGYLYFHGAPNKEEFHEECVRRVKNLHLADCLRANKSTSAWGLEARVPFLDKEFLEVALNIDPQEKMITKEKLEKYILRKAFDTKDQPEGAYLPDNILYRQKEQFSDGVGYGWIDALKDQAELQVTDEMMKNPKPEWGDDIPDTKEAYWYRCMFDEHFPPSCASTVMRWTPKWVKQTDPSGRAISIHQAKYDHVDE

SEQ ID NO: 6519 - protein, 235 aa, Solanum tuberosum
MAREKIKIKKIDNITARQVTFSKRRRGLFKKAEELSVLCDADVALIIFSATGKLFDFASTSMKDILGKYKLQSASLEKVDEPSLDLQLENSLNMRLSKQVADKTRELRQMRGEELEGLSLEELQQIEKRLEAGFNRVLEIKGTRIMDEITNLQRKGAELMEENKQLKHKMEIMKKGKFPLLTDMVMEEGQSSESIITTNNPDQDDSSNASLKLGGTTAVEDECSITSLKLGLPFS

SEQ ID NO: 6520 - protein, 368 aa, Vigna radiata
QMGLAENQLTSDLVEDWILNNPEASICTPEGINDFRAIANFQDYHGLAEFRNAVAKFMARTRGNRITFDPDRIVMSGGATGAHEVTAFCLADPGEAFLVPIPYYPGFDRDLRWRTGVKLVPVMCDSSNNFVLTKEALEDAYEKAREDNIRVKGLLITNPSNPLGTIMDRKTLRTVVSFINEKRIHLVCDEIYAATVFSQPGFISIAEILEDETDIECDRNLVHIVYSLSKDMGFPGFRVGIIYSYNDAVVNCARKMSSFGLVSTQTQYLLASMLNDDEFVERFLAESAKRLAQRFRVFTGGLAKVGIKCLQSNAGLFVWMDLRQLLKKPTFDSETELWKVIIHEVKINVSPGYSFHCTEPGWFRVCFA

SEQ ID NO: 6521 - protein, 784 aa, Ralstonia metallidurans
MLHLSAAYFVTPFALLAAMMLVVARCWRNARQASAKMAELKAERTLFQSLLDSSPNAVLVVSHEHRILKVSEPYARLCGVSTEDLIGKPLVHSHTTSRFLDLGGLLELTLLRMDGNERSDLITLGIPEQSVRTFRVNATQCRSEDGVFSGTAIVLTDISEQVAAQHRVDQTSAAMDDITDALSVTFFQLCRESNGHIWLPWVKGMQNTTLNWSAERMMRDGGGILPNLDASEKTLFIGAVDQSIATQQPMDVTVRLTSDNRWVHIASGNPRVGPNGATLWYAYAMDVTEMQRYNTLLATASREAEAATEAKSRFLATMSHEIRTPLATVIASLDLLRESELSTHQREELDLADHSAKLLLEILGDILDFSRIEAGEMKLEQAPIDLRLIIEDVLRIQARQIEKKGVILDFYVEAGLAATLLGDAVRLRQIVLNLVGNATKFTLQGSIVVRALLIADHPETQTIQLEVSDTGIGIPAEKQAALFKAFSQADVSTTRRFGGSGLGLSICSRLVQAMGGAVVLTSTPGVGSTFRVELTLPVVERSTRMVEFAKTHIAIDVSRADDAAVFREHAVALGMQLAPLDCLNPSDIAVIDEDAASDKVPVGVLTIPYGKKHGNLSGPPIWWSEFRAACLDAVLRDTHRFPAQGQDVTATPPISDSLAGLTSLPILVAEDHTPFQIVIRRQIEKLGLACDVVSDGKEALAAIRNKQYGMILTDCHMPYMDGYELTSAIRASEAQGQRLPIVALSADASDEQRHRGRAAGMDDFLLKPLKLPELRACIQRWVLR

SEQ ID NO: 6522 - protein, 470 aa, Escherichia coli
MKAFPETFLWGGATAANQVEGAWQEDGKGISTSDLQPHGVMGKMEPRILGKENIKDVAIDFYHRYPEDIALFAEMGFTCLRISIAWARIFPQGDEVEPNEAGLAFYDRLFDEMAQAGIKPLVTLSHYEMPYGLVKNYGGWANRAVIDHFEHYARTVFTRYQHKVALWLTFNEINMSLHAPFTGVGLAEESGEAEVYQAIHHQLVASARAVKACHSLLPEAKIGNMLLGGLVYPLTCQPQDMLQAMEENRRWMFFGDVQARGQYPGYMQRFFRDHNITIEMTESDAEDLKHTVDFISFSYYMTGCVSHDESINKNAQGNILNMIPNPHLKSSEWGWQIDPVGLRVLLNTLWDRYQKPLFIVENGLGAKDSVEADGSIQDDYRIAYLNDHLVQVNEAIADGVDIMGYTSWGPIDLVSASHSQMSKRYGFIYVDRDDNGEGSLTRTRKKSFGWYAEVIKTRGLSLKKITIKAP

SEQ ID NO: 6523 - protein, 252 aa, Prunus microcarpa
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVIPMAHTPLGGATANVKAFGSISPLEDPVLIGLAKKYQKSVAQIALRWNLERGTPVIPKSSKVERLKENLEVLNFKLEKEDIELINTIDKKSRTTL

SEQ ID NO: 6524 - protein, 162 aa, Arabidopsis thaliana
  misc_feature (87)..(87): Xaa can be any naturally occurring amino acid
  misc_feature (112)..(112): Xaa can be any naturally occurring amino acid
TPIAAVPDGSIILDQLASHSTAFAVEQFSDDVGYSWIDGLKDHAAQNVNDKMMSNAGHIFPHNTPNTKEAYYYRMIFERFFPQNSAXRLTVPGGATVACSTAKAVDQLASHXWSTNMDPSGRAAIGVPLSAYDGKNVALTIPPLKAIDNMPMMMGQGVVIQS

SEQ ID NO: 6525 - protein, 252 aa, Prunus lusitanica
AHYRSEADVGNALAEAFETGLVKREELFITSKASNHGHVVEACKNSLKKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSISPLEDPVLRALAKKYKKSVAQIALRWNLDRNTPVIPKSSKIERLKENLEVLNFKLEKEDIELINTIDKKSRTTL

SEQ ID NO: 6526 - protein, 252 aa, Prunus virginiana
AHYKSEADVGNALAEAFDTGLVKREELFITSKASNHGHVVEACRNSLKKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGSTANVKSFGSISPLEDPVLHGLAKKYKKSVAQIALRWNLDRNTPVIPKSSKIERLKENLEVLNFKLEKGDIELINTIDKKSRTTL

SEQ ID NO: 6527 - protein, 275 aa, Gibberella moniliformis
MLEDPAHQDVARWGKDGDTFVVVENEKFTRSILPKHFKHSNMASFVRQLNKYDFHKVRQTNDSGSAANGANTLEFKHPNFRVGSKDDLDNIRRKAPAPRRTQATEDFTTSHHISVMTEQLTATQQQVQQLQELFTEVSQTNRLLVNEVLTLQKMLNAQKQSQHEMLNYLSPSNNRHQQSMHLNVGTSPLDGSDDSAPELRRARELLSSVTPDQIADRELERLQGVYGSPADSAVVIPQASMPMMHDPMNDINRYPVYPVGQTVGIDPFHSDHIHK

SEQ ID NO: 6528 - protein, 378 aa, Listeria monocytogenes
MEESPQNEPNKVEKDEEQKSKPGNGYIKMKLFPFIMLLFAFVFVTALVTTIVMSLGDDKQVKVSIPERKEFTKLYDVYDEITSKYYKDTNSTTMIDGAISGMVNSLDDPYSTFMSKKESSEFNDTISASFEGIGAEIQEKDGAIVIVSPIKNSPAEKAGLRPQDIITQVDGKSVKGDTATEATQKIRGEKGTKVTLTIQRSNEDKPFDVTITRDEIPIETVYKEMGSDKIAHVTISTFSETTYDELEKALKSLEKDGMKGLVLDLRGNPGGLLDQAVSISSLFVPDGKIVVQEQDKDGDKSAIKADSSSHGDYKVKVPTTMLIDGGSASASEILAAAAKESGGIKLVGTKSFGKGTVQTATTLSDDSTLKLTVAKWLT

SEQ ID NO: 6529 - protein, 702 aa, Mesorhizobium loti
MAKQASKLAGTAATIHDQKLQRGEGGELHQTASGSTAVLTTAQGGPVSDDQNSLRIGARGPTVLEDFHFREKIFHFDHERIPERVVHARGYGAHGYFETYESLAKYTRADIFQRAGEKTPAFVRFSTVAGNKGSADLARDVRGFAVKLYTQEGNWDIVGNNMPVFFIQDAIKFPDLIHAAKAEPNSDFPQAQTAHDNFWDFISLTPESMHMIMWAMSDRAIPRSLRFMEGFGVHTFRLLNAKDESTFVKFLWKPKLGLQSVAWNEAVKINGADPDFHRRDLWDAIHAGNFPEWELQLQLFDQAFADSFDFDILDPTKLIPEEVLPPIAVGRLVLDRMPDNFFAETEQVAFMTQNVPPGVDFSNDPLLQGRNFSYLDTQIKRLGSTNFTHLPINAPKCPFHTFQQDGHMAMRNPVGRANYQPNSWDEGPRESPQKGFRSFAEAEAGPKARLRAESFADHYSQARQFYISQHPVEQGHIASALTFELSKVHTPVIRERIVSHLLNIDDALARKVADALGLKAMPKPADAGAPTRTDLPASDALSILKNGPGRFEGRKLGILVTDGTDAALLNALKQALTKAGAKFEIIAPKVGGAKASDGSWMDAQQMIAGAPSVLYDAIALLAAKPAMAGLLRESTARDFVADAFAHCKFIGFVEAAAPLLDKAGVVEDEAVIPLASAKDVAGFITRLGDLRLWAREPKVKLG

SEQ ID NO: 6530 - protein, 525 aa, Streptococcus criceti
MAKDIKFSADARSAMVRGVDVLADTVKVTLGPKGRNVVLEKSFGSPLITNDGVTIAKEIELEDHFENMGAKLVSEVASKTNDIAGDGTTTATVLTQAIVREGLKNVTAGANPIGIRRGIERAVATAVEGLKAIAQPVSGKEAIAQVAAVSSRSEKVGEYISEAMEKVGNDGVITIEESRGMETELDVVEGMQFDRGYLSQYMVTDNEKMVADLDNPYILITDKKISNIQDVLPLLEEVLKTSRPLLIIADDVDGEALPTLVLNKIRGTFNVVAVKAPGFGDRRKAMLEDIAILTGGTVITEDLGLELKDASIASLGQAAKITIDKDSTVIVEGAGQADAIAERVNVIKSQLETTTSDFDREKLQERLAKLSGGVAVIKVGAATETELKEMKLRIEDALNATRAAVEEGIVAGGGTALVNVIEKVASLDVKGDEATGRNIVLRALEEPVRQIARNAGYEGSVIIEKLKASAVGTGFNAADGSWVDMVEAGIIDPVKVSRSALQNAASVASLILTTEAVVADHPEEK

SEQ ID NO: 6531 - protein, 215 aa, Beta vulgaris
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIARDIKQRLADSDTRQEAQPSITIKPADQSGNQAAAKSACCGS

SEQ ID NO: 6532 - protein, 484 aa, Vigna radiata
MGFKAMDQTPLLSKMAIGDGHGESSPYFDGWKAYDQNPFHPTDNPNGVMQMGLAENQLTSDLVEDWILNNPEASICTPEGINDFRAIANFQDYHGLAEFRNAVAKFMARTRGNRITFDPDRIVMSGGATGAHEVTAFCLADPGEAFLVPIPYYPGFDRDLRWRTGVKLVPVMCDSSNNFVLTKEALEDAYEKAREDNIRVKGLLITNPSNPLGTIMDRKTLRTVVSFINEKRIHLVCDEIYAATVFSQPGFISIAEILEDETDIECDRNLVHIVYSLSKDMGFPGFRVGIIYSYNDAVVNCARKMSSFGLVSTQTQYLLASMLNDDEFVERFLAESAKRLAQRFRVFTGGLAKVGIKCLQSNAGLFVWMDLRQLLKKPTFDSETELWKVIIHEVKINVSPGYSFHCTEPGWFRVCYANMDDMAVQIALQRIRNFVLQNKEVVVSNKKHCWHSNLRLSLKTRRFDDITMSPHSPLPQSPMVKATN

SEQ ID NO: 6533 - protein, 806 aa, Oryza sativa
MALSTAQTGESMHSSTFASRYVRTALPRFRMPEKSIPKDAAYQIINDELMLDGNPRLNLASFVTTWMEPECDKLMMAAINKNYVDMDEYPVTTELQNRCVNMIAHLFNAPIGDDETAVGVGTVGSSEAIMLAGLAFKRKWQNRMKAEGKPHDKPNIVTGANVQVCWEKFARYFEVELKEVKLTQGYYVMNPEKAVEMVDENTICVAAILGSTLNGEFEDVKMLNDLLTAKNAETGWNTPIHVDAASGGFIAPFIYPELEWDFRLPLVKSINVSGHKYGLVYAGVGWVIWRNKEDLPDELIFHINYLGADQPTFTLNFSKGSNQIIAQYYQLIRLGFEGYKDIMQNCRDNATVLREGIEKTGHFDVVSKDSGVPLVAFSLKDSSRYTVFEVAESLRRFGWIVPAYTMPADAEHVAVMRVVIREDFSRGLAERLITDLTKTVADMDAHAVKKAAAEPAKKTVREIEKEVTTYWRSFVARKKSSLWEDEGNGGSGGPRCCSSSSPSQLPVRSSTARESLDHISINCTGGVGATSGCRSVHSRRSAPTRRARLLVPAQPRLCLDSPDWRQSAAGREWEQERDDGDDRRGSWLASESWWFVGDDATAAAATRVRREKRRACAGAGGAGGDGAARAPPSSSSASTRAAASTPGGGMRGSRMHYLRYYDAAFDAVDAAGLLETRPARAKVEEMFAREIRNAVAFEGAERFERHESFAGRRRRMEDGGGLQWGSKAEEKCLLPSSSLARRPRRQPSPPVSLRPDGSLPPAVAAAPLVLPLPRASAAEPPRCAPMPPTAAPLVLPPPLPTEKERI

SEQ ID NO: 6534 - protein, 257 aa, Unknown
  Synechocystis sp. PCC 6803
MDIHRLPALADNYIFLLHDRQRNQAAVVDPAEAKPVLDCLETLGADLVTIYNTHHHGDHVGANRELLAKYPNLEVYGGVEDQGRIPGQTVFLRDGDRLSFADREATVYFVPGHTRGHIAYYFAPGSGETIGDLFCGDTIFAGGCGRLFEGTPAQMVQSIGKLRQLPDQTRLWCAHEYTLGNLKFALTVDPSNKDLQERFQTVQGDRQRGQATIPSWLGTEKRTNPFLRWDNPAIQARVGMTEPARVFGKLRGMKDNF

SEQ ID NO: 6535 - protein, 807 aa, Haemophilus somnus
MNKFVSQSTIDTFFDGKHADPFSVLGMHETSNGIEVRVLLPDAEKVFVLSKETKNVLCELSRVDERGFFAGVVPNTHSFFAYQLEVYWGNEAQVIEDPYAFHPMINELDNWLLAEGSHKRPYEILGAHFTECDNVAGVNFRLWAPNAKRVSVVGDFNYWDGRRHPMRFHQSSGIWELFLPKVSLGQLYKFELLDCHNQLRLKADPYAFSSQLRPDTASQIGALPEIVSMTEKRRKANQADQPISIYEVHLGSWRRNLENNFWLDYDQIAEELIPYVKDMGFTHIELLPLSEFPFDGSWGYQPIGLYSPTSRFGTAEGFKRLVNKAHKAGINVILDWVPGHFPSDTHGLVAFDGTALYEHADPKEGYHQDWNTLIYNYGRHEVKNYLASNALYWMERFGLDGIRVDAVASMIYRDYSREDGQWIPNQYGGRENLEAIEFLKQTNHLLGTEIPGVVSIAEESTSFAGVTHPPYEGGLGFHFKWNMGWMNDTLSYMKKDPIYRQHHHSQMTFGMVYQYSENFILPLSHDEVVHGKCSLLGKMPGDAWQKFANLRAYYGYMWGYPGKKLLFMGNEFAQGREWNYQESLDWYLLDEFHGGGWHKAVQDYVRDLNHIYQKNAPLFELDTDPQGFEWLVVDDYQNSVFVFERRSKKDERIIVISNFTPVLRQNYRFGVNIAGEYMEILNSDAQQYMGSNSTNTSKIVTEDIESHNKAQSISIDIPPLATVYLKLHKVKKVRKMRKTSKVEDTAVKTEKKIAKGKTTRTKKTVADTVSEATEVKPKKTVTKRAVVKKVKNAEVIAESTSVENNVS

SEQ ID NO: 6536 - protein, 311 aa, Triticum aestivum
MATHFVLNTGAKIPSVGLGTWQSDPGVVGEAVYAAVKAGYRHIDCARAYNNEKEVGLALKKLFEEGVVKREDLFITSKLWCGHHAPEDVPEALGDSLNDLQLDYLDLYLIHWPFKIKKGTSIGNPENFLPPDIPATWGAMEKLHDAGKARAIGVSNFSSKKLGDLLAVARVPPAVDQVECHPTWQQSKLHSFCQSTGVHLSAYSPLGSPGSTWMNGNVLKEPVVVSIAEKLGKTPAQVALRWNIQMGHSVLPKSVSEERIKQNLAVYDWSIPEDLLAKFSEIKQARLLMGNFIVNKDSVYKTHDELWDGEI

SEQ ID NO: 6537 - protein, 372 aa, Arabidopsis thaliana
MENGEAKQSVPLLTPYKMGRFNLSHRVVLAPLTRQRSYGNVPQPHAAIYYSQRTTPGGFLITEATGVSDTAQGYQDTPGIWTKEHVEAWKPIVDAVHAKGGIFFCQIWHVGRVSNSGFQPNGKAPISCSDKPLMPQIRSNGIDEALFTPPRRLGIEEIPGIVNDFRLAARNAMEAGFDGVEIHGANGYLIDQFMKDTVNDRTDEYGGSLQNRCKFPLEIVDAVAKEIGPDRVGIRLSPFADYMESGDTNPGALGLYMAESLNKYGILYCHVIEARMKTMGEVHACPHTLMPMRKAFKGTFISAGGFTREDGNEAVSKGRTDLVAYGRWFLANPDLPKRFQVDAPLNKYDRPTFYTSDPVVGYTDYPFLESTA

SEQ ID NO: 6538 - protein, 334 aa, Bradyrhizobium japonicum
MSIADAEFAQAKTAQSAPTAAKPQLPPGVVTEGPLVKAKLRESYLLLGILYVGAVAGIIWAVTQGVGKVELFTFAWMFALTTFGIGAGMHRLFVHRSFRTGPIMRVFFCAIAQMAVQGSIAKWVANHRRHHLYADDVGDPHSPQFDGFGNRYVSALKGFLHAQGSWVFDQATTDNEYYAKDILADPIAMFFVRTRWVWYGMSAVFIPGFIGYVFGGVHTMIGCVLFSGLLRAYLLILVSQLTGSVCHAYGYRRFEVDDASTNEFVTTILTFGEGLHNNHHRFPRDAYISHAWWEIDLNGLIILGMEKIGLVHDVFHASHRQLERASEAQAASTR

SEQ ID NO: 6539 - protein, 340 aa, Pichia anomala
MSHKASDEHHVDTDLITLSRFILTSQQKVAAQATGELTLLLNSLQFAFKFIANNIRKAELVNLMGLAGASNSTGDAQKKLDVIGDEIFINAMKASGNVKVLVSEEQEDLIVFDGPGNYAVVCDPIDGSSNIDAGVSVGTIFGIYKLLPGSKGSIKDVLRPGTEMVAAGYTMYGASAHLMLTTGQGVNGFTLDASLGEFILTHPNLTISDEKHIFSVNEGNTTYWTPEVQQFIADLKKPQFNGKPYSARYIGSMVADVHRTLLYGGLFAYPADAKSKAGKLRILYECFPMAFLFEQAGGKAVTDNGDRILELKPKAIHDRSGIWLGSKVEIDRFLKATGKI

SEQ ID NO: 6540 - protein, 434 aa, Cattleya bicolor
MSKVFGIEAPLSKIALSKAHGEDSPYFAGWKAYEENPYDAMNNPNGVIQMGLAENQLSFDLLEEYLEQHPDAFGWGSDLSGFRENALFQDYHGLQTFRKAMASFMEKIRGGRSKFDPNRIILTAGATAANELLTFILANPGDAILVPTPYYPGFLRDLQWRTGVTIFPVHCDSSNGFQLTLSSLEKAYADAKASNFKVKGLLITNPCNPLGTTASFSLLQDIILFISDKNIHLISDEIYSGSVFSSTNLFSISDLITDAVSEQIHIVYSLSKDLGLPGFRVGALYSYNDRVVKTARRMSSFSLVSSQTQKLLAFMLSDEEFTVRYIEKNRERLTERYELVVEGLKEARIECLKGEAGLFCWVNMEELMEEKTMEEELKLWKVIVEELKLNITPGSSCCCSEPGWFRVCFANMSRETLEVALRRLKDFAQKKDCR

SEQ ID NO: 6541 - protein, 250 aa, Glycine max
  misc_feature (192)..(192): Xaa can be any naturally occurring amino acid
  misc_feature (218)..(218): Xaa can be any naturally occurring amino acid
  misc_feature (232)..(232): Xaa can be any naturally occurring amino acid
  misc_feature (234)..(235): Xaa can be any naturally occurring amino acid
YIWLRRNSDIVGMKKDGISVFRELALFQDYHGLPALKNELVDFMAKIRENGIKFASEKLVLTAGATPANEILMFCLADPGEAFILPTPYYPGFDRDLKWRTGVEIVPMHCSSSNGFRITSSALEQAYQQAQKLNLKIKGVLVTNPSNPLGITMTKTELNHLVDFAIDKNIHIISDEIYSGTVFDSPKFVSIXEVVNERITTVNNNSITSIWNRIHIVXGFSKDLGIPGFSCXEXXLQHETVVAAATKMSS

SEQ ID NO: 6542 - protein, 478 aa, Bacillus licheniformis
MIHQRLRPFPDHFLWGSASAAYQIEGAWNEDGKGLSVWDVFTKIPGKTFKGSNGDIAVDHYHRFKEDVALMAEMGLKAYRFSVSWPRIFPQGRGEANESGLRFYDDLINELLAHDIEPVLTLYHWDLPQALMDEYGGFESRRIIEDFNAYCVTLYKRYGGRVKYWVSLNEQNYNFNHGFITAMHPPGVKDRKRFYEANHIAFLANAKAIDSFRRYVPDGKIGPSFAYSPAYPLSSRPDDILAFENAEEFTNYWWLDMYCRGTYPDIPLKYLKEKGWAPTIEDGDMELLAKGKPDFVGVNYYQTITYEMNPLDGVSEGKMNTTGQKGSNQETGMPGLYKTKRNPHLETSNWDWAIDPIGLRIGLRRISSRYGLPLFITENGLGEFDKVENDGTIHDDYRIAYLRAHLEQCRQALNDGVDLIGYCSWSFTDLLSWLNGYQKRYGFVYINRDEENVKDLKRIKKDSFYWYQNVIQTNGEEL

SEQ ID NO: 6543 - protein, 450 aa, Methylococcus capsulatus
MSRYEFPERFLWGAATSAYQVEGSPLADGAGPSNWHRFCRQPGRILNGDTGDTACDHYRRFREDVALMKALGLSAYRFSIAWSRIFPEGKGRINWRGIAHYQALVETLLEHGIRPMATLHHWDLPAALEDLGGWANRDSAGWFADYAHTVIRALGNEIDLWATLNEPWVIMDAGYVSGVHPPGHRSLKDAPWVTHNLLRAHALAVQAFRADGRGQIGLVVNLEPKYALTDSRDDRAAAERAHAYMNRQYLDPVLHGAYPDELAEISALHWPSFESEDLRVIQEPIDYLGINYYTRAVVRHDPSGGPLEVTAVPQRGVEHTEMGWEVYPQGLKDVLAWVKARYGDIPLYITENGAAFADPEGENGRIDDTRRIAYYRSHLRALHEAIAQGVDVRGYFAWSLLDNFEWTYGYARRFGLVQVDPLTQRRIPKASAGFYAEVAQTNGAVLDRDY

SEQ ID NO: 6544 - protein, 488 aa, Listeria monocytogenes
MTDRKNLTTNQGVPVGDNQNSMTAGRKGPTLIEDYVLIEKLAHFDRERVPERVVHARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREVRGSSVHAFKWINEEGKTVYVKLRWVPKAGIVNLSTEQASQIQAKEFNHASRDLYEAIENGDYPEWDLYVQVLDPKDLDSFDFNPLDATKDWFEDVFPYEHVGTMTLDRNPDNIFAETESVGFNPGVLVRGMLPSEDRLLQGRLFSYSDTQRHRVGPNYLQLPINSPKAPVANNQRDGHMPFKQQTSSINYEPNSYDTEPKENPAFIEPEQEIRGDISGRLIAEKPNNFGHAKEVWDRYSNAERAALVKNIVDDWSQVREDIKIRNLRNFYQVDPEFASRVAAGTGINLEEHVTDLK

SEQ ID NO: 6545 - protein, 370 aa, Arabidopsis thaliana
  misc_feature (259)..(259): Xaa can be any naturally occurring amino acid
METKQSIPLLMPYKMGPFNLSHRVVLAPLTRSRSYGNIPQPNAKLYYTQRTTPGGLLISESCVVSETSLGYPDLPGLWNRDQVEAWKPIVDAVHSKGGIFFCQIWHGGRVFHQDQPNGEAPVSSTDKPLMCKNMYGGQFKPPRRLRSDELPAIVNDFRIAARNAIEAGFDGVEVHGAHGYLIDQFLKDKVNDRSDQYGGSLENRCRFALEVIEAVVNEIGSDRVGIRLSPFADYMESGDSNPEALGLYLVQAMNKHGMXVVYGHMVEPRMKTLEGIFECTESLTPMRKAFKGTFIVAGGYSREDGNKAVEEGRTDLVAYGRPFLANPDLTRRFELNEPLNRYDRSTFYTSDPVVGYTDYPFLETTDTTTA

SEQ ID NO: 6546 - protein, 305 aa, Arabidopsis thaliana
MSLSASEKEENNKKMAADKAEMGRKKRAMWERKWKRLDIVKAFASLFVHFLCLLAPFNFTWPALRVALIVYTVGGLGITVSYHRNLAHRSFKVPKWLEYFFAYCGLLAIQGDPIDWVSTHRYHHQFTDSDRDPHSPNEGFWFSHLLWLFDTGYRVEKCGRRTNVEDLKRQWYYKFLQRTVLYHILTFGFLLYYFGGLSFLTWGMGIGVAMEHHVTCLINSLCHVWGSRTWKTNDTSRNVWWLSVFSFGESWHNNHHAFESSARQGLEWWQIDISWYIVRFLEIIGLATDVKLPSESQRRRMAMVR

SEQ ID NO: 6547 - protein, 182 aa, Oryza sativa
  misc_feature (31)..(31): Xaa can be any naturally occurring amino acid
  misc_feature (64)..(64): Xaa can be any naturally occurring amino acid
  misc_feature (112)..(112): Xaa can be any naturally occurring amino acid
  misc_feature (119)..(119): Xaa can be any naturally occurring amino acid
MSLIRRSNVFDPFSLDLWDPFDGFPFGSGGXSSGRCFPSFPRGDSSETAAFAGARIDWKETPEXHVFKADVPGLKKEEVKVEVDDGNILQISGERIKEQEEKTDKWHRVERXSGKFLRXFRLPENTKPEQIKASMENGVLTVTVPKEEPKKPDVKSIQITGLEHWANLKRFICGFKCIDHLC

SEQ ID NO: 6548 - protein, 338 aa, Burkholderia fungorum
MALQRRTTLTKYLIEQQRETNNLPADLRLLIEVVARACKAISYHVSKGALGDALGTAGSENVQGEVQKKLDILSNEILLEANEWGGNLAGMASEEMEQFFPIPANYPKGEYLLVFDPLDGSSNIDVNVSIGTIFSVLRCPDGQQPTEQSFLQPGTQQVAAGYAVYGPQTVLVLTTGNGVNCFTLDRELGSWVLTQSDMRIPVETREYAINASNERHWYPPVQQYIGELKDGKEGSRQSDFNMRWIASMVADVHRILNRGGIFMYPADKRTPDKPGKLRLMYEANPMAFIVEQAGGAATNGEKRILDIQPKSLHERVAVFLGSKNEVDRVTRYHLETKK

SEQ ID NO: 6549 - protein, 339 aa, Clostridium acetobutylicum
MKIFEAYTIKNMCLKNRIVMPPMCMYSSDNTGNINDFHLVHYTTRSIGGVGFIIVEATGITPNGRISDKDLGIWSEKHAEGLSFLVKEVKKYGSKIAIQLNHSGRKYEGTSGEPVAPSALAFDENSKTPKELTKNEIKEIILAFKAAAKRAEKAGFDAIEIHGAHGYLINQFLSPLSNFRDDEYGGSTENRTRFLKEVLEAVREVWPKEKPILLRVSAEDYRGGSGITPNEMVNIINIVKDLIDVVDVSSGGVAPAHINLYPGYQVKLSEVIKNECNVPTIAVGLICDINMVEEILSNNRADLVALGRELLRNPYFVLSSARLKNINIDFPKPYERAFN

SEQ ID NO: 6550 - protein, 209 aa, Orchis italica
MGRGNTEIKRIENSTNRQVTFSKRRSGIIKKAREISVLCDAQVSLVIFSSLGKLSEYCSPSTTLSKMLERYQQNSGKKLWDATHENLSAEIDRIKKENDTMQIELRLKGEDLNSLTPKELIPIEEGLQNGLTSVREKQMDFLKMLKKNERMLEEENKRLKYLLQHQQLAIEGSMRELEISYHQKDPEYADQMPMTFRVQPFQPNLHGNN

SEQ ID NO: 6551 - protein, 252 aa, Prunus emarginata
AHYKSEADVGNALAEAFETGLVKREELFITSKASNHGHVVEACKNSLKKLRLDYLDLYLVHYPLATKHSGVGTTASLLDENKVLDIDVTVSLETTWHTMEKTVYLGLVRSIGLSNYEFFLTRDCLSYAKIKPQVSQFETHPYFQRESLVRFCKKHGVTPMAHTPLGGATANVKAFGSISPLEDPVLLGLAKKYKKSVAQIALRWNIERDTAVIPKSSKVERLKENLEVLNFKLEKEDIELINTIDKKSRTTL

SEQ ID NO: 6552 - protein, 545 aa, Oceanobacillus iheyensis
MAKDLKFSEDARRAMLRGVDTLADAVKVTLGPKGRNVVLDKKFGSPLITNDGVTIAKEIELEDAFENMGAQLVSEVASKTNDVAGDGTTTATVLAQAMIREGLKNVTSGANPVGIRRGIEKAVELAVQELKGISQPIESKEAISQIAAVSSGDEEVGQLIAEAMERVGNDGVITIEESKGFNTELEVVEGMQFDRGYASPYMVTDQDKMEAVLEDPYILITDKKIGNIQEVLPVLEQVVQQGKPLLMIAEDVEGEALATLVVNKLRGTFNAVAVKAPGFGDRRKAMLEDIAVLTGAEVITEDLGLDLKSASIDQLGRASKVVVTKENTTVVEGSGDPEAISSRVAQIRAQAEESTSDFDKEKLQERLAKLAGGVAVIKVGAATETELKERKLRIEDALNSTRAGVEEGMVPGGGTALVNIHRQVSELTLEGDEATGASIVLRALEEPVRQIVHNAGLEGSIIVERLKGEKVGIGYNAATDEWVNMVEAGIVDPTKVTRSALQNAASVAAMFLTTEAVVADKPEENGGAGGGMPDMGGMGGMGGMM

SEQ ID NO: 6553 - protein, 427 aa, Prochlorococcus marinus
MNSSFNKLLTFKTLITALMIIVIYTNFLLIERVDALSDSKQLVLDAWTLVNEGFYDPDKFDEIQWKRIRQKTLQKQIETSEEAYSAIEDMLRPLEDPYTRILRPKDYELLKSSNFGSEINGVGLQLGEDDDSKKVKVISTLGGSPAEEAGIVSGEFIEKVDGISSEVLGLANTASKLRGESGTKVLVQISSEAGEIREVDLERRSVDLRPVRTKRLRDDSHTIGYLRITQFSESVPKKVEEALQELKEKEVEGLILDLRNNSGGLVSSGIAVADSLLSERPVVETKNRNGIKDAIISQKETFFDGPMVTLVNKGTASASEILAGSLQDNSRSILMGEQTYGKGLIQSLKSLGEDSGIAITVASYLTPKGNNIQGQGMKPDKLLDLPDATEYGSADDKWVKNAELFLDSLLEKEEVSSQTSELSNEEV

SEQ ID NO: 6554 - protein, 252 aa, Prunus emarginata
  misc_feature (193)..(193): Xaa can be any naturally occurring amino acid
AHYKSEADVGNALAEAFETGLVKREELFITSKARHHGHVVEACKNSLKKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSISPLEDPVLRALAKKXKKSVAQIALRWNLDRNTPVIPKSSKIERLKENLEVLNFKLEKEDIELINTIDKKSRTTL

SEQ ID NO: 6555 - protein, 155 aa, Pisum sativum
IIPRVFGTGRRTNAFDPFSLDLWDPFQNFQLARSATGTTNETAAFANAHIDWKETPEAHVFKADLPGVKKEEVKVEIEEDRVLKISGERKTEKEDKNDTWHRVERSQGSFLRRFRLPENAKVDQVKAAMENGVLTVTVPKEEVKKPEAKPIQITG

SEQ ID NO: 6556 - protein, 252 aa, Prunus emarginata
SSLQSEADVGNAIAEAIQSGLVKREELFITSKASNHGHVVEACKNSLKKLRLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCKKHGVTPMAHTPLGGATANVKAFGSISPLEDPVLLGLAKKYKKGVAQIALRWNIERDTAVIPKSSKVERLKENLEVLNFKLEKEDIELINTIDKKSRTTL

SEQ ID NO: 6557 - protein, 555 aa, Photobacterium profundum
MCSVFGILDIKSDPSALRATALEMSKKMRHRGPDWSGIYSSDKAILVHERLAIVDLNSGEQPLYNQDKTHILAVNGEIYNHKELSAEFAPDYPFQTESDCEIILALYKEKGPELLDYLNGIFGFILYDAVEDAYLIGRDHIGIIPLYQGYDEHGNYYIASEMKALVPICKTISEFPPGSFLWSKKGEPTRYYKRDWMEFETVADAPTDKVALKEALESAVKRQLMTDVPYGVLLSGGLDSSIISAITKKFAARRIEDDEKSQAWWPTLHSFAVGLEDAPDLKAAKIVADSIGTVHHELTYTIQEGIDAIRDVIYHIETYDVTTIRASTPMYLMSRKIRAMGIKMVLSGEGADEVFGGYLYFHKAPNKREFHEETVRKLLALNMFDCARANKSMAAWGIEARVPFLDKEFLEVAMRINPEDKMCGNGKMEKHILRECFEDHLPESVAWRQKEQFSDGVGYSWIDSLKEVAEAKVTEQQLETASFRFPYNTPTTKEGYMYREIFDELFPLESAAKCVPGGPSIACSSAKAIEWDESFKNSADPSGRAIAAVHNEAYK

SEQ ID NO: 6558 - protein, 227 aa, Capsella rubella
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQLMPPPQTQPQPFDSRNYFQVAALQPNNHHYSSAGGRQ

SEQ ID NO: 6559 - protein, 226 aa, Capsella bursa-pastoris
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENEKNNPSISLMPGGSNYEQIMPPPQTQPQPFDSRNYFQVAALQPNNHHYSSAGRQ

SEQ ID NO: 6560 - protein, 227 aa, Oryza sativa
MSLHTVVHHKFTTGVCEAGEEEGVGDRRPATDHVAAGEGAVCGRPGAERRPLVAFSLKDRSLHDEFEIDMLRRFGWIVPAYTMPPDAMVLRFVIREEFSRTLAERLVLDIEKVMCQLDALPSRLMPPVPPAPPSVSMGAHRAPPRRRAPHGPPLHSMDLALRVDLLSAGGRHASPSPPPLAGAIEAPPSSSPASHCWPQQTHSRREQRERNEMGDKRGKERRLMWQC

SEQ ID NO: 6561 - protein, 226 aa, Capsella bursa-pastoris
RGKTEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQIMPPPQTQPQQFDSRNYFQVAALQPNNHHYSSAGRQ

SEQ ID NO: 6562 - protein, 247 aa, Vibrio vulnificus
MSLSITHEKSLIDNYIWILFDKSKAIVIDPGESEKIINFLDKNNLTLEFIFLTHGHCDHTKGVFSLKEKFPNASLFVPIGLELGLGESIIKEGDELNLLNSTFNVLELPGHTDNHIGIMYKDNLFCGDVLFSAGCGRVGSNYKDMYLSLKKIKSMDDKTKIYFSHEYTLDNLKFAHYIDPKNKNIINYIEVFKEKPDTVSAPTTLLLEKEINPFLRLSENIDIKNKINNEFDAFVYLRKLKDKFNSI

SEQ ID NO: 6563 - protein, 482 aa, Brevibacterium flavum
MNANVRVFILNSLAMNDPQRPPTLLWFRDDLRLSDNAALKWAADHGPVIGLFIDETINRSIGAAARWWREQSLNALAQDLSFYGVPLLRRTGNPLEILPKIVSEMEVKAVTWNRRYHQPLCEVDATLKKNLRDQGIEVHSHPGFLLTEPWEVSTATGTPYKVFTPFSKAAWEVARGHAYETVKNNVTVPSHLTGPEGVELPIPEMEQPFWATTLVKECAPGEKNASEKLFDFLEHLQDYPQARDSLARSATSKLSAHLRFGEISIHRVWAETAAIDSEGTELFLKELLWRDFAWHRLYALPHMDTQNVRMQFNRFGWSWDPSEKDKLNTPSTPLIPTKADQFHEDLAAWRAGKTGIPLVDAGMRELWATGSMHNRVRMVVASFLTKNLQIHWRHGEEWFWETLVDADPASNAFNWQWAAGSGDDASPYFRIFNPVTQAKKFDPDETYIRRWVPEYGTPSYPDPIVDLKESRQIALDAYSAIK

SEQ ID NO: 6564 - protein, 542 aa, Oryza sativa
MAEAEAEAAGAGAGAGPARRTTRVGRYELGKTIGEGSFAKVKVARDTRTGDTLAIKVLDRNHVLRHKMVEQIKREISTMKLIKHPNVVQLHEVMASKSKIYMVLEYVDGGELFDKIVNSGRLGEDEARRYFHQLINAVDYCHSRGVYHRDLKPENLLLDSHGALKVSDFGLSAFAPQTKEDGLLHTACGTPNYVAPEVLADKGYDGMAADVWSCGIILFVLMAGYLPFDDPNLMTLYKLICKAKVSCPHWFSSGAKKFIKRILDPNPCTRITIAQILEDDWFKKDYKPPLFEQGEDVSLDDVDAAFDCSEENLVAEKREKPESMNAFALISRSQGFNLGNLFEKEMMGMVKRETSFTSQCTPQEIMSKIEEACGPLGFNVRKQNYKMKLKGDKTGRKGYLSVATEVFEVAPSLHMVELRKTGGDTLEFHNFYNNFSSELKDIVWKSESDAKAAKKREYKNAESYDIDSCWRKQRWDAKWICKCKWELGHHNHSCCQYSSASFFVMLEMKIYPPFEAPVILPSFFASSVLSASIIYGHGVRYF

SEQ ID NO: 6565 - protein, 524 aa, Solanum tuberosum
MFKSNNVTARLFERQICTPAPGTSIHRARRFYENIVPSYTIYDVECPDHSFRKFTDDGLYLVSFSRNHQDLVVYRPTWLTFSCKEEDCDTHDLPLKARKFESFFTQLYSVTLASSGELICKDFFLYMESNQFGLFATSTAQIHDAPPTGGAIQGVPSVEKITFHLLRLEDGAILDERVFHNDYVNLAHSIGAFLYDDLLAIVSLRYQRIHILQIRDSGDLVDVRAIGEFCREDDELFLNSNSQVLVNHVGNGFHHSLPESETSFLSGIKQRLLSFIFRGIWNEETDQTMRVQCLKKKFYFHFQDYIDLIIWKVQFLDRHHLLIKFGSVDGGVSRNADSHPSFFAVYNMETTEIVAFYQNSADELYFLFELFSDHFHVSSKSSLHMNFMSSHSNNIHALEQLRCTKNKATNFSQFVKKMMASLPFSCQSQSPSPYFDQSLFRFDEKLISAIDRHRQSTDHPIKFISRRQPNILKFKMKPGPEAGSTDGRTKKICSFLFHPILPLALSVQQTLFLQASVVNIHFRR

SEQ ID NO: 6566 - protein, 150 aa, Bradyrhizobium japonicum
MRYLHTMLRVRNLDVALKFYQDALGLKEVRRIENDKGRFTLVFLCSADDLEALKKQPQTRGAPLVELTYNWDEEKYGEDRFFGHLAYEVDDIYATCEKLMKAGVTINRPPRDGNMAFVRSPDLHSIELLQKGEPKAPQEPWSSMPNTGHW

SEQ ID NO: 6567 - protein, 486 aa, Neurospora crassa
MSSSNSRRLNIDNINPHVRAAKYAVRGELAVKSEEFRAALLRGTSDIPFSQVISANIGNPQQLDQKPITFFRQVLSLLENPLLLEHEDVLINHLGYKTDVIERAKWFLKNVGSVGAYSASNGAPAIRQHIAEFLERRDGFPANWQDIYLSAGASSGVNTLLHIICADEKSGILVPIPQYPLYTASLSILNATCVPYLLDESKNWGTDINTIKESYQKAKDAGVDTRAIVIINPGNPTGASLSEEDIRAVLEFARQERLVVLADEVYQTNVFIGEFISFKRVLRQLQKENPDGKYDCVELASLHSISKGMVGECGHRGGYFELVNFDPEVQAEIYKFVSIMLCAPVIGQCLVELMVNPPKPGEPSYELYEKEYRGIYEGMRERANALHKAFEQMEGVECGAPQGAMYLFPTINLPPKAAEAAAKEGRTPDEFYCMKLLEATGVCVVPGSGFGQKEGSLHFRTTFLAPGTEWVGSIVKFHKEFMDQYR

SEQ ID NO: 6568 - protein, 349 aa, Sinorhizobium meliloti
MSGATLEAYLASCTARGDDLSRDVAAVIQRLAKAALDIRKLVNQGALGTAFNGTHGGSNTDGDLQKDLDILCDDQFLTCLQGAPVACYASEELENPVLLDPSARLAVAIDPLDGSSNIDNNVSIGTIFSVLPAAKGPDVDPSQSFLQPGNRQLAAGFFIYGPQTALVLSLGKGTEIFIFSSRLGCFVEAYKSAIIPERAHEFAINMSNYRHWEEAIRLYVDDCLAGSEGPRERDFNMRWIASLVAETYRILIRGGIFLYPADGRKGYSQGRLRLVYEANPIAFIIENAGGAATTSIDRILDLVPENLHQRVPLVFGSRREVARITRYHVDPNMIGERAPLFGKRGLFRA

SEQ ID NO: 6569 - protein, 607 aa, Bacillus thuringiensis
MCGITGWVDWKEDLSNQHVILKKMANRIQHRGPDAEGFWFSPRAAFAHRRLIVIDPEGGTQPKTFRAGDYTYALTYNGEIYNFRELREQLRKCGHLFETHSDTEVLLHAYLEWKEDCVQHLNGIFAFALWDDQKQRLFLARDHLGVKPLFYTERNNSIIFGSEIKALLAHPSVPAEIDADGINEIFGLGLFRTPGCGVFKHIQEVRAGHSITFTRDKKVVTKYWNLESKIHTDSIEDTSSRILSILQDTVKRQLIADVPLVCMLSGGLDSSGITALAGKEFAAENKTLHTYSVDFVNSAKDFELTFARTGLDAPWVKRVSEHVGTSHHDIIVNAEELANHLFVPLRAKDLPSAGEMETSLYLLFCEMKKDATVALSGESADEVFGGYPWFHQEELLYVDKFPWLTNWKTTSPLLLHEVSNQCNLENYIDTRFQEAILEVPTLEGESKKSAKQRQMFYLFLTRFLPFLLDRKDRMSMAVGFEVRVPFCDYRLVEYLWNVPFNIKSIDNIEKGILRRALKPALPDDVRNRRKSAYPTSQDPHYLQTIRNLTLEMCSNKNSPIFSLINHSTLLAIADGSNKEINNFEARSAMEYMLQVNEWLKTYHIHIA

SEQ ID NO: 6570 - protein, 827 aa, Geobacter metallireducens
MVLQKQASSIKARLLRINLLLLGVTSLVIVLVVNVAQKRLALNDAGRDAERILVRYLAIHAYINKELKPRLLDFTASLRDKDYFDPVWMSSTYAVREIDKIFQSRHGKGYYYKECAINARSPRNEADPFEREFLERASHNPAVTTFNGVREIDGKLFFVAMARGEAMEKSCLLCHSNPETAPGGLVRTYGPNRSFSRHENELVSAISIRIPLSEAYAEANSFSLRLSALLLAVIASFFAIKNWFFGRVVLSPLASVTESARRIAHDRRYLGEQIPLGRDREMNELAASFNVMSTELHAFINNLEEKVEEKTAELVQAREEAEEANRVKGEFLATMSHEIRTPMNAIIGINQLLQETHLSQQQRRLVDDSSNAAESLLTIINDILDFSRVEARRLELSDEALELRSFVESLRRLFAVKAERENISLSILVGDEAPQFICGDPARLRQVLTNLLSNAIKFTPTGGRVTLAADADPAGGNLLFTVSDTGIGIEKDKHERIFEMFRQADSSTTRNYGGTGLGLAITRGLVELMGGTIEVESEAGKGAVFRVLLPLRPATGPPADKTAGEELSDSVLPSLSVLVVEDNELNRTVAIGLLTALKQRVAAVANGREAVDALRDGTYDLVLMDISMPEMDGIEATRAIRRGDAGEKARAIPIVALTAHALKDDRDRFLAAGMSDYLSKPLIRGELQRMLLRIAGERGELPPEERCPMRDAPDEGSPFDLEFQQSQFHDAGIGDCLAEVLSIFAQSTATECERMEEYLATGKYAELAAAAHSVKGAAATIGAPHVSRYAADVETAARKSDGVAVARTIPLLRREVRRVEAAVGEMS

SEQ ID NO: 6571 - protein, 176 aa, Zea mays
MADAPASPGGGGGSHESGSPRGGGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGGAYNQGMGYMQPQYHNGDISN

SEQ ID NO: 6572 - protein, 452 aa, Mesoplasma florum
MLKFPKNFHIGASMSAMQTEGKGITEIGDLTFDAYFKENPELFYHGVGPDLTSDITRHYKDDIEKFKYIGLDSVRTGFSWARLFPDGINLNKEAVKFYHDYIDEYLKNDIEIIMTLFHFDMPLWAHELGGWESREVIEKFISYCEFVFKEYGSKINYFVTFNEPLVPVFEGYVGKMHYPAKDSPKEAVAQAYGIFLAHAKAVKLFKELKIDSKIGVVYNWNFTFPFSDSAEDKISAEIYDAYVNRGPLNIMYNGNINPIIIKTLEEYNITPFHTSEEIEIIKQTEIDFLGVNYYFPCRVKTNENVKNRWALDQMHIEIPADAKINPFRGWEIYPEGLYDISIAIKKELNNIPWYIAENGMGVENEDRFRNENGQIDDDYRIEFLETHMSELKRGLDAGSNCFGYHIWAAIDCWSFRNAYKNRYGLIEVDLKDQSRKFKKSAYWYKELIENKE

SEQ ID NO: 6573 - protein, 499 aa, Aspergillus nidulans
MTTRTTVPNASQRALSTAAVRCLTLDNINSNVKAAKYAVRGELAVKAEEYRVRLAQGDKTLPFDSVIFANIGNPQQLDQKPITFFRQVLSLMENPLLLSNKDALRTSFGYQDDVIERAEKLLAEVQSVGAYSHSQGAPLIRESVAKFIEERDGFPADPQSLYLTGGASSGVNTILNVICNGPNAGVLVPIPQYPLYTATLSLLNAQCVPYHLEEQKAWGTDIGTIKKSLEQAKAAGTDVRAIVVINPGNPTGASLSPADIKSVLDIAAEEKLVVIADEVYQTNVFIGEFTSFKKRLRELQQEVPGKYDNVELVSLHSTSKGMVGECGHRGGYFELVGFDPLVAAQVYKFISIMLCPPVIGQCLVELMVNPPKEGEPSHELYQKEYNGIREGLRQRAFALYEAFQRMEGVECQEPQGAMYLFPTISLPPKAIEAAAAENRAADEFYCLRLLDATGVCVVPGSGFGQKENTLHFRTTFLAPGTDWVERIVKFHSEFMAKYK

SEQ ID NO: 6574 - protein, 213 aa, Sinapis alba
MVRGKTQMKRIENATSRQVTFSKRRNGLLKKAFELSVLCDAEVSLIIFSPKGKLYEFASSNMQDTVDRYLRHTKDRVSSKPVSEENMQHFKHEAANMMKKIEQLEASKRKLLGEGIGSCSIEELQQIEQQLEKSVKCVRARKTQVFKEQIEQLKQKEKALAAENEKLAEKWGSHEIEVWSNKKQESGRGDEESSPSSEVETQLFIGLPCSSRK

SEQ ID NO: 6575 - protein, 418 aa, Triticum aestivum
  misc_feature (355)..(355): Xaa can be any naturally occurring amino acid
MIGGGGGGALRRVGKYEVGRTIGEGTFAKVKFAQNTETGESVAMKVLDRSSILKHKMVDQIKREISIMKLVRHPNVVRLHEVLASRKKIFIILEFITGGELFDKIIRHGRLSEADARKYFQQLIDGVDFCHSKGVYHRDLKPENLLLDSQGNLKISDFGLSAWPAQGAALLRTTCGTPNYVAPEVLSHKGYDGALADTWSCGVILYVLLAGYLPFDEVDLTTLYGKIETAEYSFPAVFPSGAKSLIRRILDPSPDTRIRIEEIRKDEWFKKDYEPVREVENEEVNLDDVNAAFDDPEEDNQHTFDDEAGPLTLNAFDLIILSQGLNLSALFDRRQDYGQLHNRFLSRKTSKCYIXSSMEVVAQSMGVKTHIRHYKMRVGGSKCEQDLAISQLCLKFLKLPHPPLWWELERSAGRFFRV

SEQ ID NO: 6576 - protein, 644 aa, Chlamydia trachomatis
MMRFARFCLLVLTLFPQLAFSAEPLRRQDVRKTVDKLVEHHIDTQQISPYILSRSLEDYVRSFDSHKAYLTQDEVFSHAFSEEATRPLFKQYQEDNFSSFKELDTCIQQSISRAREWRSSWLTDSIRVIQDAMSHTIEKKPSAWASSIEEVKQRQYDLLLSYASIYLEDAAKNRYQGKEHALVKLCIRQIENHENPYIGINDHGYRMSPEEEANSFHVRIIKSIAHSLDAHTAYFSQEEALSMRAQLEKGMCGIGVVLKEDIDGVVVKEVLAGGPADKTGSLRVGDIIYRVNGKNIENTPFPGVLDSLRGSPGSSVTLDIHRQNNDHVIQLRREKILLDSRRVDVSYEPYGNGIIGKITLHSFYEGENQVSSEQDLRKAIRELQEKNLLGLVLDIRENTGGFLSQAIKVSGLFLTNGVVVVSRYADGSVKRYRTISPQKFYDGPLAVLVSKSSASAAEIVAQTLQDYGVALIVGDQQTYGKGTIQHQTITGSNSQEDFFKVTVGRYYSPSGKSTQLEGVKSDIVIPSRYAEDKLGERFLEYALPADQYENVINDNLGDLDINIRPWFQKYYSPHLQKPELVWREMLPQLAHNSQERLEKNKNFEIFVQHLKKTNKQDRSFGSNDLQMEESVNIVKDMILLKSIS

SEQ ID NO: 6577 - protein, 212 aa, Haemophilus influenzae
MNIEIIPVTAFQQNCSLIWDDDKNAAIIDPGGEAERLIQRIEELDLNLKVILITHGHLDHVGAAMQLKQHFGVEIWGSNEKDKFLFESLPEQAQRFGLPNIEAFLPDRWFNQEGEILKLDGFNFEILHLPGHTPGHIGFIEHEKKVAFTGDVLFQGGIGRTDFPRGDYETLISSIRTKLLPLNDDLIIIAGHGSYTTIGQEKRSNPFLNSKS

SEQ ID NO: 6578 - protein, 216 aa, Arabidopsis thaliana
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKEIELDNENIYLRTKVAEVERYQQHHHQMVSGSEINAIEALASRNYFAHSIMTAGSGSGNGGSYSDPDKKILHLG

SEQ ID NO: 6579 - protein, 226 aa, Capsella bursa-pastoris
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQIMPPPQTQPQQFDSRNYFQVAALQPNNHHYSSAGRQ

SEQ ID NO: 6580 - protein, 224 aa, Camelina sativa
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETLGSMSPKELRNLEGRLERSITRIRSKKNELLFSEIDYVQKRESDLHNDNQLLRAKIAENERNHPSISLMPGGSNYEQLMPPPQTQPFDSRNYFQVAALQPNNHHYSSAGRQ

SEQ ID NO: 6581 - protein, 695 aa, Haemophilus influenzae
MVMKFKMSKNVICYAWLSVCLSSAIPAFAVQPTLKPSDISIPAISEESQLATKRATTRLTQSHYRKIKLDDDFSEKIFDRYIKNLDFSHNTFLQSDIDELRQKYGTKLDEQLSQGDLSAAFDIYDVMMKRRYERYTYALSLLDKEPDLNGQDQIEIDREKAAAPQTEADANKLWDARVKNDIINLKLKDKKWSEIKAKLTKRYNLAIRRLTQTKADDIVQIYLNAFAREIDPHTSYLSPRTAKSFNESINLSLEGIGTTLQSEDDEISIKSLVPGAPAERSKKLHPGDKIIGVGQATGDIEDVVGWRLEDLVEKIKGKKGTKVRLEIEPAKGGKSRIITLVRDKVRIEDQAAKLTFEKVSGKNIAVIKIPSFYIGLTEDVKKLLVKLENQKAEALIVDLRENGGGALTEAVALSGLFIADGPVVQVRDAYQRIRVHEDDDATQQYKGLLFVMINRYSASASEIFAAAMQDYRRGIIIGQNTFGKGTVQQSRSLNFIYDLDQSPLGVLQYTIQKFYRVNGGSTQLKGVAADINFPEIIDAKEYGEDKEDNALAWDKIPSASYTEVGNIDYIDNAVNILNEKHLARIAKDPEFVALNEELKVRNERRDRKFLSLNYKMRKAENDKDDARRLKDLNERFKREGKKALKDIDDLPKDYEAPDFFLKEAEKIAADFVIFNSDQKINQANGLSEAKTESKK

SEQ ID NO: 6582 - protein, 151 aa, Brassica napus
MFSSGNVTSRVFERQIRSSPPGASVNRARKFYENLVPSHTLYDVECPDHCFRKFTEDGLFLISFSRNHQELVVYRPSWLTYTSVSDDTLPPLPRRASRFDSFFTQLYSVNLASANELICKDFFLYFPSRRFGLFATSTAQIHDSAPFPPPV

SEQ ID NO: 6583 - protein, 228 aa, Lepidium squamatum
RGKIEIKRIENTTNRQVTFCKRRNGLLKKAYELSVLCDAEVALVVFSSRGRLYEYSNNSVKGTIERYKKAISDNTNTGSVAEINAQYYQQESAKLRQQIVSIQNSNRQLMGETIGSMSPKELRNLEGRLERSITRIRSKKNELLFAEIDYMQKREVDLHNDNQLLRAKIAENERNNPSISLMPGGSNYEQIMPPPQTQPQPQQFDSRNYFQVAALQPNNHHYSSAGRQ

SEQ ID NO: 6584 - protein, 230 aa, Lepidium squamatum
RGKIEIKRIENTTNRQVTFCKRRNGLLKKAYELSVLCDAEVALVVFSSRGRLYEYSNNSVKGTIERYKKAISDNTNTGSVAEINAQYYQQESAKLRQQIVSIQNSNRQLMGETIGSMSPKELRNLEGRLERSITRIRSKKNELLFAEIDYMQKREVDLHNDNQLLRAKIAENERNNPSISLMPGGSNYEQIMPPPQTQPQPQSQSFDSRNYFQVAALQPNNHHYSSADRQ

SEQ ID NO: 6585 - protein, 226 aa, Lepidium phlebopetalum
RGKIEIKRIENTTNRQVTFCKRRNGLLKKAYELSVLCDAEVALIVFSSRGRLYEYSNNSVKGTIERYKKTKSDNSNTGSVAEINAQYYQQESVKLRQHIVSIQNSNRQLMGETIGSMSAKELKNLEGRLERSIARIRSKKNELLFAEIDYMQKREVDLHNDNQLLRAKIAENERNNPSISLMPGGSNYEQIMPPPQTQTQPFDSRNYFQVAALQPNNHHYSSAGRQ

SEQ ID NO: 6586 - protein, 349 aa, Oryza sativa
LVRHPNIVQLYEVMATKTKIYFVLEHVKGGELFNKVQRGRLKEDAARKYFQQLICAVDFCHSRGVYHRDLKPENLLLDENSNLKVSDFGLSALADCKRQDGLLHTTCGTPAYVAPEVINRRGYDGAKADIWSCGVILFVLLAGYLPFHDKNLMDMYKKIGKAEFKCPSWFNTDVRRLLLRILDPNPSTRISMDKIMENPWFRKGLDAKLLRYNLQPKDAGLLALSTGLDLSGMFEESDKKESKFTSTSTASTIISKIEDIAKGLRLKLTKKDGGLLKMEGSKPGRKGVMGIDAEIFEVTPNFHLVELKKTNGDTLEYRKVLNQEMRPALKDIVWAWQGEQPKQQQQPTC

SEQ ID NO: 6587 - protein, 330 aa, Debaryomyces hansenii
MNVDTDIITLTRFILQEQQKEAPNATGELSLLLNSLQFAFKFIAHNIRRAELVNLIGISGSANSTGDVQKKLDVIGDEIFINAMKSSNNVKVLVSEEQEDLIVFEGGGRYAVCTDPIDGSSNIDAGVSVGTIFGIYRLKEDSQGSIKDVLRKGTEMVAAGYTMYGASAHLMLTTGQGVNGFTLDTQLGEFILTQPHLTIPKTRAIYSVNEGNSHYWADSAKQYIADLKKPQEDGKPYSARYIGSMVADIHRTILYGGIFAYPADSKLKNGKLRILYECFPMAMLMEQAGGAAINDKGERILEILPKGIHDKSGIWLGSTGEVDRYLTYLK

SEQ ID NO: 6588 - protein, 280 aa, Listeria monocytogenes
MTLSFSDTYRLNNGIEMPRHGFGVYKLTDEARMRTALETAVDVGYRLFDTASFYHNEKELGDFFASSGLKRDEFFVTTKMWNTEQGYDETLRAFEKSQKKLQLDKIDLYLVHWPKQDTFFDTWRAVEKLYDEGLVRAIGVSNFEAHHLDRLRTSANVLPVVDQLETHPHFPNHLLHRYLEELHIVHQAWSPLGRGGVLQEQILIDLAEKYGKSPAQIVLRWHLQNNISIIPKSETPSRIRENAAIYDFELSEADMRQVERLNTGERVSHAPDVMYVRSEI

SEQ ID NO: 6589 - protein, 275 aa, Bacillus thuringiensis
MHIPTTTLHNGVKMPLIGLGVYKAKEGDEVKQAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKIKPMVNQVELHPMLTQFELRNFCQGEQIQMEAWSPLMRGGEVFQHPIIQAIATKYEKTPAQVILRWDIQSGIVTIPKSVTPSRIQENFSIFDFSLTEEEMTEINTLNRNLHVGTNPDKYDTL

SEQ ID NO: 6590 - protein, 542 aa, Rhizobium leguminosarum
MAAKEIKFSTEAREKMLRGVDILANAVKATLGPKGRNVVIDKSFGAPRITKDGVSVAKEIELEDKFENMGAQMVREVASKTSDIAGDGTTTATVLAQAIVKEGAKAVTSGMNPMDLKRGIDLAVAAIVAELKANARKISNNSEIAQVGTISANGDAEIGRFLAEAMEKVGNDGVITVEEAKTAETELEVVEGMQFDRGYLSPYFVTNADKMRVEFEDPYILIHEKKLSNLQSMLPVLEAVVQSSKPLLIIAEDVEGEALATLVVNKLRGGLKIAAVKAPGFGDRRKAMLEDIAILTAGTVISEDLGIKLESVTLDMLGRAKKVSIEKENTTIVDGSGAKTDIEGRVAQIKAQIEETTSDYDREKLQERLAKLAGGVAVIRVGGSTEVEVKEKKDRVDDALHATRAAVEEGILPGGGVALLRAVKALDAVKTANGDQRVGVDIVRRAVEAPARQIAENAGAEGSVIVGKLREKSEFSYGWNAQTGEYGDLYAQGVIDPAKVVRTALQDAASIAGLLVTTEAMIAEKPKKDAPPPMPAGPGMDF

SEQ ID NO: 6591 - protein, 544 aa, Rhizobium leguminosarum
MSAKEIRFSNDARDRLLRGVELLNNAVKVTLGPKGRNVVIDKAYGAPRITKDGVSVAKEIELADKFENMGAQMVREVASKTNDLAGDGTTTATVLAASIFREGAKLVAAGMNPMDLRRGIDLGVTAVVKEIKARAMKVKSSSEIAQVGTIAANGDAAIGEMIAKAMDKVGNEGVITVEEARTAETELDVVEGMQFDRGYLSPYFVTNAEKMRVELEDPYILVHEKKLGSLQAMLPILEAVVQTGKPLLLISEDVEGEALATLVVNKLRGGLKVAAVKAPGFGDRRKAMLEDIAVLTSGQMISEDLGIKLDNVTLDMLGHAKRVLIDKESTTIIDGSGEKAAIQARIQQIKAQIEETTSDYDKEKLQERLAKLAGGVAVIRVGGATETEVKEKKDRIDDALNATRAAVEEGIVPGGGVALLRAKSALTGLTGENADVTAGISIVLRALEAPIRQIADNAGFEGSIVVGKLAGSNNHNQGFDAQTETYVDMIEAGIVDPAKVVRTALQDAGSIAALLITAEVMIADIPARDSAPAAGNGGMGDMGY

SEQ ID NO: 6592 - protein, 585 aa, Magnetospirillum magnetotacticum
MCGIAGLMTPGGPPDETVLDKLADALAHRGPDGRGRHVQGNVGLVQNRLSIIDLEGGRQPILDGQGNAIVANGEVYNYLELKSDMAGQAFATGSDCEPPLHLYRHQGPAFARSLRGMYALAIHDGKAEKLILCRDPFGIKPLYLAEGSPGLAFASEPQALLAAGLVKPELDPVALAELLQLQFTTGTRTIFKGIRRLAPGETVVAEEGCVAESRRLPALPAGGPNEGGLDQLLDQLDDTLTESVELHQRSDVPYGMFLSGGIDSSVVLALMARLNPRGILAFTAGFPGTKVHDEREHARDLARAVGARHVEVEFTQSDFWALLPQVAAAMDDPAADYACLPTFKLAQEARKEVKVILSGEGGDELFGGYGRYRHAMRPWPLTKSMRRKGTFDGLDVLRDGILSHWRHGMKLAERVEAMPGRTRLQVAQAVDCADWLPNDLLAKADRCLMANGIEGRVPFLDPVVAAFAFRLPDHLKVRKGLGKWILRRWLETALPASRPFEKKRGFTVPVAEWIAARPEIGHLVAHQPGIEEICHPGKVKRLFKDCTKDTGFACWTLLFYALWHQRHVLGKIPDGDAFSALAERI

SEQ ID NO: 6593 - protein, 656 aa, Unknown
  Bradyrhizobium sp. BTAi1
MCGIAGLFRPGGADDSALAGIVGRMTAALAHRGPDASGSWVSGRQGIALGQRRLAILDLSEAGAQPMHSACGRYTITFNGEIYNHLDLRAELEDAAAAPNWRGHSDTETLLAAIRQWGLVPALQRLIGMFAFALWDAETRQLILARDRFGEKPLFYGWSGADLVFGSELKALAAHPGWAPSLDRAALTDFMRYSYVPAPATIWRDVRKLPPASFVAFVADAGPGTSPTAQSYWSLRDTVVAAQGDRISGESEAIARLEQLLSTAVKRQCLSDVPLGAFLSGGVDSSTIVALMQAQASQPVRTFSIGFAEGGYNEAEDARKVAQHLGTDHTELYVDARTAMEVVPKLPRIYDEPFADSSQIPTHLVAQLARRHVTVALSGDAGDELFGGYNRHVWGSALQARLGRVPMPLRRAIGAALGAIAPEPADTLLNMLQPVLPARLRVRHAGDQVAKLARIVAADGFDGLYRTLCSIDQDPRATVVAGEERASWAASEMKQLRGQISLLDRMTLADSLSYLSDDILQKVDRAAMAVALETRVPFLDRDVVEFSTRVPASMKVRDGRGKWLVRQVLYRHVPADMIDRPKTGFSIPLDAWLRGPLKSWAGDLLSPARLKRQGLFAPTRVTRMFEEHLSRRHNHAYWLWNVLMAEAWYDEWGRAG

SEQ ID NO: 6594 - protein, 532 aa, Schizosaccharomyces pombe
MQTPSSASAESEKDSGNTYVGPWLLGRTLGQGNLAKVKLGKHFQTNEKVALKMVYNDELEDKDTWKRLQREVTILRQLHHPNIITLYQVFRVPKYTVLALEYMDTDLHSMVVKHNRLDECTTRKIFRQIVHAIDYCHLHRVAHRDLKLENILLNKDLVVKLTDFGLSNFMLDGSFLSTSCGTPHYAAPEVIQGRYYDGCDVDVWGCGILLYLMLVGEFPFEDVTISNVLSRVCKGIYTIPSFVSSSASDLIRQMLMVLPTSRIKVAEIMQHPWFIADLPTHSRLPSRTSSFSSKHRSVTFSPPDLAILFDPSITSPSSSVGQIPQPTDHSALSPSKPMSISGTESPNPDPASLCYSSYEDLYSATSWHSDMAESSGFLDPTDIPPIPSNVETLRSSLPQRHASFMNKVYNHPLSRPPAPNRLRSLRWHYGIQTAKNPIEVLRKLCEALLELGARFRPCDEESFLKENKYKVFSCITCHNSPVYLVIELFSIGPSASVIDIRFSSSDDSIKYTSSYSPMPFLEVVKQLILKIA

SEQ ID NO: 6595 - protein, 545 aa, Porphyromonas gingivalis
MAKEIKFDMESRDLLKKGVDALANAVKVTLGPKGRNVILSKTYGAPHITKDGVSVAKEIELECPFENMGAQLVKEVASKTNDDAGDGTTTATILAQSIIGVGLKNVTAGANPMDLKRGIDKAVKAVVTHIAGMAKEVGDDFQKIEHVAKISANGDENIGSLIAEAMRKVKKEGVITVEEAKGTDTTVEVVEGMQFDRGYISPYFVTNTDKMEVQMENPFILIYDKKISVLKEMLPILEQTVQTGKPLLIIAEDIDSEALATLVVNRLRGSLKICAVKAPGFGDRRKAMLEDIAILTGGTVISEETGLKLENATMDMLGTAEKVTVDKDNTTIVNGAGNKEGIASRITQIKAQIENTTSDYDREKLQERLAKLAGGVAVLYVGAASEVEMKEKKDRVEDALSATRAAIEEGTVPGGGTAYIRAIAALEGLKGENEDETTGIEIVKRAIEEPLRQIVANAGKEGAVVVQKVKEGKDDFGYNARTDVFENLYTTGVIDPAKVTRVALENAASIAGMFLTTECVIADKKEDNPAAPAMPGGMGGMGGMM

SEQ ID NO: 6596 - protein, 350 aa, Pseudomonas aeruginosa
MATLFDPIVLGDLELPNRIVMAPLTRCRADEGRVPNALMAEYYAQRADAGLILSEATAVTPMGVGYPDTPGIWSDDQVRGWSNVTKAVHAAGGRIFLQLWHVGRISDPLYLNGELPVAPSAIAAEGHVSLVRPKRPYVTPRALDTEEIADIVEAYRQGAERAKAAGFDGVEIHGANGYLLDQFLQDSTNKRTDRYGGSIENRARLLLEVTDAAISVWGAQRVGVHLAPRADSHDMGDSNRLETFSHVARELGKRGIAFICAREAQADDSIGVALKKAFGGPYIANEQFTLDSANAILAKGDADAVAFGVPFIANPDLVERLRQGAELNPPRPETFYTGGTEGYLDYPTLA

SEQ ID NO: 6597 - protein, 534 aa, Streptococcus oralis
MSKEIKFSSDARSAMVRGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIEAAVAAAVEALKNNAIPVANKEAIAQVAAVSSRSEKVGEYISEAMEKVGKDGVITIEESRGMETELEVVEGMQFDRGYLSQYMVTDSEKMVADLENPYILITDKKISNIQEILPLLESILQSNRPLLIIADDVDGEALPTLVLNKIRGTFNVVAVKAPGFGDRRKAMLEDIAILTGGTVITEDLGLELKDATIEALGQAARVTVDKDSAVIVEGAGNPEAISHRVAVIKSQIETTTSEFDREKLQERLAKLSGGVAVIKVGAATETELKEMKLRIEDALNATRAAVEEGIVAGGGTALANVIPAVADLELTGDEATGRNIVLRALEEPVRQIAHNAGFEGSIVIDRLKNAEVGTGFNAATGEWVNMIEEGIIDPVKVSRSALQNAASVASLILTTEAVVANKPEPAAPAPAMDPS

SEQ ID NO: 6598 - protein, 228 aa, Eruca sativa
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKREVDLHNDNQLLRAKIAENERNNPGMISLMPGGSSNYEQIMPPPQTQPQTFDSRNYFQVAALQPNNHHYSSAGRE

SEQ ID NO: 6599 - protein, 771 aa, Unknown
  Azoarcus sp. EbN1
MRIVCIGGGPAGLYFALLMKKLNPAHEIAVVERNRPYDTFGWGVVFSDATMDNMREWDPVTAEAIQVAFNHWDDIELHFKDHTIRSGGHGFVGIGRKKMLNILQARCEELGVELVFDRDVESDSEFPDADLIIASDGINSRIRNKYAEVFKPDIVTRPNRYIWLGTNQLFDAFTFLFEKTEHGWFQAHVYKFDDTTTTFIVECPEHVWLAHGLDKAGQEQSIEFCQKLFGKYLDGHRLMTNARHLRGSAWLNFQRVKCEQWHHDNGRSHVVLMGDAVHTAHFAIGSGTKLALEDAIELTRLFRDEGDTPEHIPAVLERYQAARNIDVLRLQNAAWNAMEWFEVCGARYCDTLEPEQFMYSMLTRSQRISHENLRLRDATWLEGYERWFANNAGLPVKAGEAPPPMFTPFTLRGLTLANRVVVSPMAMYSADDGSANDFHLVHFGARALGGAGLLYTEMTCVSPDARITPGCAGMYKPEHVNAWKRVVDFVHANSGAKMGIQLGHAGRKGATKLAWEGIDEPLEAGGWPLMSASPLPYLPHSQVPREMTRDDMERVRDDFVRATKMAFEAGFDILELHCAHGYLLSSFLSPLTNRRRDDYGGGHENRVRFPLEVFRAMRAAWPSNRPMSVRLSCHDWFPGGNTADDAVAFARLFRDAGADLIDCSSGQVWKGDRPVYGRMYQTPFADRIRNEAGIPTVAVGALYEADHANSIIAAGRADLCAIARPHLADPAWTLHEAAKIGFDDVAWPKQYLSARSQYETNLRREGGAPDK

SEQ ID NO: 6600 - protein, 231 aa, Eruca sativa
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKRSLQEVDLHNDNQLLRAKIAENERNNPGMINLMPGGSSNYEQIMPPPQTQPQTFDSRNYFQVAALQPNNHHYSSAGRE

SEQ ID NO: 6601 - protein, 226 aa, Guillenia flavescens
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQNIISIQNSNRQLMGETIGSMSAKELRNLEGRLDRSINRIRSKKNELLFAEIDYMQKREVDLHNDNQLLRAKIAENERNHPSMSLMPGGSNYEQIMPPPQTQSQPFDSRNYFQVAALQPNNHHYSSAGRQ

SEQ ID NO: 6602 - protein, 397 aa, Rickettsia sibirica
MLSKLNKPALFALIFYPIFIISLVVKYSFDYGIGLTEVIFIIASYYINNITVGIGLHRLWSHNAYKINKYAEFVLIMLSAGTLQGPALSWASNHYKHHRYTDQDQDPHTPLKFDNKFLGFMWSHIGWMLVGSGSYKSIDRITWAKHGKNNLLKWQLKYYWQIAAFMNIVVPLFIGYLVGGTMQSAYAGFLFMGLGRFLQQQATFCVNSLCHFAGSKKYYKGTAGDIWWMALFLLGENWHNYHHAFPSDYRNGAKWYHFDVHKWIIFLMSKIGLASELERTTKVRIQAKMQETLSYLSEKQKQKLTLMQTKIDHLLENLCLKIKELEESSITIKEQFKKSFVEIQESLKNLAEQVSAATQITEKSSEKLLKIINKKIIDAEQSIYKLYNKLNTLKVSN

SEQ ID NO: 6603 - protein, 632 aa, Bacillus licheniformis
MCGFVGVFNHRPSSETAAQEELIKQMNEMIVHRGPDDDGYYHDEHVGFGFRRLSIIDVENGGQPLSYEDDSYWIIFNGEIYNYIELKDELLSKGYEFKTDSDTEVLLATYRHYKQEAASKLRGMFAFLIWDKKEQLLYGARDPFGIKPLYFTKTDGHVYFASERKSLMAVDADLELNEKALQQYTSFQFVPEPETLDKKVQKVESGHQFTVRPGEDIQFKTYWKVQFKPVQTEEDKLVQEVRDAIFDSVKVHMRSDVPVGSFLSGGIDSSFIVSVAKQFHPNLKTFSVGFEHEGFSEVDVAKETADKVGVENFSAIISPEEYMNELPKIVWHLDDPLADPAAIPLYFVAKEAKKQVTVVLSGEGADELFGGYNIYREPLSLKPFERIPSPLKKMLLRVASAMPEGMKGKSFLMRGCTPLEDRYIGNAKIFEEGMKSKLLRQYDSNLSYCDVTKPYFEESRSYSEINKMQYVDIHTWLRGDILLKADKMTMANSLELRVPFLDKVVFEAASKIPEELKTKNGTTKYLLRKAAEGIVPEHVLNRKKLGFPVPIRHWLKNEMHDWAVNIIKESETDAYIHKDYVLQLLEDHCANKADNSRKIWTVLIFMIWHSIFVEKRFVPEELNHQPKEVIIV

SEQ ID NO: 6604 - protein, 471 aa, Legionella pneumophila
MTIALVWFRQDLRLTDNPAFIEACSHHEIVIPLYIYDDKCSVLGQAQAWWLHHSLIALGKSLNQQGLSLVLRKGDPQEIILELVAQYGVESVYWNRCYEPQVIARDKKIKLALGEREIKVQSFNGNLLHEPWTIKNKNGDFFKVFTPYWKQCRQILNIPSPFMLTKRPRGIEITSDDLGKWKLLPAINWAARFSEYWTPGEEGAQKKLDEFIVHHLSGYKRERDFPAKNATSRLSPHLHFGEISPWVILRALELAKLEQTCDLASVEHFLSELGWREFSVYLLYHFPKLDCENFRKEFDAFPWQNDEQLLTCWQKGMTGYPIIDAGMRELWATGYMHNRVRMIVASFLTKDLLIDWRSGAQWFLDTLVDADLANNSASWQWVAGCGADAAPYFRIFNPVLQSQKFDPDGIYIRQWIPELAQLNSQSIHQPWTDADANSIFLGKKYPKPIIDHQEARTKALSYYQQIKKGMD

SEQ ID NO: 6605 - protein, 226 aa, Thlaspi arvense
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSITRIRSKKNELLFSEIDYMQKREVDLHNDNQLLRAKIAENERSNPSMNLMPGGSNYEQLMPPPQTQSQPFDSRNYFQVAALQPNNHHYSSAGRQ

SEQ ID NO: 6606 - protein, 226 aa, Thlaspi arvense
RGKIEIKRIGNTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSITRIRSKKNELLFSEIDYMQKREVDLHNDNQLLRAKIAENERSNPSMNLMPGGPNYEQLMPPPQTQSQPFDSRNYFQVAALQPNNHHYSSAGRQ

SEQ ID NO: 6607 - protein, 66 aa, Solanum tuberosum
QTQNAHLEFVEVLNVKEQVVAGMMYYITLVATDDGYKKIYKTKIWVKEWENFKEVQEFKQIVYATK

SEQ ID NO: 6608 - protein, 154 aa, Medicago sativa
AVKMLLIPWKWGMKYFWDTLLDADLESDILGWQYISGSLPDGHELERLDDPEIQGTKYDSEGEYVRQWLPELARIPTEWIHHPWNAPPTVLRASGVELGQNYPKPIIDIDLAREQLTQAIFKMWEDEAASKSSTSENKHEVVDDSENLSIPKFS

SEQ ID NO: 6609 - protein, 140 aa, Kluyveromyces lactis
MSSWLSESQQFGAVFTFGGCLFFLFGIFTFFDRALLAVGNILFLLGVLLMIGPHKTLKFFTRPTKRRGTLFLVFGIFMILCKWTFLGFIIESLGIVGLFGDFFGVILQLLRSIPIIGPVLSHPTIAPVLDRIAGVSVLPV

SEQ ID NO: 6610 - protein, 1349 aa, Candida albicans
MPHSRQPSISSSIMSQSNHNHPQKIGPWKLGKTLGRGATGRVLLATHQTTGQKAAVKVVSKSELQDEETEKNGDGLPYGIEREIIIMKLLTHPNVLRLYDVWETSKALYLVLEYVEGGELFDLLVERGPLPEVEAIKYFRQIILGTAYCHALGICHRDLKPENLLLDSQLNVKLADFGMAALESNGKLLETSCGSPHYAAPEIVSGLKYHGAASDVWSCGVILFALLTGRLPFDDENIRNLLLKVQAGNFEMPVDEVSREARDLIARMLEVDPMRRISTEKILRHPLLTKYPMSNEDLISEKSLPHPQTGYKSLGSVRNIDKQILSNLTILWNDRPEEEIVDCLLKDGSNPEKTFYALLMRYKHNQEDNTNNNSPKKSTSFNNKVVRSGSKYSLNGTPRRKRASHISVSRPTSFQYKSNPGAGATANRNSVARHSVASSANNSPRKSPYKSPYRSPYRSPYKSPSKRYSYNQSPTKSPYGRRSNSQRQFENEPLKAKPRNIYNEIVDAQSNFSLPPSLPPSLPSKDSRYMIDEPNQPQLQQPALSQVPENPIVDESPDLMQSAKISSGKRNSIIGKNNNNSNSNKRMSKRKSIRASMTTGLKRNSITMKLLSTYAKLSGDDDWEYMDKQTKRTSATFAALCDKIFNQEDYDEEDEQLVDPEEKEAKEYERLMELERKKHEAELKARRELEKKKRRQKRRSILSSKKLSIIVKNDADPNNSEQELVDEGIKQPKRQSKNLTALRALSEGNHASEELTLEDVENLKRRSASQPVPKRRQTPVLTRRPVSRLDPLWQAHENEQLDRAKDALEQEWRDSQKRSSTVSRKKVNRESMISVMDDIVEEDQGRVNRRSTRNTYYERERDYELPEPTVEDSNLTDDYMTEIRKSRLLNSQLNVRDPLNEKRKSEPKTLISNVQIPSVTRKSRNFTTSNKRLSVLSMYSTKESYRDLNSIINSPDENPEQHQNMNKPALRTSIADRLDKAGLAEPEYETETDGEDKVSVIDLDDHLADRRTSYYDGSGKRASRASTTKRYNVHSSSGQRPKSKVPDLPKNDYDDTFVSNSDEVHKRQYKSMVSDESSASDDVFDKIKLPDGKSTKSSIDELANGTSTSGHRKPKIRHSQPGPEMLIPHLNGGIESSQPMSKVRGNNSSGHDDSVPPPPPAHKVNKKPLDDKTNFPPPEVDPKRKGSFFRKLSWGSKKTIENNTNAATNTTTQQQLPSPAESKEEKPKSSFFRWFSSSNTPSAAEIRKFNTILPKHEMSTALFALLNSWSNFGLKDLRNDQVGYYITGAISKHNSFNLKSCKFRIKINQRDFNQKSEIVCVRVKGSKVTTDTLFSEIEKVLLKEGVLDK

SEQ ID NO: 6611 - protein, 163 aa, Bradyrhizobium japonicum
MALRELIPWNNGSRNLPARRTEVDNPFLSLHREMNRLFDDVFRGVDIGQFAPPATMGWPSVEFNETDKEVKVIAELPGIEQKDVEVELADGVLTISGEKKSETKDKERRFSERYYGRFERRIPVDDVDQDKVAASFKDGILTVTLPKSPTEQRKVKRIAINGK

SEQ ID NO: 6612 - protein, 220 aa, Zea mays
MGQQSLIYAFVARGTVVLAEYTEFTGNFTTIASQCLMKLPASNNKFTYNCDGHTFNYLVEDGFTYCVVAVESVGQQIPIAFMDRVKEDFTKRYGGGKAATAAANSLNREFRLKLKEHMQYCVDHPEEVSKLAKVKAQVSEVKGVMMENIEKVLDRGEKIELLVDKTENLRSQAQDFRQQGTNVRRKMWLQNMKIKLIVLGIIIALILIIILSVCHGFKCH

SEQ ID NO: 6613 - protein, 277 aa, Streptomyces coelicolor
MSSKVPPIILNNGVEMPQLGFGVWQVPDDDAQTAVALALEAGYRSIDTAAIYGNEEGTGRAIAASGLAREDLFVTTKLWNSDQGYDSTLRAFDTSMAKLGLEYLDLYLIHWPMPAKERYVDTYKAFEKLLADGRVRAIGVSNFLPEHLERLTAETSVIPAVNQIELHPHLQQHAAREVHAEQGIATEAWSPLGSGKGILDIPAIVAIAQKHGRTPAQVVLRWHLQLGNVVIPKSVTPSRIKENIDVFGFSLDTEDLAAISALNEDRRLGSDPADVNS

SEQ ID NO: 6614 - protein, 474 aa, Streptococcus pyogenes
MGIFPKDFLWGGAVAANQVEGAFEADTKGLSVQDVLPNGGLGEWTDSPTSDNLTLEAIDFYHRYKEDIALFAEMGFKVFRTSIAWSRIFPNGDDDQPNEAGLQFYDDLFDELLNYGIEPLVTLSHYETPLHLAKAYNGWTDRRLIGFFERFAQTVMERYKDKVKYWLTFNEVNSILHMPFTSGGIMTEKEKLSLQDLYQAIHHELVASASVTKLAHEINPDVKVGCMILAMPAYPMTSDPRDILAAHAFENLNLLFSDIHVRGKYPSYIKSYFKENGIEIVFEDGDKELLAEHTVDFLSFSYYMSVTQAHNPEAYTSGQGNILGGLSNPYLESSEWGWQIDPIGLRLVLNQYYDRYQIPLFIVENGLGAKDQLVQTADGSMTVHDDYRIDYMSQHLVQVAKAIEDGVEVMGYTAWGCIDCVSMSTAQLSKRYGFIYVDRNDDGTGQLTRYKKKSFDWYRQVIQTNGRYLEDNFS

SEQ ID NO: 6615 - protein, 1122 aa, Arabidopsis thaliana
MSGSRPTQSSEGSRRSRHSARIIAQTTVDAKLHADFEESGSSFDYSTSVRVTGPVVENQPPRSDKVTTTYLHHIQKGKLIQPFGCLLALDEKTFKVIAYSENASELLTMASHAVPSVGEHPVLGIGTDIRSLFTAPSASALQKALGFGDVSLLNPILVHCRTSAKPFYAIIHRVTGSIIIDFEPVKPYEVPMTAAGALQSYKLAAKAITRLQSLPSGSMERLCDTMVQEVFELTGYDRVMAYKFHEDDHGEVVSEVTKPGLEPYLGLHYPATDIPQAARFLFMKNKVRMIVDCNAKHARVLQDEKLSFDLTLCGSTLRAPHSCHLQYMANMDSIASLVMAVVVNEEDGEGDAPDATTQPQKRKRLWGLVVCHNTTPRFVPFPLRYACEFLAQVFAIHVNKEVELDNQMVEKNILRTQTLLCDMLMRDAPLGIVSQSPNIMDLVKCDGAALLYKDKIWKLGTTPSEFHLQEIASWLCEYHMDSTGLSTDSLHDAGFPRALSLGDSVCGMAAVRISSKDMIFWFRSHTAGEVRWGGAKHDPDDRDDARRMHPRSSFKAFLEVVKTRSLPWKDYEMDAIHSLQLILRNAFKDSETTDVNTKVIYSKLNDLKIDGIQELEAVTSEMVRLIETATVPILAVDSDGLVNGWNTKIAELTGLSVDEAIGKHFLTLVEDSSVEIVKRMLENALEGTEEQNVQFEIKTHLSRADAGPISLVVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQKSCCRLKNQEAFVNLGIVLNNAVTSQDPEKVSFAFFTRGGKYVECLLCVSKKLDREGVVTGVFCFLQLASHELQQALHVQRLAERTAVKRLKALAYIKRQIRNPLSGIMFTRKMIEGTELGPEQRRILQTSALCQKQLSKILDDSDLESIIEGCLDLEMKEFTLNEVLTASTSQVMMKSNGKSVRITNETGEEVMSDTLYGDSIRLQQVLADFMLMAVNFTPSGGQLTVSASLRKDQLGRSVHLANLEIRLTHTGAGIPEFLLNQMFGTEEDVSEEGLSLMVSRKLVKLMNGDVQYLRQAGKSSFIITAELAAANK

SEQ ID NO: 6616 - protein, 424 aa, Dechloromonas aromatica
MAKPPRRKIRMKHVKKSAKLANVCYDIRGPVLQKAKQMEEEGHKIIKLNIGNLAAFGFDSPEEIQQDMIRNLPNAAGYTDSKGIFAARKAIMHYTQQKGIKGVTLEDIYVGNGVSELIVMAMNALLDAGDEVLVPAPDYPLWTAAISLSGGTPKHYLCDESKGWLPDLDDIRSKINAHTKAIVLINPNNPTGALYPDDLLYEIIDIARQHHLTIYADEVYDKVLYDDVKHTSIASLAEDVLMITFNGLSKNYRSCGYRAGWMVVSGDKRHAKDYIEGLDMLASMRLCANAPGQHGIQTALGGYQSINDLIKDGGRLRRQRDIAHELITAIPGVTCVKPKAALYMFPRLDPKIYPIKNDQQFISELLQEEKVLLVQGTGFNWPHPDHFRLVFLPHEDDLREAVARIARFLENYRKRHNTNQLIKD

SEQ ID NO: 6617 - protein, 491 aa, Gibberella zeae
MSLPADFKWGFATASYQIEGAIDKDGRGPANWDTFCAQAGKIADGSSGVTACDSYNRTAEDISLLKSLGSKAYRFSICWSRIIPLGGRNDPINQAGIDHYRKFVDDLLDAGITPFITLFHWDVPDELDRRYGGLMNREEFPLDYERYARVMFEAIPRCKNWITHNEPWCSAILGYSTGSNAPGRCSDRNKSDVGDSSTEPWIVGHNLLVAHGRAVKIYREEFKPKNGGEIGITLNGDATYPWDPKDPRDIEAAERKIEFAISWFADPIYFGDYPASMRAQLGDRLPTFTPEEKALVLGSNDFYGMNHYTANYVKHREGEAAPEDFVGNLELHFWNHRGDCIGEETQSTWLRPCAQGFRDLLVWISKRYGFPRMYVTENGTSIKGENDMPREKILQDDFRVQYYDDYVRAMADASRLDGVDIHGYFAWSLLDNFEWAEGYETRFGVTYVDYENDQKRYPKKSAQHLKPLFDSLIKKEENGLNGVGKVKAGQT

SEQ ID NO: 6618 - protein, 334 aa, Unknown
  Frankia sp. EAN1pec
MADIQRAAGISDLDTGDARPAPRRKTLSSPYLHRLQRRHFLLFDIIPILGTIAALGFLTVHPFGFTELGLLASMWLLTGLGVTVGYHRLFTHRTFRTTRGVSSVLAVLGSMAGQGGMVSWVALHRRHHECSDRAGDPHSPNLAGGGLRGRLRGLAHSHFLWMRRHEYPNIAHYAPDLLRDRALARIGRRYDHWVLLGLLIPTLVGGLVYWSWAGAVSGLLWGGLVRIFVLEHIIWSINSFLHMFGTRAFDSRENSRNGGVFGLLTLGESWHHNHHAFPESPSFGLAWHRLDPGYWLIRTLAACGLAWDLKVPSTERIAARRVPRTAGTAAGPAT

SEQ ID NO: 6619 - protein, 392 aa, Pseudomonas aeruginosa
MWFNGFLDLSPWQLVAVTLVLTHITIVSVTVYLHRYSAHRALDLHPALQHFFRFWLWLTTGMNTREWTAIHRKHHAKCETVEDPHSPVHKGLFTVLRAGAELYKAEAKNQDTLRIYGKNCPDDWIERNLYSRFPIGGVVLMALIDLALFGALGLTVWAVQMAWIPFWAAGVVNGLGHAVGYRNFECRDAATNLVPWGILIGGEELHNNHHTYPNSAKLSVKKWEFDLGWAWIKLFSFLRLARVARVAPIAHRVEGKHSLDMDTAMAILNNRFQIMAQYRKLVIAPLVKQEVAKADESVRHLFRRAKRLLSRETSLLQDRHHVRIDSMLAHSQALKVIYEKRLALQQIWAKTSANGHDMLAAIKDWVHEAEASGIQSLKEFAAQLKTYSLRPA

SEQ ID NO: 6620 - protein, 225 aa, Eruca sativa
GRGKIEIKRIENTTNRQVTFCKRRNGLLKKAYELSVLCDAEVALVVFSSRGRLYEYSNNSVKGTIERYKKAISDNTNTGTVAEINAQYYQQESAKLRQQIISIQNSNRQLMGETIGSMSPKELRNLEGRLDRSINRIRSKKNELLFAEIDYMHKREVDLHSDNQLLRTKIAENERNNPSMNLTPGGYEQIMQPSQTQSQPFDSRNYFQVAALQPNNHHYSSAGRQ

SEQ ID NO: 6621 - protein, 492 aa, Zea mays
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSM

SEQ ID NO: 6622 - protein, 229 aa, Guillenia flavescens
RGKIEIKRIDNTTNRQVTFRKRRNGLLKKAYELSVLCDAEVALIVFSSRGRLYEYSNNSVKGTIERYKKAISDNSNTGSVAEINAQYYQQESAKLRQQIVSIQNSNRQLMGETIGSMIPKDLKTLESKLDKSITRIRSKKNELLFAEIDYMQKRSLQEVDLHNDNQLLRAKIAENERNNPSMNLMPGGSNYEQIMPLPQTQSQPFDSRNYFQVAALQPNNHHYSSAGRH

SEQ ID NO: 6623 - protein, 470 aa, Staphylococcus aureus
MTKTLPEDFIFGGATAAYQAEGATNTDGKGRVAWDTYLEENYWYTAEPASDFYDRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYKGEIGVVHALPTKYPFDPSNPEDVRAAELEDIIHNKFILDATYLGKYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIIDGANVKGYFIWSLMDVFSWSNGYEKRYGLFYVDFETQERYPKKSAYWYKELAETKEIK

SEQ ID NO: 6624 - protein, 226 aa, Guillenia flavescens
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIVSIQNSNRQLMGETIGSMIPKDLKTLESKLDKSITRIRSKKNELLFAEIDYMQKREVDLHNDNQLLRAKIAENERNNPSMNLMPGGSNYEQIMPLPQTQSQPFDSRNYFQVAALQPNNHHYSSAGRH

SEQ ID NO: 6625 - protein, 1124 aa, Pisum sativum
MSTTRPSQSSNNSGRSRNSARIIAQTTVDAKLHATFEESGSSFDYSSSVRVSGSVDGDQQPRSNKVTTAYLNHIQRGKQIQPFGCLLALDEKTCKVVAYSENAPEMLTMVSHAVPSVGDHPALGIGTDIRTVFTAPSASALQKALGFAEVSLLNPILVHCKTSGKPFYAIIHRVTGSLIIDFEPVKPYEVPMTAAGALQSYKLAAKAITRLQSLASGSMERLCDTMVQEVFELTGYDRVMAYKFHEDDHGEVIAEIAKPGLEPYLGLHYPATDIPQAARFLFMKNKVRMIVDCNAKHVKVLQDEKLPFDLTLCGSTLRAPHSCHLQYMANMDSIASLVMAVVVNDSDEDGDSADAVLPQKKKRLWGLVVCHNTTPRFVPFPLRYACEFLAQVFAIHVNKEIELEYQILEKNILRTQTLLCDMLMRDAPLGIVSQSPNIMDLVKCDGAALFYRNKLWLLGATPTESQLREIALWMSEYHTDSTGLSTDSLSDAGFPGALSLSDTVCGMAAVRITSKDIVFWFRSHTAAEIRWGGAKHEPGDQDDGRKMHPRSSFKAFLEVVKARSVPWKDFEMDAIHSLQLILRNASKDTDIIDLNTKAINTRLNDLKIEGMQELEAVTSEMVRLIETATVPILAVDVDGTVNGWNIKIAELTGLPVGEAIGKHLLTLVEDSSTDIVKKMLNLALQGEEEKNVQFEIKTHGDQVESGPISLIVNACASKDLRENVVGVCFVAQDITAQKTVMDKFTRIEGDYKAIVQNPNQLIPPIFGTDEFGWCCEWNAAMIKLTGWKREEVMDKMLLGEVFGTQMSCCRLKNQEAFVNFGIVLNKAMTGLETEKVPFGFFSRKGKYVECLLSVSKKIDAEGLVTGVFCFLQLASPELQQALHIQRLSEQTALKRLKVLTYMKRQIRNPLAGIVFSSKMLEGTDLETEQKRIVNTSSQCQRQLSKILDDSDLDGIIDGYLDLEMAEFTLHEVLVTSLSQVMNRSNTKGIRIANDVAEHIARETLYGDSLRLQQVLADFLLISINSTPNGGQVVIAASLTKEQLGKSVHLVNLELSITHGGSGVPEAALNQMFGNNVLESEEGISLHISRKLLKLMNGDVRYLKEAGKSSFILSVELAAAHKLKG

SEQ ID NO: 6626 - protein, 593 aa, Unknown
  Mesorhizobium sp. BNC1
MQEGMGAIVHGNGVAFRVWAPHADAVSVVGTFNDWSDEAAPMTAEDGGFWYADLPSAKPGDEYRFLIRNGEKRLSRIDPYARAVTNSVGNGIIVEQQDDWHEAEFETPPWNELVIYEMHIGTFHRPQDNELGTFDDATERLAHLKRLGINAVQIMPAMEFAGDISWGYNPAHIFAIESSYGGPAAFKAFINAAHKQGIAVILDVVYNHFGPSDLDLWQFDGWSEDDKGGIYFYNDWRSDTPWGDTRPVYGRGEVRQFIRDNALFWLEEYHLDGLRFDMTLYIRNVRGDEGDEGDAIPEGWSLLQWVNSEIRERLPGRITIAEDLRNKAEITGAVDEGGAGFGAQWDSEFVHPIRETLIAPDDESRHMGTVAHALGHSYNGDPFQRVVYTESHDEVANGKARIPHEIAPGDPSHWAAQKRSTLGAALMLTAPGIPMLFQGQEFLQGEWFQDTVPLDWDQSEEFKGIVRLYRDLIRLRRNQMSVTSGLLGRNTRIFRVDEEKKLIAFHRWVEGGPRDDVVVVANFSHQAYASYRMGFPRQGLWNLRLNTDWSGYSPDFGSFESHDVVAEAVECDGLSWSGEVAIGPYTALVFSQD

SEQ ID NO: 6627 - protein, 712 aa, Methylobacillus flagellatus
MKNKTEKVKSQLAGSTAPDKKNTTAKTRDLESYKSDATGQPLRTNQGVKIADNKNSLRAGSRGPSLLEDFILREKITHFDHERIPERIVHARGVGAHGYFESYADHSSLTKAGFLGEKGKQTPVFVRFSTVQGPRGSADTVRDVRGFAIKFYTEEGNFDLVGNNIPVFFIQDAIKFPDFVHAVKPEPHNEIPTGASAHDTFWDFVSLQPESAHAVIWAMSDRAIPRSLRAMQGFGVHTFRLINAKGVAKFVKFIWTPKQGVLSLVWDEAQKIAGKDPDFHRRDLGESIELGNYPEWEFGVQIIDEQDEHSFDFDILDPTKIVPEELVPITPLGKLVLNRNPDNFFAETEQIAFCPGHIVPGLDFSNDPLLQGRLFSYTDTQLSRLGGPNFHEIPINKPVCPFHNNQRDALHRTTIHKGQAAYEPNSIDGGWPQETPPAAKDGGFESYYERIDAHKVRERSASFKDHFSQPRLFYKSLSATEQLHIAEAYSFELGKVKRQHIRERVVNEILSNIDLGLAGTVAQKLGIPAPKKPTIKVPEPSLKQSSALSQMKLTPQDLQGKKIAALVFDGLSAKAIRPLLDWAQQHSIALQLLGPTSAPVKTSEGKSLAVDGSIKGEPSILFDAAIVPDIPTDHTALLDNGQAVHFILETFKHLKPLALTGPGASLIKALHLEEDAGLLQAKDFSAVREQFERALLAHRVWEREKKAERIPA

SEQ ID NO: 6628 - protein, 302 aa, Haloarcula marismortui
MKRPQQSADMAPEQNGTTTVPTLGFGTYRTGGYKCYNAVKNALDCGYTHIDTAMAYENEAAVGRAIEQSSVDREDIFLTTKIKGYPEMVEYERLIEAAKGCLERLGTEYLDLLLVHWWNPLADMEETFNALNTLVDDGLVGQIGVSNFSIKELKQAMRLSDAPIATNQIEYHPYWGDEELVRFCQDNDVTVTAYSPLAEGRAVEDDVLRSIGDRYGKSAAQVSIRWLIQQENVVTIPKAATPKHIEANIDVFDFELTDRDMRRIRKLKPPFWYRENREGGSIYEARSVLGNFVPDSLYNRIA

SEQ ID NO: 6629 - protein, 326 aa, Candida albicans
MKLATEIDFKLNNGKTIPALGLGTVASKDPKDVKDQVITAVKAGYRHIDTAWFYGTEKYIGEALQELFAEGIIKREDLFITTKFWPSYWANPEKSLDESLKDLQLDYVDLFLQHWPICLHGDENGLPKIPKDENGELIYDDDPTPNGTKYIDVYHKLEDILETTTKVRSIGVSNYSIPKLRQLLPKVKKHIPVCNQIEYHPQLPQQDLVDYCTKNNILISCYSPVGSYGAPVLKIPLVKQLAEKYQVTENEIADAYNILNGRVTLPRSSNLERIKTIIRLPHLTKEELDELYQVGVKDPQRYICDPWGYGIGFRWWKGDTLSKEFD

SEQ ID NO: 6630 - protein, 189 aa, Unknown
  uncultured bacterium
MDIDFKKLAPWNWFKKEQEEQQSTASLPVQRNDLPVAGGPVSPILQLHREIDRLFDDAFRGFGFPTLAMPRWPSDWPGMLKPALDIQETDKQYKIALEVPGIEEKDIQITLDNDVLLVRGEKRQEQETKDGGFHRVERSYGSFQRALNLPADANQDTIKAAFKNGVLTITMDKREASTPKQGRSIPING

SEQ ID NO: 6631 - protein, 1171 aa, Oryza sativa
MASGSRATPTRSPSSARPAAPRHQHHHSQSSGGSTSRAGGGGGGGGGGGGGAAAAESVSKAVAQYTLDARLHAVFEQSGASGRSFDYTQSLRASPTPSSEQQIAAYLSRIQRGGHIQPFGCTLAVADDSSFRLLAYSENTADLLDLSPHHSVPSLDSSAVPPPVSLGADARLLFAPSSAVLLERAFAAREISLLNPLWIHSRVSSKPFYAILHRIDVGVVIDLEPARTEDPALSIAGAVQSQKLAVRAISRLQALPGGDVKLLCDTVVEYVRELTGYDRVMVYRFHEDEHGEVVAESRRNNLEPYIGLHYPATDIPQASRFLFRQNRVRMIADCHAAPVRVIQDPALTQPLCLVGSTLRSPHGCHAQYMANMGSIASLVMAVIISSGGDDDHNISRGSIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEVQIKDIIEWLTMCHGDSTGLSTDSLADAGYPGAAALGDAVSGMAVAYITPSDYLFWFRSHTAKEIKWGGAKHHPEDKDDGQRMHPRSSFKAFLEVVKSRSLPWENAEMDAIHSLQLILRDSFRDSAEGTSNSKAIVNGQVQLGELELRGIDELSSVAREMVRLIETATVPIFAVDTDGCINGWNAKVAELTGLSVEEAMGKSLVNDLIFKESEETVNKLLSRALRGDEDKNVEIKLKTFGPEQSKGPIFVIVNACSSRDYTKNIVGVCFVGQDVTGQKVVMDKFINIQGDYKAIVHNPNPLIPPIFASDENTCCSEWNTAMEKLTGWSRGEVVGKLLVGEVFGNCCRLKGPDALTKFMIVLHNAIGGQDCEKFPFSFFDKNGKYVQALLTANTRSRMDGEAIGAFCFLQIASPELQQAFEIQRHHEKKCYARMKELAYIYQEIKNPLNGIRFTNSLLEMTDLKDDQRQFLETSTACEKQMSKIVKDASLQSIEDGSLVLEKGEFSLGSVMNAVVSQVMIQLRERDLQLIRDIPDEIKEASAYGDQYRIQQVLCDFLLSMVRFAPAENGWVEIQVRPNIKQNSDGTDTMLFLFRFACPGEGLPPEIVQDMFSNSRWTTQEGIGLSICRKILKLMGGEVQYIRESERSFFHIVLELPQPQQAASRGTS

SEQ ID NO: 6632 - protein, 365 aa, Shigella flexneri
MSSEKLYSPLKVGAITAANRIFMAPLTRLRSIEPGDIPTPLMAEYYRQRASAGLIISEATQISAQAKGYAGAPGIHSPEQIAAWKKITAGVHAENGHMALQLWHTGRISHASLQPGGQAPVAPSALSAGTRTSLRDENGQAIRVETSMPRALELEEIPGIVNDFRQAIANAREAAFDLVELHSAHGYLLHQFLSPSSNHRTDQYGGSVENRARLVLEVVDAGIEEWGADRIGIRVSPIGTFQNTDNGPNEEADALYLIEQLGKRGIAYLHMSEPDWAGGEPYTDAFREKVRARFHGPIIGAGAYTVEKAETLIGKGLIDAVAFGRDWIANPDLVARLQLKAELNPQRAESFYGGGAEGYTDYPTL

SEQ ID NO: 6633 - protein, 672 aa, Escherichia coli
MSYPSLFAPLDLGFTTLKNRVLMGSMHTGLEEYPDGAERLAAFYAERARHGVALIVSGGIAPDLTGVGMEGGAMLNDASQIPHHRTITEAVHQEGGKIALQILHTGRYSYQPHLVAPSALQAPINRFVPHELSHEEILQLIDNFARCAQLAREAGYDGVEVMGSEGYLINEFLTLRTNQRSDQWGGDYRNRMRFAVEVVRAVRERVGNDFIIIYRLSMLDLVEDGGTFAETVELAQAIEAAGATIINTGIGWHEARIPTIATPVPRGAFSWVTRKLKGHVSLPLVTTNRINDPQVADDILSRGDADMVSMARPFLADAELLSKAQSGRADEINTCIGCNQACLDQIFVGKVTSCLVNPRACHETKMPILPAVQKKNLAVVGAGPAGLAFAINAAARGHQVTLFDAHSEIGGQFNIAKQIPGKEEFYETLRYYRRMIEVTGVTLKLNHTVTADQLQAFDETILASGIVPRTPPIDGIDHPKVLSYLDVLRDKAPVGNKVAIIGCGGIGFDTAMYLSQPGESTSQNIAGFCNEWGIDSSLQQAGGLSPQGMQIPRSPRQIVMLQRKASKPGQGLGKTTGWIHRTTLLSRGVKMIPGVSYQKIDDDGLHVVINGETQVLAVDNVVICAGQEPNRALAQPLIDSGKTVHLIGGCDVAMELDARRAIAQGTRLALEI

SEQ ID NO: 6634 - protein, 649 aa, Chlamydia muridarum
MKRLARFCLLALTLFPQLAFSSAPLRQQDVRKTVEKLVEHHIDTKHISPHILSRSLEDYARSFDSHKAYLTQDEVLTYVFSEKATHSLFKQYQEDNFASFRELHTCIQQSISRVREWRTVWLSDAVRVIQDASSHTIPKKPTTWGSSIEEVKQRQYELLLSYASIYLEDATKNRYQGKEHALVRLCIRQIENHENPYIGINDHGLKMSLEEEANSFHIRIIKSIAHSLDAHTAYFSKEEALSMRAQLEKGMCGIGVVLKEDIDGVVVKEVLPGGPADKTGSLRVGDIIYRVNGKNIENTPFPGVLDSLRGLPGSSVTLDIHRQNNDHVVQLRREKILLDSRRVDVSYEPYGDGIIGKITLHSFYEGENQISSEQDLRRAIRELQEKNLLGLVLDIRENTGGFLSQAIKVSGLFLTNGVVVVSRYADGSVKRYRTISPQKFYDGPLAVLVSKSSASAAEIVAQTLQDYGVALIVGDKQTYGKGTIQHQTITGNNSQEDFFKVTVGRYYSPSGKSTQLEGVKSDIVIPSRYAEDNLGERFLEYALPADQYENVLNDNLGDLDIHIRPWFQKYYSPHLQKTELTWREMLPQLVENSQQRLEKNKNFEIFVQHLKKTDKQEQSFGSNDLQMEETVNIVKDMILLQTSLRSPAQ

SEQ ID NO: 6635 - protein, 764 aa, Unknown
  Silicibacter sp. TM1040
MRIACLGGGPAGLYFGISMKLRDPSHEVTVIERNRADDTFGWGVVLSDETLDNLAANDAKSAESIRSHFAYWDDVALLFKGTRQVSSGHGFCGIGRKKLLILLQERARELGVKMQFETEVQSAEDYRKDYDLVVASDGLNSRTRSLYADTFKPDVDTRLCNFVWLGTHQTFKDAFTFIFEETEHGWVWAHAYQFDDDTATFIVECTQETFDAFGFGSMSQQESIKTCEEIFKDHLGGHALMTNANHIRGSAWIRFPRVLCEKWSHENVVLMGDAAATAHFSIGSGSKLALESAIALADLLHEKPDLQSAFDEYEDQRRLEVLRLQSAARNSMEWFERVERYLDLDPVQLNYSMLTRSQRISHENLRERDKDWLESAERWFMDQAGAPKDAPLRAPMFAPFRLREMDLKSRIVVSPMAQYKAKDGSPTDWHLVHYGERAKGGAGLVYTEMTCVSPEGRITPGCPGLYAPEHEAAWSRITDFVHAETDAKICCQIGHSGRKGSTQLGWDEMDAPLPEGNWDIVSASAIPWSGQNATPREITRAEMDEVRDQFVRAAQMADRAGFDMIELHAAHGYLISSFLSPVSNQRGDDYGGSLENRLRYPLEVFAAMRAVWPEGKPMSVRISANDWVGEDGVTPDEAVQIARAFWEAGADLIDVSAGQTTTEAKPVYGRMFQTPFSDQIRNEAGICTMAVGNIFEADHANSILMAGRADLVAVGRPHLSDPYWTLHEGSKIGDRAAPDWPLPYLAGRDQSWRLADKEAETLRA

SEQ ID NO: 6636 - protein, 783 aa, Oryza sativa
IRLEKVKTNFSVPATARKNKTMVTVVEEVDHLPIYDLDPKLEEFKDHFNYRIKRYLDQKCLIEKHEGGLEEFSKGYLKFGINTVDGATIYREWAPAAQEAQLIGEFNNWNGAKHKMEKDKFGIWSIKISHVNGKPAIPHNSKVKFRFRHGGGAWVDRIPAWIRYATFDASKFGAPYDGVHWDPPACERYVFKHPRPPKPDAPRIYEAHVGMSGEEPEVSTYREFADNVLPRIRANNYNTVQLMAIMEHSYYASFGYHVTNFFAVSSRSGTPEDLKYLVDKAHSLGLRVLMDVVHSHASNNVTDGLNGYDVGQNTHESYFHTGDRGYHKLWDSRLFNYANWEVLRFLLSNLRYWMDEFMFDGFRFDGVTSMLYHHHGINKGFTGNYKEYFSLDTDVDAIVYMMLANHLMHKLLPEATIVAEDVSGMPVLCRPVDEGGVGFDFRLAMAIPDRWIDYLKNKEDRKWSMSEIVQTLTNRRYTEKCIAYAESHDQSIVGDKTIAFLLMDKEMYTGMSDLQPASPTINRGIALQKMIHFITMALGGDGYLNFMGNEFGHPEWIDFPREGNNWSYDKCRRQWSLVDTDHLRYKVVPKYINYMNAFDQAMNALEEEFSFLSSSKQIVSDMNEKDKVIVFERGDLVFVFNFHPNKTYKGYKVGCDLPGKYRVALDSDALVFGGHGRVGHDVDHFTSPEGMPGVPETNFNNRPNSFKVLSPPRTCVAYYRVDEDREELRRGGAVASGKIVTEYIDVEATSGETISGGWKGSEKDDCGKKGMKFVFRSSDEDCK

SEQ ID NO: 6637 - protein, 464 aa, Listeria innocua
MLYSKENKESYLEPVFGSSAEDRDIPKYTLAKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAQKPNLVISSGYQVCWEKFCVYWDIDMRVVPMDKDHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIYNDGSHLPIVCYKLKDDANVKWTLYDLADRLQMRGWQVPAYPLPKNLENIIIQRYVCRADLGFNMAEEFIQDFQASIQELNNAHILFHDTQQSGVHGFTH

SEQ ID NO: 6638 - protein, 274 aa, Triticum aestivum
  misc_feature (220)..(220): Xaa can be any naturally occurring amino acid
  misc_feature (248)..(248): Xaa can be any naturally occurring amino acid
  misc_feature (264)..(264): Xaa can be any naturally occurring amino acid
NKFVQKSRLVPVRNSRDIVDPRVRGFGVNTYTLISRDGKAHLVKFHWKPTCGVKCLLDDEAVTVGGTCHTHATKDLTDSIAAGNYPEWKLFIQTIDADHEDKFDFDPLDVTKTWPEDIIPLQPVGRMVLNKNIDNFFAENEQLAFCPAITVPGIHYSDDKLLQTRIFSYADTQRHRLGPNYLMLPVNAPKCAHHNNHHDGLMNFMHRDEEVNYFPSRFDXTRHAEQYPIPPRVLSGCRGECIIEKETXFSAAGEKYRSFDPGRXDRFLKRWFDA

SEQ ID NO: 6639 - protein, 273 aa, Gloeobacter violaceus
MTAQSPATQATPISWVFVGFMAFIHLGALAALWQFSWSALALAIFLHWALGCLGITLGFHRLLSHRSFTVPKPLEYFLALLGTLCLQGGPVLWVAHHRLHHAHSDTEADPHDSNRGFWWSHWGWMFYMPEERLNFDHYSRYAKDLARDPVHRFLNRNMIPLQLAFAALLYLLGGWPFVLWGIFVRLVVVFHCTWLINSACHQWGYRSHQTDDHSTNLWWAAILAYGEGWHNNHHAMPRSARHGLAWWEIDVTWSVIWILSKLGLARNVQLPTS

SEQ ID NO: 6640 - protein, 243 aa, Glycine max
MEDPNQAPEGSSQKKMGRGKIEIKRIENTTNRQVTFCKRRNGLLKKAYELSVLCDAEVALVVFSTRGRLYEYANNSVRATIERYKKANAAASNAESVSEANTQFYQQESSKLRRQIRDIQNLNRHILGEALGSLSLKELKNLEGRLEKGLSRVRSRKHETLFADVEFMQKREIELQNHNNYLRAKIAEHERAQQQQSNMNMSGTLCESLPSQSYDRNFFPVNLIASDDQQQYSRQDHTALQLV

SEQ ID NO: 6641 - protein, 50 aa, Triticum turgidum
MTVEKLLEYGHMLVQEQDNVKRVQLADTYMSQAALGDANQDAMKTGSFYG

SEQ ID NO: 6642 - protein, 594 aa, Cytophaga hutchinsonii
MNQAILYRGPDHSDFVSFQFKQQQIFIGNNRLKIIDRNTLSNQPYNSIDKRYSLTFNGAIYNYKELKQQLPAMEWQTESDTEVLLNWMIVHGLSGLPELNGMFAFAFYDRQQHALIIARDPSGIKPLYYYNDDDYFIASSEIKGILASGLVKKEFNSNQVSHYLQFKYVPKPFTFYKNIFELNEATFIKIDEYDFKIKRFESPSVIKPNTLTNQQLIETCDQLIENAVKHHLVADVPVGLYLSGGIDSTLLLSKIRKLGHLNFPTFTIANSSREQAFGTRDFEFARLASKLYNSDHHEVSVHAEMLQDLPAFVSMIDQPIGDSALFLTHILSKEAGQHVRVALNGAGADELFAGYNRHSAYKSYLNNLLHKNLAITLIKSTYNILPDGGNHSLKKVFRLWNKFTGMMDVDPIKTCHNFSSSEYFIEKNTSIEVDDKSYEDLSYYLYYCLRNDRTKYLISDILALTDKMTMRSSIEARVPYLDQELRRFVESLDPSVLLKNGRKWILKEVLLRNGGETFLNRPKEGFGMPFGYWLKLPVNKNFVEKLTNKNHPIYEWVPYQTIKNLVDWHLGSKRDCSSELWSVLLLMHWYEKEF

SEQ ID NO: 6643 - protein, 2310 aa, Schizosaccharomyces pombe
MSLYKSLDVAIDYAISQLGEFQFQPIRTQSNPSSLLSACLVRAVHVETRRKVIFKFSQQTFKLENEYFLLRQLSSHPNGRNYAIAPAYILLLNETLGALIYDDPGPNILDEWLGNPNPLDLKLFLKFALGVSYVLCFLHEKKIVHGEIRLDTFHYDLNAPIHAKLLTIGSSVSPIRFTLSSLNWKRLYQVQNICHKLQFFSPEQIGNVGRPLDSRSDIYSLGILFYVILTKQYPWGGQSMRIVQSIHMRQFPSVLPRRPDAFPALDQLIQKMTAKSMNSRISSATDLCYTIVELMQEFSTITSSPLLDQKLLSINKPQQEKLKFPKLLLTNSSDYVRIFHELVAFSSKRDLLTSAKRVDKLPKQHLFKYRPVDNEATYCQVVTVTGEKGSGKSNLLNAVADEARKFGYFAMSSFKGHHFSPYSAIFKCVSLIMQQTLREEKQLVTDYFTSLWEFLGFQLIYMGELFEYVPELNSLLSPKYNLHCKRENYFKLKKRDPQQFRSASGRLGFMVCLLEILSFTSRVRPVIIILDELHLADHPSLSLIIGMISHRLPILLILAWDEPVMFKDFSKCLHEAPYAMVTDIRMNLFDRKNITEFLDSTLESPTQALGPLVLLMQKLSKGNPLVLKSLLLIAFANNGFAFHPKSSSWTYDLPVINRSFEALSSYDIPPLLASLLDALLPARCIEFLLWAALLVEPFPFELLRLITTSMHLFIPKEEILDFPLNVLQFDNDNESCQFSETFFREGILSKISLRRAESMHAQIAKELITGTAKEFYDIRTVHHILKGLGVIKKFDNTKPYILALKESADALMQFGSYEYATELLKSCLFLLPRNFWNSKLYTRKDLISIHISLAMCYWWSKDHENAIKVLKNPKLSSSNVYDYLPAFRLLTKIEYYKYQSLRSIDKAQELLSNLGLKLKEPTDDVLREFYDRLSTKFLECDFLVKQSEPLDRKRIDAISVILSECGFVLFNFSQPYYYYFSFLLAEMYLRYGNPSLRYSVMFLASYCFVTRRKPEFLLRISQVDSDLFVIKDRSAVAHAELIYWGLKRELCSTETGSAVTLESILLQCVMFGDKIYGAYCLACLMAQRVFRGDHIHQLLLDQENSETLLLLWDCEPPFTYYLMLIRNSLLALFGLTNNDDPNNILTTKQRTQKDLHDKLTSKKVPCTFCCWYYAGIIFLNTLFHHYEYVMSIAQEVRKLVDGKLYERYYLITRSFIGVAALQLLFYKKNISEFEREKVEDVAHWAQSSLSEMAKCFHAELYKLWVCLLEGLRQRNLGNYMEALRLFEKVTSMGASVFSPIEFPFVLELIGEFYYGRGHKFLAKSYITRALSCLKNIGCYGVENKLRSRYSDLISDVESRGTTVVSIATTTGDYAEKLKLLRNQDINDFSLGLASYSDIFDKPLVTLPVKKSSAVDESENDFYDRNDEESFDIVSLVSVIKCGQLLSSKLRLGPLLTTVIKLVIEYSQAKHAAIILKDASNYTLAAHGNVEKAESFEPPVILSQSDVKIPDSLLSEVFDHCRIVSLYTVSASQDAELLRWLQEEHDMDFFAIIPLQFKESVIGALYLCLSRRAIRTGNVTFLKLLSQQIAISVSNALLFQSLRRTITDNVTLIELQRLSYQRYKAIEEKCITLLDSLPCIVWTLDSDIGEIEYTNASKRNYFGVPEDCHDSLSWKTFIHPDHHHQFQEKLLNLKTLELGDIELLLRMEDGNYHWHLCRGLSFKEDANAKKWIVVCIDINDEKEAREAAMHAVNLKTNFLANMSHELRTPFSSFYGMLSLLSDTKLNEEQYDIVSTAKQSCTSLVQIIDDLLNFSELKSGKMKLEPDKVFDVEENIADCIELVYPSLSSKPVQISYDIYPNVPALLAGDSAKLRQVITNLLGNSVKFTTEGHILLRCMAIDEEINAEENQCKLRFEIEDTGIGLKEEQLKLLFNPFTQVDGSTTRIYGGSGLGLSICLQICKIMDGDIGVQSVYGEGSTFWFHVQLRNVTSKLSQKHFEESHERFANIRQSLKNAKILVVKSFTTSRSIFRSLFSLAVVDTTTIYSDIEQQLIDSLDKRQPYDFLCIEAASGQTEQIITQILSNQKLNKVLLIVLLPSIQRTKVRSDGDPFITSLNKNQSRIFCFREPIRISKLLQNFPALLSKWSTPTKLVEPSQFRASPRKVDQAVVLSSEEKEILQKKYALIAEDNLIARKLLTKQLSNLGFQVHAAVDGVELVKMYEAKQFGFYSVIFADYHMPIRDGAEAVMDIRAYERENNCSTPIPVIALTADIQKSAKQRCLEVGMNFYLTKPFTQKQLVNAVREFVLLEKSAR

SEQ ID NO: 6644 - protein, 736 aa, Podospora anserina
MASYLPSMEKVQHAVLGPRGGDKVADLQKETKEMSDKARLTTDYGVKQTSADDWLKIVNNDKTGPMLLEDPFARERIHRFDHERIPERVVHARGSGAFGKFKLFESAEDVTFAPILTDTSRETPIFIRFSTVLGSRGSADTVRDVRGFAIKFYTQEGNWDIVANNIPVFFIQDAIKFPDVIHAGKPEPHNEVPQAQTAHNNFWDFQYNHTEATHMFMWAMSDRGIPRSYRMMQGFGVNTFTLINAKGERHFVKFIFTPELGVHSLIWDEALKLAGQDPDFHRKDLWEAIENGVFPKWKFGIQVIPEADEHKFDFDILDATKIWPEDLVPVRYIGEFELNRNPDEFFPQTEQVAFCTSHIVPGIGFSDDPLLQGRNFSYFDTQLSRLGINWQELPINRPVCPVMNFNRDGAMRHTITKGTVNYWPNRFEKVKPATHEEGGYVEYAEKVAGIKARARSAKFKEHFAQAQLFWNSMSAVEKNHIINALGFELDHCEDPVVYERMVTRLADIDLGLAQTVAEMVGGEPPKEASRPNHGRKAPGLSQTEFPGSKPTIASRRIAILVADGYDQVAYSAAYAAISAGLAIPLVIGTKRSKIVAAGGAGSTTPHHHLEGFRSTMVDAIFIPGGVDSIRALSKNGRALHWIREAFGHLKAIGATGEAVDLVNKAIGLPAVSVSESAEVQDSYGVVTMRETKPGSLSEAVDIVKAGAGFMEKFFHNIAQHRCWARELDGLHSQVAY

SEQ ID NO: 6645 - protein, 744 aa, Nocardia farcinica
MSGPEDPADRRHGEVPAPRRDIPRPLVERRDLMLLAAGTHRDPHTVLGAHPHPDGTVVRVLRPHAAKVSVRVGGVDHPLDSVGYGVFAAVLPHPELMDYRIVTEYPGGPTVIAADGFRFLPTLGELDLHLIGEGRHEHLWHVLGAHPRRYTTLDGPVSGTSFAVWAPNARGVTVIGDFDGWSGNTAPMRALGTSGVWEVFVPDVGSGTKYKYRVHGADGRVVDHADPLAFATELPPATASVVTGSDYTWQDAQWLERRRSTDPTRSPMSVYEVHLGSWRPGLGYRELAEQLADYVRAAGYTHVELLPVAEHPFGGSWGYQVTSYYAPTARFGSPDDFRAFVDHLHGAGIGVLLDWVPAHFPRDEWALARFDGTPLYEHPDPRRGEQLDWGTYVFDFGRNEVRNFLVANARFWIEEFHIDGLRVDAVASMLYLDYSRGENWEPNIHGGRENLEAVAFLRELNDVVHRAHPGVVTIAEESTTWPGVTRGTEVGGLGFTMKWNMGWMHDTLGFLARDPIHRSWHHNEITFSLVYAWSENYVLPISHDEVVHGKGTLWTRMPGDDFAKAAGVRALLAYMWAHPGKQLLFMGQDFGQFREWSHDRGLDWGELDNPLHRGIATAVRDLNRVYRATPALWSQDTTPGGYAWIEADDRDRNVLAFLRYGSDGSTVACVFNFSGALHGEYRVGLPIAGEWTEILNTDAADYGGSGVGNYGVVRTEEIPWHGRPVSATVALAPNSAVWLAAPRA

SEQ ID NO: 6646 - protein, 218 aa, Eustoma grandiflorum
MGRGKIDIKRIENNTNRQVTFCKRRNGLLKKAYELSVLCDAEVALIIFSSRGRVYEYANNNIKSTIDRYRKATSDASTVFTTQEINAQFYQQESKKLRQQIQVLQNSNRHLMGEGLSSLNVKELKQLESRLERGISRTRSKKHEMILAEVEYLQKREIQLEQENACIRSKIAEQERLQELSMMPPGQDYNAMQAYLAQNFMQVNGLMEGPPVYSMLHK

SEQ ID NO: 6647 - protein, 315 aa, Glycine max
MNDMKVRSGLCVWPNVRQLCFRKGILYGFMRLFSTPLKTLRGASRSLRVAQFCSVANMSSSLQIELVPCLKDNYAYLLHDVDTGTVGVVDPSEAVPVIDALSRKNRNLTYILNTHHHHDHTGGNVELKARYGAKVIGSGTDKKRIPGIDIHLNDGDKWMFAGHEVRVMDTPGHTQGHISFYFPGSGAIFTGDTLFSLSCGKLFEGTPQQMLSSLKKIMSLPDNTNIYCGHEYTLNNTKFALSIEPENEELQSYAAQVAYLRSKGLPTIPTTLKMEKACNPFLRTSSAAIRQSLNIAATANDAEALGGIRQAKDNF

SEQ ID NO: 6648 - protein, 406 aa, Oryza sativa; identical to SEQ ID NO: 115

SEQ ID NO: 6649 - protein, 428 aa, Bacillus cereus
MEVYTMKFPHDFLFGAASASYQVEGAWNEDGKGVTNWDEFSKIPGKTYNGTNGDVAVDHYHRYKEDVRLMAEMGLESYRFSISWARILPTGDGKVNEKGIEFYNNLIDECLKYGIVPFVTLYHWDLPLPLEKDGGWTNKRTAEAFVKYAETCFKAFGDRVKHWITFNETVMFCGLGYLKGAHPPGIQNDVPKYFQATHYVFYAHAKTVAVYKQLKQYGEIGITHVFLPAYSVDDQKENIQAANHANEYETYWYYDPILKGEYPSYVVQQLKEKGWTPNWTVEELEIIKQNAEENDFIGLNYYQPIRVERYDMDIKSEEHSRENSTLAPGNPSFDGFYRTVKMDDKTYTKWGWEISPEGFLEGLHMLKARYGDIKMYVTENGLGDEDPIIDGEIVDVPRIKFIEAHLKVMKRAIEEGINLKRLLCMVSD

SEQ ID NO: 6650 - protein, 394 aa, Pisum sativum
MEGGGGAPAADAVMEDAAPQQQEPQQQAAMGIENIPATLSHGGRFIQYNIFGNIFEVTAKYRPPIMPIGKGAYGIVCSAHNSETNEHVAVKKIANAFDNKIDAKRTLREIKLVRHMDHENVVAIRDIVPPPQREVFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEADLGFLNENAKRYIRQLPLYRRQSFQEKFPHVHPEAIDLVEKMLTFDPRQRITVENALAHPYLTSLHDISDEPVCTTPFSFDFEQHALTEEQMKELIYREALAFNPEYQQ

SEQ ID NO: 6651 - protein, 369 aa, Candida albicans
MENNNTIPALFQPIKISDSITLPNRIGVSPMCMYSSSPTDNQATSFHFVHYGSFAVRGPALIILESIFVSENSGLSIHDLGLWNDDQAHSLRKIVDFIHDQDGICCIQLNHAGRKIVEGVPFQQIQHGWQEHCVGPSTEPFSDSHNTPRELTVNEINSIVEDFANAAWRAVEISKFDAIEIHCANGCLIHQFLSKLTNKRADQYGGSFENRVRFLLQIIENIKRKIETPIFLKFPMSDNCSDPEAWSTEDALKLADLVIDLGVKVIDVTSGGNVAHCKSRYLLNDDKQLPSQVPLARKLKSHIRNRCLIACSGGLDRDIFKLDEFIANGDFDIALIGKGFLKNTGLISRIADQLQAQFRTAPQYKLALS

SEQ ID NO: 6652 - protein, 365 aa, Bordetella bronchiseptica
MTMASIFSPYELGELILPNRVVMAPMTRARTLDTVPAQSMALYYAQRASAGLIVTESAQVSAQGRGYLCTPGIHTPEQVAAWRNVTDAVHRAGGRIFIQLWHVGRLSHTSLLPDGGSPVGPVSVAAAHTLVQAYGHDGRPAQVPASPPAALDIAGIRRIVADFRAAAENAARAGFDGVEIHAGNGFLFEQFINAGLNTREDQYGGPSIANRLRLLLETVDAVSAVIGRQRVGVRISPFAHAGDLHEFDSEKASWLGLAGALCQRRIAYLHASHLGQAGFQRDMRKAFGGTFMLAGGFTAQTAQAALDAGEADLVVFGRPFIANPDLVERMRHGWPLAEAGKHAFYGGDDRGYTDYPRYAAAQPAA

SEQ ID NO: 6653 - protein, 143 aa, Brassica napus
MADTPSSPAGDGGESGGGSVREQDRYLPIANISRIMKKALPPNGKIGKDAKDTVQECVSEFISFITSEASDKCQKEKRKTVNGEDLLWAMATLGFEDYLEPLKVYLARYRELEGDNKGSGKSGDGSNRDAAAGGVPNEDMPSW

SEQ ID NO: 6654 - protein, 327 aa, Saccharomyces cerevisiae
MSSLVTLNNGLKMPLVGLGCWKIDKKVCANQIYEAIKLGYRLFDGACDYGNEKEVGEGIRKAISEGLVSRKDIFVVSKLWNNFHHPDHVKLALKKTLSDMGLDYLDLYYIHFPIAFKYVPFEEKYPPGFYTGADDEKKGHITEAHVPIIDTYRALEECVDEGLIKSIGVSNFQGSLIQDLLRGCRIKPVALQIEHHPYLTQEHLVEFCKLHDIQVVAYSSFGPQSFIEMDLQLAKTTPTLFENDVIKKVSQNHPGSTTSQVLLRWATQRGIAVIPKSSKKERLLGNLEIEKKFTLTEQELKDISALNANIRFNDPWTWLDGKFPTFA

SEQ ID NO: 6655 - protein, 462 aa, Zea mays
MVSDGARGLLGAYELGRTLGEGNFGKVKQARHRGSGGQFAVKIMERARVLSQRADEQICREIATLKLLAHPNVVRLHEVAASKTKIYMVLELVNGGELLDRIAASEGKLPEQEARRLFQQLVDGVSYCHEKGVCHRDLKLENVLVDRKGNIKISDFGLSALPQHLGNDGLLHTTCGSPNYIAPEVLQNRGYDGSLSDIWSCGVILYVMLVGHLPFDDRNIVVLYQKIFKGDAQIPEWLSPGARNLLRRILEPDPAERIAMAEIKAHPWFQEHYVPVLPPYDDDDDHDSVKQIGAGSKTTHHINAFQLIGMASSLDLSGFFEEEDVSQRKIRFTSAQPPEDLFAEIERSATDMGFHVHRGHSKLRLTRNCDRSKNQKNPMSSSSSSFLVCTEVFELSPSLYVVELNKSHGDPALYRQLCQRICGDLGVLEMDQIFGTRPPVADDLAGLALALERRSATPLVAL

SEQ ID NO: 6656 - protein, 481 aa, Oryza sativa
MPSHQPVAGMSAVDPAYLSSQPSAASKPHPQEPVRNKAYDPKKPHITETPMTKKNWYKHVNWLNVILIVGIPMCGLVAAYWTPLYLKTAIWAVAFYFATGLGITAGYHRLWAHTSYSASLPLKIFLAAVGGGAVEGSIRWWARDHRAHHRYTDTDKDPYSVRKGLLYSHFGWMLMKQNPKRIGRTDISDLNDDAVVVWQHKNYLKVVLFMGLIFPTLVAGLGWGDWLGGFVYAGILRIFFVQQATFCVNSLAHWLGDQPFDDRNSPRDHVITALVTLGEGYHNFHHEFPSDYRNAIEWHQYDPTKWSIWMWKQMGLAYDLKQFRSNEIEKGRLQQQQKKLDQKRSKLDWGVPLEQLPVMEWDDYVDQAKNGRGLIAVAGVVHDVTDFINDHPGGKAMIKSGIGKDATAMFNGGVYYHSNAAHNLLSTMRVGVIRGGMEVEIWKRAHGENKDFIKDAAGNRIVRAGAQVTKVVEPPASAGTA

SEQ ID NO: 6657 - protein, 513 aa, Arabidopsis thaliana
MGNSFGCSASGERLVSAARDGDFVEAKMLLDCNPCLAKYSTFGGLNSPLHFAAAKGHNEIVGLLLENGADVNSRNYCGQTALMQACRYGHWEVVQTLLLFRCNVTRADYLAGRTALHFAAVNGHARCIRLVLADFLPSDKLNSLPETGVVTAKNKSEQSALSKFVNKAADGGITALHMAALNGLFDCVQLLLDLEANVSAVTFHYGTSMDMIGAGSTPLHYAACGGNLKCCQILLARGARKMTLNCNGWLPIDIARMWSRHWLEPLLSPNSDVVIPAFPHSNYLSLPLLSILNIAREFGLQSATIGDEVDICAVCLERTCTVAAEGCEHQLCVRCALYLCSSSNVPSVTVGPPGSIPCPLCRHGITAFKRLPSSLTREMKLPMSLGFCAPCMLHTGDTTDQSSPTCPPTEQRSSKTRAASVSSDIFCPVTCSPFPSVNIPMCTCNEGTCPNFETHGTERHSEEHVESSPSRTTTEQEKIEEGQRLGKTTTCSSMFWGRRSCSRENQCNSEINA

SEQ ID NO: 6658 - protein, 244 aa, Vitis vinifera
MGRGRVELKRIENKINRQVTFAKRRNGLLKKAYELSVLCDAEVALIIFSTRGKLYEFCSSSSMLKTLERYQKCSYGAVEVSRPSKELEQSSYREYLKLKSKFEALQRTQRNLLGEDLGPLNTKELEQLERQLETSLKQVRSTKTQFMLDQLSDLQNKEQVLVESNKALTRKLDEISVKNHLQLSWESGEQSMPYGHQQAQSQGFFQPLECNPTLQIGYNPAGSSQLSAPSNAQNVNGFIPGWML

SEQ ID NO: 6659 - protein, 726 aa, Podospora anserina
MKRLLTWATLVGSMSAVTKAACPFADPNYHLAKRDEGASQQTENILEEYEVDDSNAYMSSDVGGPMEDQNSLKAGYRGSTLMEDWIFRQKIQHFDHERIPERAVHARGAGAHGTFTSYADWSNITAASFLGGAGKKTPVFVRFSTVAGSRGSADTARDVHGFATRFYTDEGNFDIVGNNIPVFFIQDAIRFPDLIHSVKPSPDNEVPQAATAHDSAWDFFSQQPSTMHTLFWAMSGNGIPRSYRHMDGFGVHTFRFVTDDGNSKLIKWHFKTKQGKASLVWEEAQVLAGKNADFHRQDLWDAIESGNGPEWELSVQIVDEEKALAFGFDLLDPTKIIPEELAPLVPLGIMKLDRNPTNYFAETEQVMYQPGHIVRGVDFTEDPLLQGRLFSYLDTQLNRNQGGPNFEQIPINRPVSPVHNNNRDGAGQMLIHKNVYPYTPNTLNGGYPLQANQTHGKGFFTAPNRIVDGKLVRALSPTFDDHWSQPRLFYNSLTRVEQQFLINAIRFEASHLKNEQVKKNVLEQINRVSNDVAKRVAVALGLEAPAPDPAFYHNNVTAGLSIFNGTLPTIATLRVGVLASSFNDGSLAQARELKEQLSKEGVVVTVVGEVLKEGVDQTYSAADATGYDAVVVTDGAEGLLTGGKNSPLFPAGRPGQILVDSYRWGKPVAAVGENSGQALEQTVGVSRGQDEGVVVGEGVEQVVKGVEEGLRVFRYLGRFPVDEGAE

SEQ ID NO: 6660 - protein, 232 aa, Lilium longiflorum
MGRGKIEIKRIENTTNRQVTFCKRRNGLLKKAYELSVLCDAEVALIVFSSRGRVYEYSNNSIKQTIDRYKKACDSSNSNSLIQVNSQQYFQQESAKLRHQIQILTNANRHLVGEALSSLTVKELKQLENRLERGLTRIRSKKHELLFAEIEFSQKREVELQSDNMYLRAKIAENERTQAAIVQARAEFDALPTFDSRNFYQVNNMLEAPPHYHHQDQTALHLGYEAKDDSVP

SEQ ID NO: 6661 - protein, 242 aa, Vitis vinifera
MGRGRVELKRIENKINRQVTFAKRRNGLLKKAYELSVLCDAEVALIIFSNRGKLYEFCSSSSMLKTLERYQKCNYGAPETNVSTREALELSSQQEYLKLKARYEALQLSQRNLLGEDLGPLSTKELESLERQLDVSLKQIRSTRTQYMLDQLTDLQRKEHMLNEANKTLKQRLLEGTQVNQLQWNPNAQDVGYGRQQAQPQGDGFFHPLECEPTLQIGYQPDPITVAAAGPSVNNYMPGWLP

SEQ ID NO: 6662 - protein, 403 aa, Pseudomonas syringae
MQFNKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSMQALLNNGDEVLVPAPDYPLWTAAVALSGGSPVHYLCDEQANWWPDLEDIKAKITPNTKAMVIINPNNPTGAVYSREVLLGMLELARQHNLVVFSDEIYDKILYDDAVHICTASLAPDLLCLTFNGLSKSYRVAGFRSGWIAISGPKHNAQSYIEGIDILANMRLCANVPSQHAIQTALGGYQSINDLILPPGRLLEQRNRTWELLNDIPGVSCVKPMGALYAFPRIDPKVCPIFNDEKFVLDLLLSEKLLVVQGTAFNWPYPDHFRVVTLPRVDELEQAIGRIGNFLKGYRQ

SEQ ID NO: 6663 - protein, 447 aa, Prochlorococcus marinus
MFNLTFKNCPNNSNKNLRNLILSFFIIISPALSAPQKIHSLIEDSPKEVMDQVWQIIYRDYMDSTGKYDQKEWFKVRRKMLSNKYDNYSQAYESIRVMLSSLEDPYTRFLEPKEFNEMRIDTSGELTGIGIQISIDEKNNDVLVISPIEGTPAFQAGIKAKDKIISIDGTLTKGMSIENVVKLIRGKKGTEVKLGISRDNQFFKLTLVRARIEIRTVVSRINKSSSGNHFGYIRLKQFSANAAKEMRKALISLERNDPDAYIIDVRGNPGGLLEASIDISRQLLDKGVIVSTKTKDGITDVRRARGNALTHKPIAILVNEGSASASEILSGAIQDNKRGILIGKKTFGKGLVQSVRPLVDGSGLTVTVAKYLTPRGTDIHKYGIVPDIEVELKSIKGNRFSSIDLGTEKDSQYSVAESALIRLLKKFQDKKAYLPNSSNFEVAISSK

SEQ ID NO: 6664 - protein, 783 aa, Pseudomonas syringae
MDISLKNRLSFKQARLAVLIGFALGTLLSVAQIAIDYASEDASINREIGSLLEIIQNPASRIAYNIDAELAQELTLGLLHSPAVVSARLTDNNDTVLASVERATATGRYRVLSDWLFGESRQFQEKLHLDHLPDETIGTLYLTVDTFAFGSHFLQRAEITLLNGFVRSLALAGILTILFYATLTKPLVRVIRDLSSRDPRTVDQAKITCPPYHEKDEIGVLVATFNRQFETMSSEFSRRRAAEDRLTDHLNELENIVSARTNELKSSNMRLRESNEELQIARSTALDMANARSAFLAHMSHEIRTPLNGLLGMLALSLDSPLGAEQRQQLMIAHDSGKVLVELLNDILDMSKFDAGHLEIERIPFDLGGLIEDTANLLSQNAAPSVELTCLIAPDFPAMVTGDPTRVRQIVSNLLSNALKFTRFGRVDVRLTHHQDAASGEHRVRIEVRDTGIGIAQDAQAKIFQPFTQAETAITRQYGGTGLGLALTNNLCEAMHGTLSIQSQSGFGSQFCAELPLPVHVPAVAQNPLRGRVTVVSSAGSGLVELLGSLLPFWGVDLKRRSIDDSPDDLDLDNAPDLVITDCPECLFAIRPTTPVPILLVTAYGNFMPGEQVAALAPLQQQARPLARNALYHALRRVLNQEDTGKRDTLALDQPTRRVARVLLVEDNPVNQLVAKGILSKLGCEVIISSHGGEALEQLEHGHFDLVLMDCNMPVMDGYQATRQIRSSGRWPNLPIVALTANAMPDERERCKAAGMNDYLAKPFRRAELAGILDQWIPVTDDR

SEQ ID NO: 6665 - protein, 127 aa, Glycine max
  misc_feature (18)..(18): Xaa can be any naturally occurring amino acid
  misc_feature (115)..(115): Xaa can be any naturally occurring amino acid
  misc_feature (119)..(120): Xaa can be any naturally occurring amino acid
RVSYVGPPPKDALVYLIXANEILYSLHPNIITIAEDATFYPGLCEPTSQGGLGFDYYVNLSGPDMWSTFLESVPDHEWSMTKIVNTLVSNREHADKMLMYAENHNQSISGRGSFXEILXXEIDENSN

SEQ ID NO: 6666 - protein, 627 aa, Bacillus licheniformis
MAGVSASDIKAHLFHEGRLYESYRFFGAHQTEQDGRQGFRFCVWAPHAKEVRIAGTFNGWSGVLHRMEKRHQEGIWELFIPGIGEGELYKYEMITAANETKLKADPYAFFSEVRPKTASVTYQLAGYQWGDRKWQKKKQQKAVYEKPISIYELHIGSWKKKADGRFFTYRELSETVIPYVKEHGFTHIELMPLTEHPFDRSWGYQTTGYYSPTSRYGEPHDLMYFIDQCHQHEIGVIMDWVSGHFCKDDHGLYLFDGMPLYEYKHEHDRENWEWGTANFDLGKREVHSFLISNALYWIEMYHIDGFRVDAVANLLYWPNRPQPEANGFAIEFIQTLNEQVFAKDPHFLMIAEDSTDWPLVTHPTYEGGLGFNYKWNMGWMNDVLTYMEASPEQRKHLHHLVSFSLMYAYSENYILPFSHDEVVYRKKSLLHKMPGDYWQKFAQYRLLISYFMMHPGKKLLFMGGEFAQFDEWKDEEELDWFLDDFDMHRKARMFTKEALHLYKKSRILYENDHRQQGFEWIDVNNAEQSIVSFIRYGKQPGEALIIVCNFTPSVYHEYRVGVPFQTEYIEVLNSDDAKYGGSHQINPKRLQARKGVLHGKPYSISMTVPPLGAAVFRAVKKRGAKKG

SEQ ID NO: 6667 - protein, 478 aa, Lactobacillus sakei
MTNQLTTNEGQPWADNQHSQTAGQRGPVLIQDYQLLEKLAHFNRERIPERVVHAKGAGAKGYFKVTKDMSAYTKAAVFSGVGKKTPLITRFSQVAGEAGYPDTYRDVRGFAVKFYTEEGNYDIVGNNTPVFFVNDPLKFPDFIHSQKRDPRTHARSQDMQWDFWSLSPESVHQVTILMSDRGIPASYRMMHGFGSHTFKWVNAQGEQFWVKYHFKTNQGIHNLSNELADELAGKDTDYLQNDLFDAIETGDYPSWTVAVQLVPYEDGLNYPQDIFDVTKVISQKDYPLIEIGQMVLDENPTNNFEDIQELAFSPANLVPGIEASPDKLLQGRLFGYKDAERYRLGANYEQLPVNRPKVPVHNYERDGAMAQNQATGVNYEPNSQDGPTEVPAAKIHGDQLSGTTGNFSADPDYYSAAGKLYRLLSADEQTRLIENIRMNLGQVTKPEIQIREVKQFYQADPEYGRRVATSVKLRFSSV

SEQ ID NO: 6668 - protein, 159 aa, Nicotiana tabacum
MSLIPSFFDGRRSNIFDPFSLNIWDPFEGFPFSGTVANIPTSTRETAAFSSARIDWKETPESHVFKVDLPGIKKEEVKVEVEEGRVLQISGERSREQEEKNDKWHSMERSSGKFLRRFRLPENIKMEEIKATMENGVLTVTVPKMEEKKPEVKAIDISG

SEQ ID NO: 6669 - protein, 525 aa, Triticum aestivum
  misc_feature (519)..(519): Xaa can be any naturally occurring amino acid
MAAIKPPPPDRPPQAARLPSPSSSSSAVAAAKRGATGSRGLLMGRYELGRVLGKGTFAKVYHARHVQTGESVAIKVLDREKAVRSGLVSHIKREIAVLRCVRHPNIVHLFEVMATKTKIYFVMELVRGGELFSRVSKGRLKEDIARRYFQHLISAVGFCHTRGVFHRDLKPENLLVDEAGNLKVSDFGLSAVAEPFQPEGLLHTFCGTPAYVAPEVLARRGYEGAKADIWSCGVILFVLMAGYLPFHDQNLMAMYRKVYKGEFRCPRWFSKDLTSLIMRFLDTNPSTRITLPEVMESRWFKKGFRPVKFYIEDDQLYNVIDAENDMLDLGLPDPLPQPLLPPPSSPSPQEVDGDDSGSESDASVVSCPATSSFEERHRLRGPLPRPASLNAFDIISFSRGFNLSGLFEEKGDEVRFISSEPMSGIITKLEEIANVKSFAVRKKDWRVSLEGTREGVKGPLTICAEIFELTPSLVVVEVKKKAGDKEEYDDFCNKELKPGMQHLVHQMAPVPITPTISEXAERPSR

SEQ ID NO: 6670 - protein, 518 aa, Magnetospirillum magnetotacticum
MGAGFVLAVSLLAHPASAGWVAGEAERTIAFGFDAIVERHLQPVTAQTIALDGLRGLAEIDPQLGVTLDQGRLRLSTTERVVADFPAAPPDDTVGWARITVNAALEASQVSERLRDADAERLYQAVFEGALGKADLFSRYAGAKEAREHRSNRSGFGGIGIKFDLIDGEVRIVEVVDDGPAAKLGLRSGDVITAIDGEAVKGLDRADISNRLRGAVATELVLSLRRGSQMLQFTLRRSLIVPQTVSSSVAGGIAHFKITSFNQRTAYSLENQLKEIRDRLGAGLQGVVLDLRGNPGGLLDKAVAVVDLFVTEGTIISTKGRHPAAANAFEAKPGDIGEDLALVVLVDGRSASAAEIVASALQDAGRAVVVGTNSYGKGTVQTVVRLPNDGEITLTWSRFHAPSGYALHGLGVLPVLCTGGTGQTAAQMVEAAGRGLFPGKPTETLAVWRGTGIEDTELRHRLRDTCPPVRLGDSKLEMELADRLLSNRAAYARALAASAPSRGLEALQTRPSPETGSH

SEQ ID NO: 6671 - protein, 754 aa, Lycopersicon esculentum
MGSLLRMNRLLSSIVESCNCIIDPQLPADDLLMKYQYISDFFIALAYFSIPVELIYFVKKSAVFPYRWVLVQFGAFIVLCGATHLINLWTFNMHTRNVAIVMTTPKALTALVSCITALMLVHIIPDLLSVKTRELFLKKKAAQLDREMGIIRTQEETGRHVRMLTHEIRSTLDRHTILKTTLVELGRTLALEECALWMPTRTGLELQLSYTLRHQNPVGLTVPIQLPVINQVFGTNHVVKISPNSPVARLRPAGKYMPGEVVAVRVPLLHLSNFQINDWPELSTKRYALMVLMLPSDSARQWHVHELELVEVVADQVAVALSHAAILEESMRARDLLMEQNVALDLARREAEMAVRARNDFLAVMNHEMRTPMHAIIALSSLLQETDLTPEQRLMVETILKSSNLLATLINDVLDLSRLEDGSLQLDIGTFNLHALFREVHSLIKPIASVKKLFVTLSLSSDLPEYVIGDEKRLMQILLNVVGNAVKFSKEGNVSISAFVAKSDSLRDPRAPEFFAVPSENHFYLRVQIKDTGIGITPQDIPNLFSKFTQSQALATTNSGGTGLGLAICKRFVNLMEGHIWIESEGLGKGSTAIFIIKLGIPGRANESKLPFVTKLPANHTQMSFQGLKVLVMDENGVSRMVTKGLLTHLGCDVTTVGSRDECLRVVTHEHKVVIMDVSMQGIDCYEVAVVIHERFGKRHGRPLIVALTGNTDRVTKENCMRVGMDGVILKPVSVYKMRSVLSELLEHGVVLES

SEQ ID NO: 6672 - protein, 546 aa, Unknown
  Bradyrhizobium sp. BTAi1
MSAKDVKFGVEARDRMLRGVDILANAVKVTLGPKGRNVVLDKSFGAPRITKDGVTVAKEIELDDKFENMGAQMVREVASKSADAAGDGTTTATVLAQAIVREGAKAVAAGMNPMDLKRGIDLAVEAVVADLVKNSKKVTSNDEIAQVGTISANGDSEIGKFLADAMKKVGNEGVITVEEAKSLETELDVVEGMQFDRGYISPYFVTNADKMRVEMDDAYILINEKKLSSLNELLPLLEAVVQTGKPLVIVAEDVEGEALATLVVNRLRGGLKVAAVKAPGFGDRRKAMLQDIAILTGGQAISEDLGIKLENVNLSMLGRAKKVMIDKENTTIVNGAGKKADIEARVAQIKAQIEETTSDYDREKLQERLAKLAGGVAVIRVGGATEVEVKERKDRVDDAMHATRAAVEEGILPGGGVALLRASEQLKGLRTKNEDQKTGVEIVRKALSAPARQIAINAGEDGSVIVGKILEKEQYAYGFDSQTGDYVNMVSKGIIDPTKVVRTAIQNAASVASLLITTEAMVAELPKKNAGGPAMPPGGGMGGMDF

SEQ ID NO: 6673 - protein, 474 aa, Campylobacter coli
MKKLTNDFGNIIADNQNSLSAGAKGPLLMQDYLLLEKLAHQNRERIPERTVHAKGSAAYGEIKITADLSAYTKAKIFQKGEVTPLFLRFSTVAGEAGAADAERDVRGFAIKFYTKEGNWDLVGNNTPTFFIRDAYKFPDFIHTQKRDPRTHLRSNNAAWDFWSLCPESLHQVTILMSDRGIPASYRHMHGFGSHTYSFINDKNERFWVKFHFKTLQGIKNLSNKEAAELIAKDRESHQRDLYNAIENKDFPKWKVQVQILAEKDADKLGFNPFDLTKIWPHSVVPLMDIGEMILNQNPQNYFNEVEQAAFSPSNIVPGIGFSPDKMLQARIFSYPDAQRYRIGTNYHLLPVNRARSEVNTYNVAGAMNFDSYRNGAAYYEPNSYEESPKEDKSYLEPDLVLKGNAQRYAPLDDDFYTQPRALFNIMNQNQKEQLFENIAASMEGVEEKIITRALGHFEKISPDYAQGIKKALGK

SEQ ID NO: 6674 - protein, 417 aa, Rubrobacter xylanophilus
MWRTGITKRKRGRGPLVRVLLLAALLVAVGYGAYEYGKSQSPAGLSGPDRESLRLYAEALDAVRDGYVDREAIDPKKQTYGAIEGMLDSLGDEGHTRFLTPEERRENEQGLSGDYVGIGVQLEDRDGRVVVASPIEGSPADRAGIESGDVLVAVNGRSVSGQELDRIADRVKGPEGTRVKITVLRDGEERTFYLERAEIESPAVSWAMVPGTGVAHIRLSSFSDDSARELRAAFEEARLDGAERFVLDLRDNPGGRLEQAVEMAGFFLEPGSVVYIRRDASGERTPVRADGEAQLAEVPLAVLVNGGSASSAEILAGALRDNDRATVIGQRTFGTGTVLSEFVLSDGSAILLGVAEWLTPDGDFIRDTGIEPDIRVGLDEGEEPLSPSQTEGLSREEISRRDPQLWRAVRELAGGRV

SEQ ID NO: 6675 - protein, 223 aa, Vitis vinifera
MGRGKIEIKRIENTTNRQVTFCKRRNGLLKKAYELSVLCDAEVALIVFSSRGRVYEYSNNNIKSTIDRYKKASSDSTNGGFTMEINAQYYQQESAKLRQQIQMLQNSNRHLMGDSLASLTVKELKQLENRLERGITRIRSKKHELLLAEIEYLQKREIELENESVYLRTKIAEVERLQQANMVSTHEFNAIQALVSRNFFQPNMIEGGSTGYPLHDKKVLHLG

SEQ ID NO: 6676 - protein, 532 aa, Glycine max
  misc_feature (117)..(117): Xaa can be any naturally occurring amino acid
MGRDAPLTPSLFLQTLFPSLFLSLNPTFSLSKTLHHSPLPSDPSPVSLQFPPNTAGPHLLPFSRLLMSSAAGAPDRRASPPRVAAGAPTRPPLKRHLAFITKPPFAPPDEYHSFSSXAPAAPPMKPVVVRSPYIMKRKSGMNDSEGESLAQKWSNSPGYTNVSNVTNNSPFKTPVSAKGGRTQKAKASKGRSCPPTPISNAGSPSPLTPASSCRYDSSLGLLTKKFINLVKHAEGGILDLNKAAETLEVQKRRIYDITNVLEGIGLIEKKLKNRIHWKGIESATSGDVDGDISLLKAEVEKLSLEEQGIDDQIREMQERLRNLSENENNQKCLFVTEEDIKDLPCFQNETLIAIKAPHGTTLEVPDPEEAVDYPQRRYRIILRSTMGPIDVYLISQFEEKFEEVNGAELPMIPLASSSGSNEQLMTEIVTAECSGKELEPQTQLSSHAFSDASQEFAGGMMKIVPSDVDNDADYWLLSDADISITDMWRTDSSVDWNGVDMLHPDFGVISRPQTPSSGFAEVPSTAANSIQK

SEQ ID NO: 6677 - protein, 400 aa, Unknown
  Exiguobacterium sp. 255-15
MAGVVWYRKDLRVDDHEALTRACEEEKIVRAVFVRQTADGRGKQQMTFEEETLQSLNEHLVQLGIELTILQGETVEQLTSFIQPEDVVYFHRMTGEYEARQEQEVQKRFNTRMYETQTLHLRDDIGSDELKRVFTAFRKRVEQDGRFAEPIEAPGNIQYIELPQTRGGYDPRTAFPFIGGEAAGRNRLAAYLEQPIFTYKETRNGFNVDDSSKLSAWLANGSLSPRRVMAELQRTEQEHGANESTYWLYFELLWRDFFHLTMRETGHRLFRSNGLKDGRLTWKTDQAAIDSWMAGETGEPFVDAFMREIKDTGWMSNRGRQITASYLIHDLKQDWRIGARYFEQQLIDYDVASNYGNWAYIAGVGNATRTPRFNPEFQQQKYDPNRALIRRWMSSETTEK

SEQ ID NO: 6678 - protein, 1403 aa, Nostoc punctiforme
MVKQRRYHWLKAVIFFRKRKLLALLLGIFFSISVVLLWQRLSIQTPGLLKPVVLITGLLVVTLTLSICFALAIKVNNQQIALINQDLTHRILEQKQVEITLRASENRLRQLLETVKVIPWELDLKTWRFIYVGPQAVDLLNYAIADWYEENFWINHLHPHDKEKSVRFRQEATARCENHELEYRMLAADGRVVWLRDVVSVVEEAGTLTTLRGFMFDITDLKQVEETLRLRERALAATSNGIIIADARLPYNPIIYVNCAFEKITGYTAADVIGQNCRFLQRTDSQQPALNELRSSLQAGTSCKVILRNYSKDGVLFWNELCISPIHDENGKLSHFIGIQTDISQRKQAEASLRRQALTFENMHDGVIITDLGGNIIDWNPAAQSMFGYTKAEILAKHISILHRPEVAATLSAKILEKINQQARWSGEIHFLCKDGSQAICETTVVSLQDEQGETVATVGINHDITENKRAKEALQRQLHRTLLLEQITQEIRQSLDTSKIFETAATQIGKAFKADRCLIHSYISDPTPRIPLVAEYNTLPGYCSMLKLEVPMTNNPHAEQMMAQESAIASPDVYADPLLQAAEPICRKIELKSMLSIRTSYQGEPNGAIGLHQCSYFRQWTPDEIELLEAVAAQLGIALAQAQLLEQETHRREELTLKNFALEQAKRQAEAANRAKSEFLAMMSHEIRTPMNAVIGMTDLLLDTDLTPQQQDFVETVRSSGDALLTIINDILDFSKIESGKLELEEQPFDLRACVEQAISLLAPKAAQKNIELVYLIQPQVPTQIVGDMTRLRQVLMNLLNNAIKFTERGEVVLSVELGAGDSVKQGENSSPLHPSLVRLRPSLREAAPTTTLRTSSRQARPSASSESPIQIQFAIKDTGIGITPEKIERLFHPFTQADVSMTRRYGGTGLGLVISKRLSKMMGGTLWVESQGIVGGNPSPRWKSRKSLSSPYSSQGSTFYFTITAQVPAVPEAEFSNSPMQLQGKRLLIVDDNLTNCQIISLQAESWEMETYAAKSAKEALAQLAQGIQFDIAILDMEMPAMDGITLARQIRRQSGCQNLPLVILTSLGREETFSDFGDVEFAASLSKPIKQSQLYDVITRVLGNQPSEASITDFPLVDRHLTHPLPLRILLAEDTIVNQKVALLMLQKIGYSADVVTNGVEVLKALQKQPYDLVLMDVHMPEMDGLETARRICQEWKVGFRPHIIAITANAMRGDREVCLAAGMDDYISKPIQLQKLAQALSKCPRQRSLEVTPIVKQDRVRYLELQPLQNIFQEGQNQTLKSDKIDAKILQSLRDIVRGDRVVFAELIKCYLTETLRLVQDISTAIATRDAQTIWKAAHQLKSSSGSIGAIALAQLCKVLEAQGRSSELENTIELLPQLYQEYEQVKTALEKELAKETP

SEQ ID NO: 6679 - protein, 351 aa, Clostridium acetobutylicum
MKKLFTEINIKNLKIKNRVCIPPMVVPVAEDGYVTSSNVERYKELAKGGPGLIIQEATCINEDGKLAEKQIGIWSDDQVEGLRKIVDAVHEEGCPIFVQIHHAGVVGISEEPLCPSPYEFNGYGRKVVGREMTLEDIKSVQNDYIEAARRAYEAGYDGIELHGCHGYLICQFLNKRVNKRNDEYGKNPENFVIEILEGIRKVTPKEFIVGIRLGGFEPAIEDGIHYAKIFEQQGIDFLDVSYGFSNGQEINVGEDYKYSNAVYAAERIKKEVSVPVFAVDGINSGDMAEAILNETNVDLVDIARGALINPNWANDAREGKDTGKCLRCSKCAWFGLSKACPGRAIFSRNNA

SEQ ID NO: 6680 - protein, 253 aa, Rumex acetosa
MEFSNELSRDMEDGSPQRKMGRGKIEIKRIENVTNRQVTFCKRRNGLLKKAYELSVLCDAEVALIVFSSRGRLYEYANHSVKATIERYKKTCSDSTGVTSVEEANAQQEAAKLRNQIRTLQNQTRNTSRNLMGEGLTSMNMKDLKNLETRLEKGISRVRAKKNELLFGEIEFMQKKEIELHNNNQFLRAKIAESERSQQSMNLMPGSSSGEQHYELMPQSQAGPFDSRNFFQVSDLQPDERYSCQNQTPLQLV

SEQ ID NO: 6681 - protein, 844 aa, Arabidopsis thaliana
MMLASQSEAQLNRDFYKESCPSLFLVVRRVVKRAVAREPRMGASLLRLFFHDCFVNGCDGSLLLDDTPSFLGEKTSGPSNNSVRGFEVIDKIKFKVEKMCPGIVSCADILAITARDSVLLVSTSTLLLFVMSYIDACGPGWSVKLGRRDSTTANFAAANSGVIPPPITTLSNLINRFKAQGLSTRDMVALSGAHTIGRAQCVTFRNRIYNASNIDTSFAISKRRNCPATSGSGDNKKANLDVRSPDRFDHGFYKQLLSKKGLLTSDQVLFNNGPTDSLVIAYSHNLNAFYRDFARAMIKMGDISPLTGSNERNKEEKGPLGADREIYTLNSTKFLRGLFIFGIETQKWWRMCPPITRGLAARAHEVMTHELPPTLSYLWIKLLGQGTFAKVYYGRSILTNQSVAIKMIDKEKVMKVGLIEQIKREISVMRIARHPNVVELYEVMATKTRIYFVMEYCKGGELFNKVAKGKLRDDVAWKYFYQLINAVDFCHSREVYHRDIKPENLLLDDNENLKVSDFGLSALADCKRQDGLLHTTCGTPAYVAPEVINRKGYDGTKADIWSCGVVLFVLLAGYLPFHDSNLMEMYRKIGKADFKAPSWFAPEVRRLLCKMLDPNPETRITIARIRESSWFRKGLHMKQKKMEKRVKEINSVEAGTAGTNENGAGPSENGAGPSENGDRVTEENHTDEPTNLNAFDLIALSAGFDLAGLFGDDNKRESRFTSQKPASVIISKLEEVAQRLKLSIRKREAGLFKLERLKEGRKGILSMDAEIFQVTPNFHLVEVKKSNGDTLEYQKLVAEDLRPALSDIVWVWQGEKDELTSQQETEYQQQQQQEQQEQEEPLKF

SEQ ID NO: 6682 - protein, 554 aa, Colwellia psychrerythraea
MCSIFGILDIKTGADALRPTALECSRLLRHRGPDWSGIYHSDNAILVHERLSIVDTEHGAQPLYNGDKSNVLAVNGEIYNHKALASALNVDYEFQTASDCEVILPLYEEFGVEFVDKLQGMFAFIVYNEKDNSYLIARDHIGIIPLYTGYDSEGNFYVASEMKALMPICKTVEEFPPGHILDSRVGKLQQYYKRNWQEYAAIKDNTTSTTKIREALEESVKSHLMTDVPYGVLLSGGLDSSLISAITQKFAARRIEDNDLAEAWWPKVHSFACGLAGSPDLIAAQTVADSIGTIHHSVVFTEQEGIDALKEVIYHLETYDVTTIRASTPMYLMARKIKAMGIKMVLSGEGADEIFGGYLYFHKAPNAQEFHEELNRKLDRLHKFDCLRANKSMSAWGIEARVPFLDKNFMDVAMRINPEDKLCGNGKMEKAILRESFEGYLPKEILWRQKEQFSDGVGYSWIDGLKAHVESLVTEQQLENAHIRFPVNTPDNKEGYYYRTVFEDKYPLATAADCVIGGKSVACSTEEALAWDESFQNNADPSGRAVLSVHNESY

SEQ ID NO: 6683 - protein, 623 aa, Gibberella zeae
MEKVNNFHAIMKMGNVRAISLTFDRNYMSTLFLKVANNCYPTPTMDPSYQSSETLFEGLPIDTLGNGLSASAVKSGIDRLLEHDIEPEHNLGRIHDRCVETLGAVWGSSCNDKPTGCAASGSSEAILLGILAMKRKWETENGGMASSNGSALNLITGSHAHVAVTNAAKANDIEIRSVPVRPEGNYSFDPSKMQGLLDRFTRHFDPIEDTSTVLDNYEQSHGHSIPIHVDAASCDFVAPFNGGKCSRWDFSVPRVISINASGHKFGLTAAALGWIIWRDQRFLSSDMLHESPYLSGHHGLPTLRYSQPSSSVLIQYYYLAHLGRKGFENIIQALLQRSSALSRTLEGTGIFACISESHRTAANTLPVVVFRVNSAVREQRPKFNEQWISDQLFHKGYSVPCSKLPIDGEDIEVLRVVIVLKVILVDKAVITRLAYDHVEIAIEDETGHLHIRKYEQYYKTIGVELRQNQHPPSTHYCERLQSPDHLRVIMSNRHVPTRRLKSGVLFSAPDDILRVPSDESTRRPKRKKFNNIRKMIPGVRKKGVGEEMALDASPALGHQESIAMFAKFVDPSSYGSSNHPNNPPVSSQKKETLCLSVLKVSLTATVEGTLAHMVLKQSFYNPL

SEQ ID NO: 6684 - protein, 478 aa, Bacillus thuringiensis
MKRRVAIIGMVVAFLIGAGGMFAGMSLFGVNPAEVTQTISSGNASTAQGNLAKINEAYALIDSRYVEDVKDEKLVEGAIQGMLSTLKDPYSTYMDKETAKQFSESLDPELEGIGAEVNKTDGKLIIVSPIKGSPAEKIGIKPNDQILSVDGNSVKDLSREEAVLKIRGKKGTTVAIEIKRAGVADPIVFKIKREKIPIFTVFSSVKQESGKDIGYMQITSFAENTAKEFKDQLKELEKKNIKGLVIDVRGNPGGYLNSVEEILGEIMTDKKPMLQVEQRNGEKKKFSTELKERKPYPISVLIDNGSASASEILAGALKEGEGYDLIGEKTFGKGTVQQAVPFKDGSNIKLTMFKWLTPDGNWIHKKGIKPTVEVKQPDYYHATPIQIEKTLSYNANDVQVKHAQEMLKSLGYVPGREDGYFSKETESALKAFQNANKMEATGQLDKKTAEAIQTKIIEKIRSGENDLQLQSALKLMAK

SEQ ID NO: 6685 - protein, 332 aa, Gibberella zeae
MSFGRTVTLNSGWKIPQIGYGTWQAAPGEVGNGVYEALKAGYRHLDLAKIYQNQREVGEGIKKALSEVPGLKREDIFITGKLWNNKHRPEEVAGALDDTLEELGLEYIDLWLIHWPVAFKNGNQLFPLKEGDDGKTALDQEVTLSQTWEAVTKLPKEKVRSIGVSNFNKEMLEQIIKDTGVTPAMNQIERHPRLPQPELVKYLQEKGIFLTAYSAFGNNSWGEPLLINTPEVKAIAERLSKSKGKEVTPAQVILAWSTLDNHVVIPKSVTPARIRSNFEEVELDEEAVKELSKFGEKPQRFNIPKTYKPDWDINVFDDEKEKSATHQVVLKL

SEQ ID NO: 6686 - protein, 114 aa, Arabidopsis thaliana
  misc_feature (68)..(68): Xaa can be any naturally occurring amino acid
  misc_feature (74)..(74): Xaa can be any naturally occurring amino acid
MCSYSIASAISRISPLIRFVKPYSTGFSFITCACNSTRRPKRFDQLCVFSMASEARESPAFNPGLSSXRDEATXGYILQQTMFRIKDPKASLDFYSRVLGMSLLKRLDFSEMKF

SEQ ID NO: 6687 - protein, 173 aa, Brucella melitensis
MSEPIGSPCVFKQRAHGQQNSATKEKTMRYLHTMVRIRDIDESLDFYVNKLGLEEIRRIENEKGRFTLIFLAAPSDTDRARAERAPELELTYNWDPETYTGGRNFGHLAYMVDDIYATCEKLKSAGVTINRPPRDGHMAFIKSPDGISIELIQKGERLAPQEPWASAENIGTW

SEQ ID NO: 6688 - protein, 803 aa, Yersinia pestis
MMTANYLSAQNFSPNIKTVAVAGEEPLMMAFAIRPDLPELKTIIDKVIESIPPEEFDNLTSEWSTFKPKPISFDESSLDNELLMIALKISSGLLLVFGLYLCYLVFNKRRQAKLLHARLLQQESIINALPFAVFIRTASGELAVYNSHFADVHSDKLYDMLNQTHEPAHWPMTSPLDREIDKYCRSVLLNRKPQLVDLSVEIKGDIRDIFLWIIPLNNAEQGVLGGWLDISQRKTVERQLEAARVEAESANRTKSTFLATISHELRTPMYAIMGLLELEIRSNRPVEKDTLVTVSKSAQSLMLLLDDIIDSAKIEAGQLSIHPTAVDFHQEMERMFTLYQPIANERGLRFSGWLDDHIPPLLMADMLRVRQVMGNLLGNALKFTEQGSVSVDITWEPSDEQHGVMNIDITDTGIGISPAAQATLFQPFSQANEGKSPRFGGSGLGLWICHQLIHKMGGKIALESQLGKGTSLLITLPLNIATADDLAQDAAITHVDDERLNQLRNLRILVVDDLPANRQLLQQQLAFIGIEQVVTAENGAKACQILQHNNFDVVITDCSMPVMDGYELAAHIRQDPALKDLIVIGCTADAREESAARCIDAGMNACMIKPVAIDTLQATLLRKDIVSQISNTNHSQSTEDNDRGGNQSNLSEKNTAQQENAPAIHSTTITSSVNRLAAAQNKLRTLSGGNPAVELQLLQSLLESNLQDAVTLTQLYRQLCVEDEDVVETVDTAETVDTADTVEDGETRGPGSTVGRHSTAGSDHIPHADIYKQMASLVHRIKGSVQLIDAQELVASCVKFESQ

SEQ ID NO: 6689 - protein, 492 aa, Nicotiana glutinosa
MDPYKYRPSSAFNSPFCTTNSGAPEKNNNSYLTVGARGLVLLEDYHLVEKLANFDRERVPERVVHARGASAKGFFEVTHDITHLTCADFLRAPGVQTPVIVRFSTVIHERGSPETLRDPRGFAVKFYTREGNFDLVGNNFPVFFIRDGMKFPDMVHALKPNPKSHIQENWRVLDFFSHVPESLHMFTFLFDDIGIPQDYRHMDGSGVHTFTLINKAGKSTYAKFHWKPTCGVQSLLEDEAARVGGANHSHATQDLYDSIAAGNYPEWKLFIQTMDPSHEDRFDFDPLDVTKTWPEDILPLQPVGRLVLNKNIDNFFNENEQLAFCPSIVVPGVYYSDDKMLQTRIFSYSDTQRYRLGPNYLQLPANAPKCAHHNNHYDGSMNFMHRDEEIDYFPSRYDPVRHAEKYPIPSTMCTGKREKCVILKENNFKQPGERYRSFTPDRQERFIRRWVEALSDPRITHEIRSIWISYWSQADKSLGQKLASRLNVRPSI

SEQ ID NO: 6690 - protein, 384 aa, Legionella pneumophila
MMFGFLNMTVWGYLLTGFVLTHITTTAVTIYLHRYQTHRALTLHPLVSHFFRFWLWLTTGMTTAEWVAIHRKHHANTDMEGDPHSPQVFNIRKVFWQVPELYREASKDKDMIKKYSYGTPNDWIERKLYSPHANKGIFLMLALNLFLFGIPGLTLWAIQMMWIPLVAGVVNGIGHYWGYRNHESSDSSTNVFPWGLLIAGEELHNNHHTFASSAKFSIKWWEFDLGWFYIRCLSFLKLAKVKKLPPKLIIDKNKSHIDVDSVKAILGNRFQVISDYYKLVIFPTLRDMQYRIKNRDLKNARHLLKKPNEQLSHADQLRLKTLLKQHDNLQAVHNYRELLQQIWLKTSLSNKDLLNLIQKWCSQAEESGLLVLRQFASQLKSYSL

SEQ ID NO: 6691 - protein, 190 aa, Triticum aestivum
  misc_feature (113)..(113): Xaa can be any naturally occurring amino acid
  misc_feature (157)..(157): Xaa can be any naturally occurring amino acid
STHASGPTRPSTHASVGPPVRPRLPPRARKGVMQMLNAIIRNERDGILVPVPQYPLYSAAISLFGGSLVPYYLEEEANWGLDLVSTRQSVAEARSKGITVRAMVIINPGNPTXGQCLSEANIRELLNFCYQENLGLLADEVYQQNVYQDERPFISAXRKVMFDMGPPVSREVQLILPYGSKDIGMWLVGL

SEQ ID NO: 6692 - protein, 470 aa, Geobacillus kaustophilus
MEQRSKQPITYRFPAGFWWGSATSATQIEGAANEGGKGKNIWDHWYEQEPHRFFQGVGPEVASDFYHRYKEDIALMKEIGHNSFRFSISWSRLIPDGVGEVNPEAVRFYNAVIDELLANGIEPFVNLYHFDMPLAMQTIGGWENREVVDAYARYASLCFQLFGDRVKTWFTHNEPIVPVEGGYLYDFHYPNVVDFRRAVQVAYHTMIAHAKAVAAFRRAAIPDGKIGIILNLTPSYPRSQHPADVKAAHIADLLFNRSFLDPAVKGEYPQDLIELLDEYGFLPVTKANDRELIKENTIDLLGINYYQPRRVKAKENMPNPDAPFLPERFFDYYAMPGRKMNPYRGWEIYEKGIYDILINIKENYGNIECFISENGMGVEGEERFRDESGMIHDDYRIEFIREHLKWVHRAIEEGVNVKGYHLWTFMDNWSWTNAYKNRYGLVAVDLENGLKRTIKKSGYWFKSLAENNGF

SEQ ID NO: 6693 - protein, 732 aa, Kineococcus radiotolerans
MSSEAPSSAPTPRPVDADDLARAAAGAHWSPHSVLGVHPHGDALTYRVLKPFASAVTVVTEDGTRVGLVHEYDGVWVGVLPGAGVGDYRVEVTYPGAEPALLDDPYRFLPTVGEVDLHLIGEGRHEELWNVLGAHVRHWEGPMGPVEGTSFAVWAPAARAVRVVGDHNHWSGREHAMRSLGSSGVWEIFLPGVGVGSRYKYEILGADGHWRQKADPMARASEVPPATASVVTESTYTWNDAEWLEQRAARSAQDGPVSVYEVHLGSWKQGLSYTELATELVDYVSAAGFTHVEFLPVMEHPFGGSWGYQVTGYFAPTSRFGSPDELRHLIDALHQAGIGVIIDWVPGHFPKDEFALAKFDGTALYEHPDPRLGEHMDWGTYIPNFGRSEVRNFLVASGLYWLEEFHADGLRVDAVASMLYLDYSRNAGEWVPNRHGGRENLEAIAFLQEANATAYKRTPGIMMIAEESTAFPGVTAPTSAGGLGFGLKWNMGWMNDSLRYFAQDPVNRQYHHGELTFSLVYAFTENFALPISHDEVVHGKGSLLRKMPGDRWQQLANVRAFLGYMWSHPGKQLLFMGSEFGQEAEWSESRSLDWWLLDTPWHQGLHRLVTRLNAVYKEHPELWSDDFTSEGFQWIDGADNQRNLISFVRWSKDRKPLVAVCNFSGSPYEDFRVGLPQAGPWREVLNTDAEEFAGSGVVNTGTLQGEDVPWNGQQFSAALRVPPLGVTWLVPA

SEQ ID NO: 6694 - protein, 247 aa, Pisum sativum
MGRGRVELKRVENKINRQVTFAKRRNGLLKKAYELSVLCDAEVALIVFSNRGKLYEFCSTSSMLKTLERYQKCNYGAPEGNVTSKEALVLELSSQQEYLKLKARYESLQRSQRNLMGEDLGPLSSKDLETLERQLDSSLKQIRSTRTQFMLDQLGDLQRKEHLLCEANRALRQRMEGYQINSLQLNLSAEDMGYGRHHQGHTHGDELFQVQPIECEPTLQIGYHQGDPGSVVTAGPSMNNYMGGWLP

SEQ ID NO: 6695 - protein, 567 aa, Vibrio cholerae
  misc_feature (520)..(520): Xaa can be any naturally occurring amino acid
MISKNMRSHLKLSFKSIFSIKFIVISHLVKRVIYPYILAGQKRAFDFFILRNVGQNGRSHWRATMHMSKSFLIISMGFVAVSVQAQTLTRDNGAPVGDNQNSITAGEHGSVLLQDVHLIQKLQRFARERIPERVVHARGTGAHGEFVASGDFSDLTLSAPFTSKGKITPVFVRFSTVIHSKGSPETLRDPRGFATKFYTEQGNWDLVGNNLPVFFIRDSIKFPDMVHSLKPSPVTNLQDPNRFFDFFSHEPGSTHMLTWVYTNLGTPASYRTMDGFGVHAYKWINQKGDVNYVKFHWKSLQGIESLRPDEVVKVQGQDFNHLTNDLYTQINAGNHPKWDLYVQVLTPEQLSKLDYNGLDATKVWLDVPEKKVGTMTLNKVPDNFFLETEQSAFAPSNLIPGIEPSEDRLLQGRLFAYADTQLYRLGANLFQLPINRPLVEVNSHNQEGASNSAQTASDINYQPSRKLELKEDPQFKAVQTQLVGSVQQKAISNPRNFYQAGVLYRSLNEQDKQDLITNLXGBLNKVTDKEIKATMVSHFYRADKDYGTRLARATNTDLKQVAKLAAM

SEQ ID NO: 6696 - protein, 591 aa, Unknown
  Mesorhizobium sp. BNC1
MCGICGEVRFDGRTPSVSAISGMMEALAPRGPDGAGIVSHGNAGFGHRRLRIIDLSEKAQQPMVDSALGLTIAFNGCIYNYPELREALEAKGYSFFSHGDTEVILKAWHAWGETCVERFHGMFAFVIQERDTGRIVMARDRFGIKPLYLAEKSGVLRFASSLPALVKAGDVDTSIDRVALHHYMTFHAVVPPPRTILNGVRKLPPATIRVIEADGRSTERRYWDPPYRRDPADAGVSAEEWRDRVHEALRLAVKRRMVADVPVGVLLSGGVDSSLIVGLLAEAGQTGLMSFSVGFEEANGEKGDEFVYSDLIAKEFGTDHHKIFVPSDRLMDALPGTFAAMSEPMVSYDNVGFYLLSQEVSKHIKVVQSGQGADEVFGGYHWYPPLARSNDVVADYAKVFFDRSHETLKRQLGANWINGEDYSRGLVAAELMRPGADSPVDRALRLDANVMLVDDPVKRVDNMTMAWGLEARVPFLDHELVELAARIPPEEKLKDGGKGVLKDVARLVVPHEVIDRPKGYFPVPQLKYVAGPYLEMVRDALGSQRARERGLFRQDYLDRLFAQPADHITPLRGSELWQAGLLELWLQTHGI

SEQ ID NO: 6697 - protein, 395 aa, Rickettsia prowazekii
MLSKLNKPALFALIFYPVFIISLVVKYSFDYGIGLTEIIFIIASYYINNITVGIGLHRLWSHNAYKINKYAEFVLVMLSAGTLQGPALSWASNHYKHHAKTDTDQDPHSPLKFDNKVLGFLWSHIGWMLIGSGSYKFIDRITWAKLGKNNLLKWQLKYYWKIAAFMNIVVPLFTGYLVGGTIKSAYAGFLFIGLGRFLQQQATFCVNSLCHFVGSKKYYRGTAGDIWWMALFLLGENWHNYHHAFPSDYRNGVKWYHFDVHKWIIFLMSKIGLASELERTTKVRIQAKMQETLSYLSEKQKQKLSLMQTKIDNLLENLCLKSKEIEESSLAIKEQLKKSFVEIQESLKNLAEQVSSATQITEKPSEKLLKIVNKKIIDAEQSIYKLYNQLNTLKV

SEQ ID NO: 6698 - protein, 689 aa, Aspergillus oryzae
MGTSQAVDSSPPDGTGVIQLDPWLEPFRDALKQRFSFIEGWVKAINETEGGLETFSKGYERFGLNVQSNGDIIYREWAPNAVQAQLVGEFNNWDVTAHPMTKNGFGVWEVTVPAVNGAPAIPHDSKIKISMVIPSGERIYRIPAWIKRVVQDLSVSPTYEAVFWNPPTEKQYKFQYSRPKRPESLRIYEAHVGISSPETKVATYKEFTSNMLPRIKYLGYNAIQLMAIMEHAYYASFGYQVNNFFAASSRYGTPEDLKELVDKAHSMGLVVLLDVVHSHASKNVLDGLNMFDGTDHLYFHGGGKGRHELWDSRLFNYGHHEVLRFLLSNLRFWMEEYGFDGFRFDGVTSMLYTHHGIGTGFSGGYHEYFGSSVDEEGVMYLTLANEMLHNLYPNCITVAEDVSGMPALCLPHSLGGVGFDYRLAMAVPDMYIKLLKEKKDDEWDIGNLSFTLTNRRHGEKTIAYAESHDQALVGDKTLMMWLCDKEMYTHMSVLTEFTPIIERGMALHKLIRLVTHGLGGEGYLNFEGNEFGHPEWLDFPRDGNNNSFWYARRQLNLTEDHLLRYKFLNDFDRAMQLTEEKYGWLHSPQAYVSLKNETDKVLVFERAGLLWIFNFHPTNSFTDYRVGVEQSGTYRIVLDTDDPAFGGLNRNLKETRFFTTDLSWNGRSNFLQVYIPTRTALVLALEETL

SEQ ID NO: 6699 - protein, 141 aa, Oryza sativa
MDKGVIVYICDSQGVRDIYEADGISTVAASEPLVVLVNKGTASASEILAGALKDNKRAVIYGEPTYGKGKIQSVFALSDGSGLAVTVARYETPAHTDIDKVGVIPDRPLPASFPTDEDGFCSCLRDSNSACNLNAAQLFTR

SEQ ID NO: 6700 - protein, 970 aa, Debaryomyces hansenii
MKTYLFSIPTKKTDETSWVKPLNNYLLSIYGNTTEYQLDLEKFDKLRQDIRGVNPDNTGIKLYYNYYSQLELLDLRFPFSTVNRHKKVNFSWYDAFQPSVVHKQTALAFEKACVLFNLGALLSTYAGAKYEEAQRNSSIAAADETIKESLQIFQQTAGIYQFLNENFLHAPSNDLHQASVKFLVKLMLAQAQEVFVLKVISGDLEQNKNSLIAKLCQGTTNHYTECFNMVCNINKSGGGSSHDDFAVTDTNESVDDILGDDDDDDDLGDYNPEKSGEPQVTASIDSAWVATIHFKVQFYESLSHYFHGLQLEKNNKYGDSIAYLTKSQNILNEISSATLKAISKSGSNDSYELLDNYKYQKDAVGIKLTEMNKDNDFIYHDIIPSLITLPEIKPMDGVKTIPINNSKLFNDLNEYNYSNFFNNVVPINIHELLSFYSEEKSQFLRNELDLVDVSNEELASILEYLKMPKSLVNLKEIMNSSKHVDTMSTSLETNIDPGVRSIVNEVSSKYQTDMSNKDHISTIRKEIYNTITESESNLSGKFSESLIKYKDDLVRLKKSLIDASNSDNNLFGLINNDNSHLYAILGKGADSPEFKMLFNVDSQTSKKQSNNVENEISLLDIDDSQLSSSVNATDSIDSKIKSIEDILHDLNSIKNNKAKLVDTLKKEIHNDDISDILILNSKIKSTNEIKTVIFPEELKKFDPYGKELDNLIEQEKTFINELKNQWANLSDDPKVKEIQSSKQFQSNLIKHQTDKIIKFYNQNWKKYSLGLSAGVDFYNKLLAYARLLKQNIATAVNAPPQSSFNENFSNLNLGPQHLGPRAPPRPNQSYRPSYGDQSGTPQYNASHFSSNSPSLNHNLPPQYSQSSLHRSSTGGSFASHHSNESPGSYSRPPPALPPKRPSYSAQPTPHAPPQAPYTQFQPQASNYTDNSSSSANPTNLPQHPDSGTNDLIYNQPSTYQPNMYNFFSSN

SEQ ID NO: 6701 - protein, 510 aa, Zea mays
MARYFRSSNLASRIFDRQLISPLPGATVNTIRQFYENLVPSYTIYDIDCPDYSFRKFTDDGKYLVAFSRNHQDLIVYRPIWFTYSCNEECETHELPPKAKKFDSFFKQLYSIPLASSNEYICKDFFLYMECHRFGLFATSTAQSNESTATEGAIHGVPLIEKITFHLVRLEDGVILDEKAFCNDFINLAHSIGAYMYEDLLCIVSLRYQTIHILQIRDSGNLVEVRNIGAFCREDDELFLHSHIQTGYGGSFLPGIKQRLLSYIFCKTWNEVPDQTLRVQHLKKKFYFHFQDYVDLIIWKVQFLDRHHLFVKFGSVDGGVSRSTDQNLAFFAVYNMETTDIVSLHQNSSEDIYALFEQFYDHFHANPQASSHGKFISSHSNDIHALDQLRVIKNKASSSSQFVKKMMTSLPYTCQSQSPSPYFDLSLFRYDEKLISAIDRHRHCTEHPIKFMSVRQNVVKFKIKPGSDSGASDSRAKRISSFLFHPFFPLALSIQQTYMQPTVVNIHFRR

SEQ ID NO: 6702 - protein, 365 aa, Salmonella enterica
MSSAKLFTPLKVGAITATNRVFMAPLTRLRSIEPGDIPTPLMAEYYRQRASAGLIISEATQISAQAKGYAGAPGLHSDEQIAAWKKITQGVHAQGGHMAVQLWHTGRISHASLQPGGQAPVAPSAINAGTRTSLRDENGQAIRVETSTPRALDTHEIPGIVNDFRQAIANAREAGFDLVELHSAHGYLLHQFLSPSSNHRTDRYGGSVENRARLVLEVVDAGIKEWGADRIGIRLSPVGTFQNVDNGPNEEADALYLIEALGKRGIAYLHMSEPDWAGGEPYSDAFREKVRARFHGPIIGAGAYTPEKAEDLIEKGLIDAVAFGRDYIANPDLVARLQRKAELNPQRPESFYGGGAEGYTDYPTL

SEQ ID NO: 6703 - protein, 364 aa, Enterobacter cloacae
SAEKLFTPLKVGAVTAPNRVFMAPLTRLRSIEPGDIPTPLMGEYYRQRASAGLIISEATQISAQAKGYAGAPGLHSPEQIAAWKKITAGVHAEDGRIAVQLFHTGRISHSSIQPGGQAPVSASALNANTRTSLRDENGNAIRVDTTTPRALELDEIPGIVNDFRQAVANAREAGFDLVELHSAHGYLLHQFLSPSSNQRTDQYGGSVENRARLVLEVVDAVCNEWSADRIGIRVSPIGTFQNVDNGPNEEADALYLIEELAKRGIAYLHMSETDLAGGKPYSEAFRQKVRERFHGVIIGAGAYTAEKAEDLIGKGLIDAVAFGRDYIANPDLVARLQKKAELNPQRPESFYGGGAEGYTDYPSL

SEQ ID NO: 6704 - protein, 481 aa, Silicibacter pomeroyi
MSETRAIIYWLRRDLRLADHPGLAAAAASGRPVVPVFIHDESVAALGAAPAFRLGLGLERFGATLGDMGSRLILRRGSAPAVLQALIAETGAGAVWWTREYTPQAITRDSALKTALQQAGIEARSFGGALLFEPWTVETGAGGFYKVYTPFWRAVSQREVSAPDPAPARVRPPEAWPGSEALSDWGLGAPMRRGAAVVATHQAPGEAAALERLDRFIATGIGQYDACRDLPAGDGTSTLSDALSLGEIGPRTLWHRAGEAAHKGAQGAETFLKQLVWRDFAYHLMYHTPHLLSENWRPGWEVFPWATDPADPGFVAWTRGRTGVPLVDAAMREMYVTGRMHNRARMIAASYLTKHLMVHWKLGMDWFADCLTDWDPAANAMGWQWVAGCGPDAAPYFRIFNPETQAKKFDPKGRYRNHWIAEGQAEPPRAALSYFDAVPRSWNLRPDASYPPPIMALDQGRRRALSAYASAFSQGSDGKLA

SEQ ID NO: 6705 - protein, 141 aa, Oryza sativa
  misc_feature (70)..(70): Xaa can be any naturally occurring amino acid
MVSFEMSELKKIGLGLSGFGVLFSFLGIIMLFDKGLLAIGNILFVSGVSLTIGPKSTVQFFTKPKNHKGXSIAFGIGFFLVLIGWPFFGMLAEAYGFVKLFRGFWPTAAVYLQKSPTFGWIFHHPLVTSLITRFRGRRVPV

SEQ ID NO: 6706 - protein, 176 aa, Brassica napus
MGEQPDPFSTSTLPDFISSQKIGRPVTLEGQSNRGHPYSGLKKRGQSSRSWVKIDENGNSTVLELDKATIMKRCSLPSRDLRLLDPLFIYPSSILGRERAMVVSLEKIRCIITAEEVILMNARDASVVQYQSELCKRLQSNQNLAVKDDSPFEFKALELGLELSCLSLDAQDLTPL

SEQ ID NO: 6707 - protein, 141 aa, Thiomicrospira crunogena
MSLLLRNLEPFRELKELENRLHHLFPKGEESNVAAFTPTVNTREGDYAYHIEIDLPGVKKEDIHVEVKENRLMISGERKVKEEVKEEDYHRVESRYGKFERSFTLPDNVDAENVDASTTDGVLEVVLPKKERSTSKKIEVK

SEQ ID NO: 6708 - protein, 466 aa, Streptococcus pyogenes
MKQRKHRYQFPDGFLWGSSTSGPQSEGTVPGDGKGPSNWDYWFSIESAKFHHQIGPEKTSTFYENYKGDIALLKETGHTIFRTSIQWSRLIPEGVGEVNPKAVTFYREVFQDIIAQGIKLIVNLYHFDLPYALQEKGGWENKATVWAYETYAKTCFELFGDLVNTWITFNEPIVPVECGYLGYYHYPCKVDAKAAVQVAYNTQLASSLAVKACHKLHPDHKISIVLNMTPAYPRSDAPEDVKAARIAELFQTKSFLDPSVLGVYPAELVSILEEADLLPQYSADELEIIKNNTVDFLGVNYYQPLRVQAPSKSQQEGDPLILDIYFEPYDMPGKKVNPHRGWEIYEPGLYDIALNLKEHYGNIEWLVTENGMGVEGEEAFLADGQIQDDYRITFIEDHLIQLHKALGEGANCKGYLLWTFIDCWSWLNAYKNRYGLVALDLESQKRTIKKSGYWFKALSESNGFDK

SEQ ID NO: 6709 - protein, 245 aa, Glycine max
  misc_feature (233)..(233): Xaa can be any naturally occurring amino acid
MQTSKENAMFCSSLVLLPFPIFNFRVPLISLFLFTPKLRSLQQHSDLEMDGPAGRGGAGLDMFLPNYKLGKTLGIGSFGKVKIAEHVLTGHKVAIKILNRRKIKNMEMEEKVRREIKILRLFMHPHIIRLYEVIETPTDIYVVMEYVKSGELFDYIVEKGRLQEDEARNFFQQIISGVEYCHRNMVVHRDLKPENLLLDSKCNVKIADFGLSNIMRDGHFLKTSCGSPNYAAXPEVISGKMYAGP

SEQ ID NO: 6710 - protein, 283 aa, Arabidopsis thaliana
MANAITFFKLNTGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSVSITRLTNPFTFYFIHSLNDFFFPGILAIRFSRDNMAEERCFEEPDTEYGCGKTRKESCASRPSLGTPNGSQCASQEYK

SEQ ID NO: 6711 - protein, 281 aa, Physcomitrella patens
MGRGKIEIKKIENTTSRQVTFSKRRGGLLKKAHELAVLCDAEVALVIFSSTGKHFEFASSGSMRDIIERYRKSSDGAVKRGTNTDLLGREVIKLKQQVERLESSQRHMLGEDLSALKVSDLLELEQQLDQGASRVRARKNQLILEEIEDLRRKEHELMIANEALRKKIADAEGAAEAAARANFPDARLESPKPFASDFSRDMSVSSQLAASVYPHPNLLQAQRSQTSLQLGWLSEQQIPSTEEGCAGESSLKWDHPHFHIQNRLHANISPSVRTYKLHVDR

SEQ ID NO: 6712 - protein, 185 aa, Guillardia theta
MSEKSNLAPFIKKLYQLVNDPMTNDYICWEKNETCFIVNKPTELSVYILPRYFKHNNFSSFVRQLNQYGFHKLEPNEWVFGHPYFKGGDKLKLSSIKRKKQWSSQKNVSVDFYNNEIFKKLIYELDTLKKYKQVLTKDILDVCRRQERFLIKQQSIETKIKKIEEELNNLKYLVFGYFGKILKSN

SEQ ID NO: 6713 - protein, 543 aa, Clostridium acetobutylicum
MAKQILYGEEARRSMQKGVDKLADTVKVTLGPKGRNVVLDKKFGAPLITNDGVSIAKEIELEDPYENMGAQLVKEVATKTNDVAGDGTTTATLLAQAIIREGLKNVTAGANPMLIRNGIRLAVDKTVEGLKKVSKNVNGKEDIARVASISAADPEIGKLIADAMEKVGNEGVITVEESKSMGTELDVVEGMQFDRGYLSPYMVTDQEKMEAVLDDPYILITDKKIANIQEILPLLEQIVQQGKKLLIIADDVEGEALATLVVNKLRGTFNCVAVKAPGFGDRRKDMLRDIAILTGGEVISEELGKDLKDVKVEDLGSAESVKISKENTTIVNGRGDKSAIHDRVAQIRGQIEETTSDFDREKLQERLAKLAGGVAVVKVGAASETELKERKMRIEDALAATKAAVEEGIIAGGGTAYINVLPEVRELTSDEPDVQVGINIIVKALEEPVRQIAANAGLEGSVIIEKIINSEKGIGFDALHEKYVDMLSVGIVDPTKVTRSALQNAASVASTFLTTECAVADIPEKDKPEMPGGAPGMGMGGMY

SEQ ID NO: 6714 - protein, 239 aa, Phalaenopsis equestris
MDSSSMEPKEKMGRGKIEIKRIENTTNRQVTFCKRRNGLLKKAYELSVLCDAEVALIIFSTRGRLYEYANNSVKGTIERYKKASTDNSNTGSISEANSQYYQQEATKLRQQITNLQNSNRNLLGDALTTMSLRDLKQLETRLEKGINKIRAKKNELLHAEIDYMQKREMELQTDNMFLRNKISDNERAQQQHQHMSILPSTSTEYEVMPPFDSRSFLHVNLMDPNDRYSHQQQTALQLG

SEQ ID NO: 6715 - protein, 466 aa, Agrobacterium tumefaciens
MDRKASRMTDPQTLAARFPGDFLFGVATASFQIEGATKADGRKPSIWDAFCNMPGHVFGRHNGDIACDHYNRWEEDLDLIKEMGVEAYRFSIAWPRIIPDGFGPINEKGLDFYDRLVDGCKARGIKTYATLYHWDLPLTLMGDGGWASRSTAHAFQRYAKTVMARLGDRLDAVATFNEPWCAVWLSHLYGIHAPGERNMEAALAAMHHINLAHGFGVEASRHVAPKVPVGLVLNAHSVIPASNSEADLKAAERAFQFHNGAFFDPVFKGEYPAEMMEALGDRMPVVEAEDLAIISQKLDWWGLNYYTPMRVADDATPGAEFPATTPAPAVSEVKTDIGWEVYAPALKSLVETLYKRYDLPECYITENGACYNMGIENGEVNDQPRLDYYAEHLGIVADLIRDGYPMRGYFAWSLMDNFEWAEGYRMRFGLVHVDYDTQVRTLKNSGKWYSALASRFPKGNHGVVKG

SEQ ID NO: 6716 - protein, 246 aa, Unknown
  Malus x domestica
MGRGRVELKRIENKINRQVTFAKRRNGLLKKAYELSVLCDAEVALIIFSNRGKLYEFCSSSSMLKTLDRYQKCSYGAVDQVNRPAKELESSYREYMKLKGRYESLQRTQRNLLGEDLGPLNTKELEQLERQLEGSLKQVRSTKTQYMLDQLSDLQNKEQLLIEANRDLTMKLDEISSRNQLRQSWEGGDQGMAYATQHHHAQSQGFFQPLDCNPTLQMGYSAVGSEQMSATTNAQQVNCFIPGWML

SEQ ID NO: 6717 - protein, 165 aa, Zea mays
  misc_feature (104)..(104): Xaa can be any naturally occurring amino acid
MASTTETNNYKFNHSMIRVKDPKASTKFYEFLGMSLVKKLEFPDNKFDLYFFGYDSPNALSHNKSTFDRQGLIELTHNYGTENDPEYKVNNGNQDPHRGFGHTXIAVDNIQAACQRIEDAGYKFQKKLTDGRMRNIAFRLDPDGNWGPKVVARNDYQETENVKED

SEQ ID NO: 6718 - protein, 546 aa, Burkholderia vietnamiensis
MAAKDVVFGDSARSKMVEGVNILANAVKVTLGPKGRNVVLERSFGGPTVTKDGVSVAKEIELKDKLQNMGAQMVKEVASKTSDNAGDGTTTATVLAQSIVREGMKYVASGMNPMDLKRGIDKAVAAAVEELKKISKPCTTNKEIAQVGSISANSDSSIGDRIAEAMDKVGKEGVITVEDGKSLADELDVVEGMQFDRGYLSPYFINNPDKQVAVLDNPFVLLHDKKVSNIRDLLPVLEQVAKAGRPLLIIAEDVEGEALATLVVNNIRGILKTVAVKAPGFGDRRKAMLEDIAILTGGQVIAEETGLTLEKATLAELGQAKRIEVGKENTTIIDGAGEAASIEARVKQVRTQIEEATSDYDREKLQERVAKLAGGVAVIKVGAATEVEMKEKKARVEDALHATRAAVEEGIVAGGGVALIRARTAIAGLTGANADQNAGIKIVLRAMEEPLRQIVTNGGEEASVVVAAVAAGKGNYGYNAATGEYVDMVEAGVVDPTKVTRTALQNAASVAGLLLTTDAAVAELPKEDAPMPGGMPGGMGGMGMDM

SEQ ID NO: 6719 - protein, 518 aa, Unknown
  Burkholderia sp. 383
MCVARRHHAAQPRQYVSLSAFVIEVPVPAKSSVAPAIVWFRDDLRVTDQPALTRAVESGRPLVCVFVDDTGDGAGRALGGAARWWLHGSLAGLDAALARHGGRLLLLRGDAQREIERVVHDTGAEAVYWNRRYAQPQRDADAALKASLKARGVTVESSNGSLLNEPWEVLTGSGGPYQVFTAYWRAARRDRTVAVPLPEPERIAFHPWPKAVRDCALALDVLALRPPVPDWAGGLRDAWPAPDEAGAHARLDAFLTASLAGYADARDLPDRPATSRLSPFLRFGNLSPRQVWHAVQGAANAGGAAVAADADKFLSELGWREFSYTLLYHFPALASDNFRAQFDAMPWRDDPAALRAWQRGRTGYPLVDAGLRELWTTGWMHNRVRMVVASFLIKHLLIDWRAGEAWFWDTLVDADPANNAASWQWVAGCGADAAPYFRIFNPVAQGQKFDPDGAYVRRWVPELAGLDNASIHAPWEASPLELDAAGVRLGVDYPAPLVEHAAARARALDALAALPKRR

SEQ ID NO: 6720 - protein, 358 aa, Silicibacter pomeroyi
MSETLFTPLKAGNIALKNRVVMAPLTRNRADDTAGTVFDRHAEYYAQRASAGLLITEGAQISAEGKGYIQTPGIHTPEQVAAWRKVTDAVHARGGKIVIQLWHVGRISHSSLLPDGQAPVSPSAIAAEAKTFTHAGFETTSTPRALETDEIARVLADYAHAAQSAREAGFDGVEIHAANGYLVEQFLKDGANQRQDDYGGSVENRARFLFQVLEAVLTVWEPGNVGIRLSPFTTVNGISESDPVATYTPVIKRLDSYGLAYLHMIEGQTGGARDGAFDDLRQLWTGAYMGNNGYDRASALERTETGAVDLVAFGRPYIANPDLVERLAADAPLNMGDTATYYGGGDEGYTDYPVLQTA

SEQ ID NO: 6721 - protein, 180 aa, Pisum sativum
MASMISSSAVTTVSRASTVQSAAVAPFGGLKSMTGFPVKKVNTDITSITSNGGRVKCMQVWPPIGKKKFETLSYLPPLTRDQLLKEVEYLLRKGWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 6722 - protein, 180 aa, Pisum sativum
MASMISSSAVTTVSRASRGQSAAVAPFGGLKSMTGFPVKKVNTDITSITSNGGRVKCMQVWPPIGKKKFETLSYLPPLTRDQLLKEVEYLLRKGWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 6723 - protein, 448 aa, Triticum aestivum
  misc_feature (68)..(68): Xaa can be any naturally occurring amino acid
  misc_feature (146)..(146): Xaa can be any naturally occurring amino acid
  misc_feature (197)..(197): Xaa can be any naturally occurring amino acid
  misc_feature (214)..(214): Xaa can be any naturally occurring amino acid
PYFLVRDDKIKNELLGLGISMQSFNGDLLYEPWEVYDENGLAFTTFNKYWEKCMKLPIEISPFLAPWXIENICSSSIDNLGLESSKDEESSNALLSRAWSPGWRNAEKTLEDFVSHGLLDYSKDRMKVTGTTTSLLSPYLHYGEVXLLGNLKHYPWRADEDRFKSWRQGMTGYPLVDAGMRELWATGWTHNRIRYIXSGCLPDGHELGRLDNPXGQKYDPDGEYVRTWIPELARMPGEWIHHPWDAPSSILEVAGVELGFNYPMPIVELHMARECLDDAISTMWQLDTAEKLAELDGEVVEDNLSHIKSFDVPKVVLKELSPSAPRCDQKVPTDNGRNLELQPKELKGTDKQTICVNVIKASKMEDSGSMANSPISRKRSSSGSVFNVPSYSSSVEVRSQNQHPGGYSVGSSGYIVQNAERNCVGKAEDDDSADSCTSAATTLKRPAA

SEQ ID NO: 6724 - protein, 207 aa, Fusarium culmorum
VAVKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKS

SEQ ID NO: 6725 - protein, 833 aa, Triticum aestivum
MLCLTASSSPSPSPSLPPRPSRPAADRPGPGISGGGNVRLSAVPAPSSLRWSWPRKAKSKFSVPVSAPRDYTMATAEDGFGDLPIYDLDPKFAGFKDHFSYRMKKYLEQKHSIEKYEGGLEEFSKGYLKFGINTENDATVYREWAPAAKDAQLIGDFNNWNGSGHRMTKDNFGVWSIRISHVNGKPAIPHNSKVKFRFHRGDGLWVDRVPAWIRYATFDASKFGAPYDGVHWDPPTGERYVFKHPRPRKPDAPRIYEAHVGMSGEKPEVSTYREFADNVLPRIKANNYNTVQLMAIMEHSYYASFGYHVTNFFAVSSRSGTPEDLKYLVDKAHSLGLRVLMDVVHSHASSNMTDGLNGYDVGQNTQESYFHTGERGYHKLWDSRLFNYANWEVLRYLLSNLRYWMDEFMFDGFRFDGVTSMLYNHHGINMSFAGNYKEYFGLDTDVDAVVYMMLANHLMHKILPEATVVAEDVSGMPVLCRSVDEGGVGFDYRLAMAIPDRWIDYLKNKDDLEWSMSAIAHTLTNRRYTEKCIAYAESHDQSIVGDKTMAFLLMDKEMYTGMSDLQPASPTIDRGIALQKMIHFITMALGGDGYLNFMGNEFGHPEWIDFPREGNNWSYDKCRRQWSLSDIDHLRYKYMNAFDQAMNALDDKFSFLSSSKQIVSDMNEEKKIIVFERGDLVFVFNFHPSKTYDGYKVGCDLPGKYKVALDSDALMFGGHGRVAHDNDHFTSPEGVPGVPETNFNNRPNSFKVLSPPRTCVAYYRVEEKAEKPKDEGAASWGKAAPGYIDVEATRVKDAADGEATSGSKKASTGGDSSKKGINFVFGSPDKDNK

SEQ ID NO: 6726 - protein, 123 aa, Zea mays
  misc_feature (21)..(21): Xaa can be any naturally occurring amino acid
AQYYQLILLVYEGYKNIVESXQYNATALNQGLDKTDKFNIESKDNGVPLLGLSLKDRSRHSEFEILDLLRRFGWIVPGYTKPPDAHHVTVLRLFIREDFSRTLTERLVLDIEKVLHELDALHA

SEQ ID NO: 6727 - protein, 865 aa, Triticum aestivum
MLCLTASSSPSPSPSLPPRPSRPAADRPGPGISVSHSGSSFLFFSFVSGLRSASRRFPDAMPRAQGGGNVRLSAVPAPSSLRWSWPRKAKSKFSVPVSAPRDYTMATAEDGFGDLPIYDLDPKFAGFKDHFSYRMKKYLEQKHSIEKYEGGLEEFSKGYLKFGINTENDATVYREWAPAAKDAQLIGDFNNWNGSGHRMTKDNFGVWSIRISHVNGKPAIPHNSKVKFRFHRGDGLWVDRVPAWIRYATFDASKFGAPYDGVHWDPPTGERYVFKHPRPRKPDAPRIYEAHVGMSGEKPEVSTYREFADNVLPRIKANNYNTVQLMAIMEHSYYASFGYHVTNFFAVSSRSGTPEDLKYLVDKAHSLGLRVLMDVVHSHASSNMTDGLNGYDVGQNTQESYFHTGERGYHKLWDSRLFNYANWEVLRYLLSNLRYWMDEFMFDGFRFDGVTSMLYNHHGINMSFAGNYKEYFGLDTDVDAVVYMMLANHLMHKILPEATVVAEDVSGMPVLCRSVDEGGVGFDYRLAMAIPDRWIDYLKNKDDLEWSMSAIAHTLTNRRYTEKCIAYAESHDQSIVGDKTMAFLLMDKEMYTGMSDLQPASPTIDRGIALQKMIHFITMALGGDGYLNFMGNEFGHPEWIDFPREGNNWSYDKCRRQWSLSDIDHLRYKYMNAFDQAMNALDDKFSFLSSSKQIVSDMNEEKKIIVFERGDLVFVFNFHPSKTYDGYKVGCDLPGKYKVALDSDALMFGGHGRVAHDNDHFTSPEGVPGVPETNFNNRPNSFKVLSPPRTCVAYYRVEEKAEKPKDEGAASWGKAAPGYIDVEATRVKDAADGEATSGSKKASTGGDSSKKGINFVFGSPDKDNK

SEQ ID NO: 6728 - protein, 810 aa, Triticum aestivum
MLCLTASSSPSPSPSLPPRPSRPAADRPGPGISAKSKFSVPVSAPRDYTMATAEDGFGDLPIYDLDPKFAGFKDHFSYRMKKYLEQKHSIEKYEGGLEEFSKGYLKFGINTENDATVYREWAPAAKDAQLIGDFNNWNGSGHRMTKDNFGVWSIRISHVNGKPAIPHNSKVKFRFHRGDGLWVDRVPAWIRYATFDASKFGAPYDGVHWDPPTGERYVFKHPRPRKPDAPRIYEAHVGMSGEKPEVSTYREFADNVLPRIKANNYNTVQLMAIMEHSYYASFGYHVTNFFAVSSRSGTPEDLKYLVDKAHSLGLRVLMDVVHSHASSNMTDGLNGYDVGQNTQESYFHTGERGYHKLWDSRLFNYANWEVLRYLLSNLRYWMDEFMFDGFRFDGVTSMLYNHHGINMSFAGNYKEYFGLDTDVDAVVYMMLANHLMHKILPEATVVAEDVSGMPVLCRSVDEGGVGFDYRLAMAIPDRWIDYLKNKDDLEWSMSAIAHTLTNRRYTEKCIAYAESHDQSIVGDKTMAFLLMDKEMYTGMSDLQPASPTIDRGIALQKMIHFITMALGGDGYLNFMGNEFGHPEWIDFPREGNNWSYDKCRRQWSLSDIDHLRYKYMNAFDQAMNALDDKFSFLSSSKQIVSDMNEEKKIIVFERGDLVFVFNFHPSKTYDGYKVGCDLPGKYKVALDSDALMFGGHGRVAHDNDHFTSPEGVPGVPETNFNNRPNSFKVLSPPRTCVAYYRVEEKAEKPKDEGAASWGKAAPGYIDVEATRVKDAADGEATSGSKKASTGGDSSKKGINFVFGSPDKDNK

SEQ ID NO: 6729 - protein, 157 aa, Triticum aestivum
MSLIPRGNAFDPFSLDLWNPFDGFPFGSGSSGGGGSLFPSFPRISSETAAFAGARIDWKETPEAHVFKADVPGLKKEEVEDGNVLQISGERNKEKEEKTDTWHRVERSSGKFLRRFRLPEDAKVEQIKAAMENGVLTVTVAKEEAKKPEVKSILISG

SEQ ID NO: 6730 - protein, 642 aa, Neurospora crassa
MFRTIRTLTPTTSVFPPTSLHFKLKTTMAPSKRKASAPPQTSHVNGNPSADKKRKTTTDAPPTNPNTSSDPLRAPHPFYKDSETHGIVLRKFYPHEMSNARAQAYNDNELPRPIETLSAALAETAALRKSLPVRQAVVHWFKMDLRLHDNRSLWLASQKAKEAGVPLICLYVLSPEDLEAHLRAPIRVDFMLRTLEVLKTDLEDLGIPLWVETVEKRKEVPTKIKELMKSWGASHLFCAMEYEVDELRREAKLVKLLAEGEKGEKMAADVVHDTCVVMPGALQSGSGGQYAVYSPWFRAWIKHIEENPECLEIYEKPGPNPPGTKEKHENLFACSIPEAPEGKRLRDDEKARYHSLWPAGEHEALKRLEKFCDEAIGKYAERRNIPAMQGTSNLSVHFASGTLSARTAIRTARDRNNTKKLNGGNEGIQRWISEVAWRDFYKHVLVHWPYVCMNKPFKPTYSNIEWSYNVDHFHAWTQGRTGFPIIDAAMRQVLSTGYMHNRLRMIVASFLAKDLLVDWRMGERYFMEHLIDGDFASNNGGWGFAASVGVDPQPYFRVFNPLLQSEKFDPDGDYIRKWVEELRDLPELKGGKGGEIHDPYGRGSEKVKKKLEEKGYPRPIVEHSGARDRALDAYKRGLARDL

SEQ ID NO: 6731 - protein, 407 aa, Zygosaccharomyces rouxii
MATHEEFIRTQVFGTVFEITNRYTDLNPVGMGAFGLVCSATDTLAGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKVHVHQFSIITDLLGSPPRDVIITICSEDTLKFVTSLPHRDPVPFQERFKAVEPDAVDLLGRMLVFDPKKRITAADALVHPYLAPYHDPTDEPIAEAQFDWDFNDADLPVDTWRVMMYSEILDFHKIGGSDGQIDTNAAFDDQVAAATAGPMLPLWLNSNININNSHPVNIQVQLLRHQQPRITVVYQ

SEQ ID NO: 6732 - protein, 777 aa, Actinobacillus pleuropneumoniae
MKTYTYSKQDLSFIEQLSQAYCKDPFSYLGLHQAGDVSVIRVFLPEATTVKILSAVGQILSEALKIDDSGLFVAQLAQQYSSLNYRLRVGYSLAEIDLEDPYRFTSSLLPMDNWLLAEGTHLRPYEILGAHLKTQEGVSGVHFSVWAPNARRVSVVGDFNYWDGRVNPMRFHAESGIWDIFLPNVEKGALYKFEILDSNGNIRLKSDPYAFASQFRPDTASVVTGLPEKIEVDAKLRHANDPDQPISIYEVHLGSWRRHLENNYWLNYEEIANELIPYVKDMGFTHIELLPITEYPFDGSWGYQPTGLYSPTSRFGSPEDLRTLIRKAHEAGINVILDWVVGHFPTDSHGLTEFDGSHLYEHQDPREGYHQDWNTLIFNYGRHEVFNYLSSNALYWTERFGIDGLRVDAVSSMIYRDYSRKDGEWIPNQYGGRENLEALDFLRRTNRMLKKEGHGAVVIAEESTSFAGITHSPEENGVGFDYKWNMGWMNDTLRYMSLDPIYRQYHHDWMTFGMMYQYSEKFVLPLSHDEVVHGKCSILGKMSGDCWQKFANLRAYYGYMWGYPGKKLLFMGNEFAQGREWNYNESLDWFLLGEQGGGWHKGVLNWVRDLNRTYQKYPALYQLDYDPAGFEWLVVDDWQQSVFAFERKAKNGESVIVVSNFTPVVRHNYRIGVRQDGTYTEILNSDAAYYEGSNVGNYGEIECEAIESHGKPFSIELSIPPLSTIFIACQPKPKEAVEAEQDIVKMAEVAMQKALKPTKKTVSVKAKAHKKAHKNKK

SEQ ID NO: 6733 - protein, 459 aa, Agrobacterium tumefaciens
MTDPQTLAARFPGDFLFGVATASFQIEGATKADGRKPSIWDAFCNMPGHVFGRHNGDIACDHYNRWEEDLDLIKEMGVEAYRFSIAWPRIIPDGFGPINEKGLDFYDRLVDGCKARGIKTYATLYHWDLPLTLMGDGGWASRSTAHAFQRYAKTVMARLGDRLDAVATFNEPWCAVWLSHLYGIHAPGERNMEAALAAMHHINLAHGFGVEASRHVAPKVPVGLVLNAHSVIPASNSEADLKAAERAFQFHNGAFFDPVFKGEYPAEMMEALGDRMPVVEAEDLAIISQKLDWWGLNYYTPMRVADDATPGAEFPATTPAPAVSEVKTDIGWEVYAPALKSLVETLYKRYDLPECYITENGACYNMGIENGEVNDQPRLDYYAEHLGIVADLIRDGYPMRGYFAWSLMDNFEWAEGYRMRFGLVHVDYDTQVRTLKNSGKWYSALASRFPKGNHGVVKG

SEQ ID NO: 6734 - protein, 642 aa, Debaryomyces hansenii
MVRMSSYDDDPIIEIFDNDNSDDIQVINRDNTQYDQNLMNSTGNTPHNYYNDIYDNSQHEHTQQNRQHQPQEQLSSLSSILQLQAETHSNQQEPSGLTPILSSNDYNQLTTVSQPKYTTSLPPLAPLSESVIPNNLNIPPTLSLPKASESQDKKTNTVTTTTKKRKEASSSKTRPAFVMKIWSMVNDPANHDYIRWNDNGKTFQVFHREEFMKLILPKYFKHNNFASFVRQLNMYGWHKVQDISNGTLNKDDKSNDEIWQFENPYFIRGREDLLDKIVRNKTISQESDHLEAGNLNFQSVLNELDQIKVNQFAIGEDLRRVRNDNKTLWQENFLTRERHQQQAQTLEKILKFLAAVYGNSAGKLLEVDNGSIGLDDFNSNNQMTTYNYQQPPQAHNQAPHQPIQVPSMTDQPSQPPSPFNRPRLMLMDQAYQKSPSNNPSPRETAQRNSNSGSIEEIIRSYENTPNDSPNSNVNKIYQQLMNNEPGVSSPRHYFPELNSQNNSYFGVPNTPGQQYIKSGTPLGSSNNTSEVMNGLEQNIFKQGQSIQQVQDWIQKLAAQQQQQQQQQQQLQNLQSLHQNHKQNSDDYEKPDIDEFDVNEFLDNSNASNSQASNSVNSDLNDASSNKRSIDEVNDGNAKRKKQ

SEQ ID NO: 6735 - protein, 476 aa, Borrelia garinii
MKNKFLICAYFLLTLSISSLVIVESIFAVDESNNNKLSRSSYEQMMIQAFEFVKENYVEPVNDEVIFEGALKGIFQALGDPYSQYLTKKDLEEISKTTVGDYVGIGISIIKKMHSQDKQDKAKNLDSNSFCVSIVTPFEGGPAYKAGIKSGDCIIAVDGKSVSSMEVDQVVDRLKGKEGTKVKVSILRGKDLTLDFELTREKIEIQTIKYDVINPDIGYIRIVSFNPYTSVDFSKALDNLKNRNIKSLILDLRLNTGGYFQAAIKMADDILSKGTIVSTKSRNSSKPIDYKASSKQVLPSDIKIVALIDRSSASASEVFVGALKDNKRAYIIGEKSYGKGVIQHVVPFYTGGFKITSSKYYTPSGKSIHKVGIEPDLEIKSPDFSEEEAVIYKEIFDKKLIEGFLKGKKSITEQEIDFFVENLVKENPKYKIDKEFLGKYVFFNYYQDNNKELPIYNLHYDKVLKAACEYLSKLGN

SEQ ID NO: 6736 - protein, 186 aa, Emericella nidulans
MSSTSPSKEPEVEQEPHSGEEHEQMDKEQDNQTQGQGEFEVKEQDRWLPIANVARIMKLALPENAKIAKEAKECMQECVSEFISFITSEASEKCQQEKRKTVNGEDILFAMTSLGFENYAEALKIYLSKYRETQSARGEHQNRPPSSGYAGGDPSAELPAALQSCVPGVLQLEAPSPKPLIMQAAL

SEQ ID NO: 6737 - protein, 249 aa, Unknown
  Synechococcus sp. CC9605
MHSSLHALPVLQDNVIWIWVRGAEAVVIDPAVAPPVRAWLEKRQLSLAAVLQTHHHADHIGGTPELLQRWPEAEVIASADDRERIPFQTMPVRGGDHVTVLGETVEVMDVAAHTRAHIAFFLPNPKGAEIRPLLFCGDTLFSGGCGRLFEGSAEQMHQALQKLAELPEATQVCCAHEYTEANLQWAVAQQPNNTVLVERYREVRSLRAKGELSLPSSIGLERRTNLFMQASSAAELGFLRSHKDQWRPT

SEQ ID NO: 6738 - protein, 514 aa, Aspergillus oryzae
MEDGTQVSTLERVVKEVQAPALQTPTDEQFWSPEDPSKPNLQFLKQHFYREGRLTEDQALWIIQAGTQLLKAEPNLLEMDAPITVCGDVHGQYYDLMKLFEVGGDPSETRYLFLGDYVDRGYFSIECVLYLWSLKIWYPNTLWLLRGNHECRHLTDYFTFKLECKHKYSERIYEACIESFCSLPLAAVMNKQFLCIHGGLSPELHTLEDIKSIDRFREPPTHGLMCDLLWADPLEEFGQEKTGDYFVHNSVRGCSYFFSYPAACAFLEKNNLLSIIRAHEAQDAGYRMYRKTRTTGFPSVMTIFSAPNYLDVYNNKAAVLKYENNVMNIRQFNCTPHPYWLPNFMDVFTWSLPFVGEKITDMLIAILNTCSKEELEDDTPTTFHYGPPSPPVPMDVESSEFKRRAIKNKILAIGRLSRVFQVLREESERVTELKTATGGRLPAGTLMLGAEGIKQAITNFEDARKVDLQNERLPPSSEEVYKRSEEERQAALERAQREADNDAGLATVARRISM

SEQ ID NO: 6739 - protein, 559 aa, Debaryomyces hansenii
MGNSPSKNDPLPTNSSANQTLNQSTSSNGELESDESIPPLSGLSGNKLNGSSKTSAIKIVNKNDNKFNSNYYNTNSNTPSSIYKKNGVQISPKKNSKSNGNHDLALDLEIGVSMAKLLSNSSPSAPGSNKLSLPSQQEYSSSFDSEKSEVSTVSPVFTTLGEYKDEDLLLSLGSSGPNDNFGVVKGDLDLDTIVEISLESTPEPRKVPDKSIDQPKKHLDTQISLTSSTSSLQSPVENSNVKRPQVNVDEIIDRLLEIGLKRPNNSSANSSRKNKDKLPLTSQEIKYVLNKSRSIFLDQPTLLRLSPPVKIVGDIHGQFHDLIRIFNSCGYPPYTNYLFLGDYVDRGYKSLETILLLLCYKIKYPENFFMLRGNHESANITKIYGFYDECKRRLPSISGNHKLWKTFVDVFNALPIAATINDKIFCIHGGLSPDLADLKQIENIKRPTDIPDNGLLADLLWSDPDPLIKNFSPTNWPKNDRGVSYCFGKKHVDYFCLKFKMDLIVRGHMVVEDGYEFFDKRKLVTVFLAPNYCGEFDNYGAIMSVDKSLCCSFELIKPQ

SEQ ID NO: 6740 - protein, 740 aa, Zea mays
MASEILGNVTEKAKDLAGSKSTKMAQLAEVTKDVHDDKWRITSDYGVKQNNTDDWLRVATDDQTGPLLLEDQFAREKIHRFDHERIPERVVHARGSGAFGKFTLFESASDVTSAGILTDTSRETPVFLRFSTVLGSRGSADTVRDVRGFAVKFYTEEGNWDIVGNNIPVFFIQDSMKFPDVIHAGKPEPDCEVPQAQSAHNNFWDFQYMHPEATHMFMWAMSDRTIPRSYRMMQGFGVNTYTLINAKGERHFVKFHFTPELGVHSFVWDEALKIAGQDPDFHRKDLWMAIDSGAYPKWKFGIQVIPEAKEHDFEFDILDATKVWPEELVPVRYIGELELNKNPDEFFTQTEQVAFCTSHIVPGIGFSNDPLLQGRNFSYQDTQLSRLGINWEELPINKPVCPVMNFNRDGAMRHTITKGKVNYWPNRFQTVPPATEKEGAYVEFPEKTAGMKVRMQSKKFREHKSQAELFYNSMSENEKMHMKAAFAFELDHCDDPVVYERLCERLCEIDLELAQSVAEMVGGEQPTKQTRPKHNKKAKGLSQMDFQPEKPTIATRMVAILIADGYDKAAYTGMKAALTAAGALPFTISPRRNKIFADGEDKSGSGVVADHHLEGQRSTMYDSVFVPGGAKSIETLSKNGRAVHWVREAFGHLKAIGGTGEAVSFIKQAVDLPGMEFSTSGDVVNSYGVVTATAVQPESFKEAVNMAKEAKDFVSAYMYAISQHKNFERETAGLNAMVAY

SEQ ID NO: 6741 - protein, 265 aa, Unknown
  Petunia x hybrida
MAQLRADDLSFIFGLLGNIVSFMVFLAPVPTFYKIYKRKSSEGYQAIPYMVALFSAGLLLYYAYLRKNAYLIVSINGFGCAIELTYISLFLFYAPRKSKIFTGWLMLLELGALGMVMPITYLLAEGSHRVMIVGWICAAINVAVFAAPLSIMRQVIKTKSVEFMPFTLSLFLTLCATMWFFYGFFKKDFYIAFPNILGFLFGIVQMLLYFVYKDSKRIDDEKSDPVREATKSKEGVEIIINIEDDNSDNALQSMEKDFSRLRTSK

SEQ ID NO: 6742 - protein, 341 aa, Aegilops tauschii
MERYEVIKDIGSGNFGVAKLVRDVRTKELFAVKFIERGHKIDENVQREIMNHRSLRHPNIVRFKEVVLTPTHLAIVMEYAAGGELFERICGSGKFNENEARFFFQQLLSGVSYCHSMQICHRDLKLENTLLDGSEAPRLKICDFGYSKSSVLHSQPKSTVGTPAYIAPEVLSRREYDGKVADVWSCGITLYVMLVGAYPFEDPDEPKNFRKTITRILSVQYSVPDYVRISMECRHLLSRIFVANPEQRITIQEIKNHPWFLKNLPIEMTDEYQMSLHMVGVNAPPQTLEEIMAIIQEARIPGDGSKFAGQLSVPGLGSMELDDIDDVDVDVEDSGDFVCAL

SEQ ID NO: 6743 - protein, 312 aa, Zea mays
MAESFVLNTGSRIPSVGLGVWQIQPDAANDAIYAAVKAGYRHIDCAAAYNNEEEVGLALKKLFEDGVVKRDDLFITSKLWAANHAPEDVEEGIDTTLQDLQLDYLDLYLIHGPIRIKKGTSTMTPENFLPTDIPATWAAMEKLYDSGKARAIGVSNFSCKKLHDLLAVARVPPAVNQVECHPVWQQDKLRKLCQSNGVHLSAFSPLGSPGSPWINGPSVLKNPIVVSVADKLQKTPAQVALRWGIQMGHSVLPKSANESRIKENIDIFGWSIPEDLMAKFSEIKQVRLLTAEFVVHPQAGYNTLEDFWDGEI

SEQ ID NO: 6744 - protein, 432 aa, Candida albicans
MTVPYQVKPSDEIKGAPEVSYYTPEQPVPAGTFYPQSSDEVAPKIFQPLKIGKLALPNRIGVSPMCQYSADYNFEATPYHLIHYGSLVNRGPGITIVESTAVSPEGGLSPHDLGIWKDEQAEKLKPIVDYAHSQKQLIAIQLGHGGRKASGQPLFLHLEQVADKSVNGFADKAVAPSALAFRPNGNLPVPNELTKDEIKRVVKDFGAAARRAVEISGFDAVEIHGAHGYLINEFYSPISNKRTDEYGGSFENRTRFLKEVIDSVKSSIPNDVPVFLRISAAENSPDPEAWTIEDSKKLADILVEKGIALVDVSSGGNDYRQPPRSGISKELREPIHVPLSRAIKQHVGDKLLVSCVGGLEKDPELLNKYLEEGTFDLALIGRGFLRNPGLVWEFADKLGVRLHQALQLGWGFWPNKQQIVDLIERTSKLEVN

SEQ ID NO: 6745 - protein, 309 aa, Apium graveolens
MAITLNSGFKMPVLGLGVWRMDRNEIKNLLLSAINLGYRHFDCAADYKNELEVGEAFKEAFDTDLVKREDLFITTKLWNSDHGHVIEACKNSLKKLQLEYLDLYLIHFPMASKHSGIGTTRSILDDEGVWEVDATISLEATWHEMEKLVEMGLVRSIGISNYDVYLTRDILSYSKIKPAVNQIETHPYFQRDSLIKFCQKYGIAITAHTPLGGALANTERFGSVSCLDDPVLKKLSDKHNKSPAQIVLRWGVQRNTIVIPKSSKTKRLEENINIFDFELSKEDMELIKTMERNQRSNTPAKAWGIDVYA

SEQ ID NO: 6746 - protein, 467 aa, Listeria innocua
MLYSENDKRKHESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKEMSYLGTSTVGSSEACMLGGLAMKFRWRNNAEKRGLDIQAKRPNLIISSGYQVCWEKFCVYWDVDMRVVPMDKEHLSLDVEKVFELVDEYTIGIVGILGITYTGKFDDIALLDEKVEAYNEANEHQLVIHIDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTALYLSKTVEKSGYFEIINDGSNLPIVCYKLKDDLDVEWTLYDLADQLLMKGWQVPAYPLPADLSDTIIQRFVCRADLGYNVAEEFAADFADALHNLEHARVLYHDKERNDSYGFTH

SEQ ID NO: 6747 - protein, 366 aa, Glycine max
MRRWLCCTCQVEESYPSNENEHLKSPRNYGDGNQKGSKVSAPVKPETQKAPPPIEAPALSLDELKEKTDNFGSKALIGEGSYGRVYYATLNNGKAVAVKKLDVSSEPESNNEFLTQVSMVSRLKDDNFVEMHGYCVEGNLRVLAYEFATMGSLHDILHGRKGVQGAQPGPTLDWIQRVRIAVDAARGLEYLHEKVQPPIIHRDIRSSNVLIFEDYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLGAVAALCVQYEAEFRPNMSIVVKALQPLLKSPAPAPAPVPES

SEQ ID NO: 6748 - protein, 548 aa, Escherichia coli
MAAKDVKFGNDAGVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTVAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATAVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 6749 - protein, 496 aa, Zea mays
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMEPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVKRFADSLGHPKVSQELRSIWIDLLAKCDASLGMKIATRLNMKPNM

SEQ ID NO: 6750 - protein, 596 aa, Debaryomyces hansenii
MHALFETDWFLDSKKYGTPCIPKSFNEFMYLVEINAFYTYNKLRDYINTYYINAYCGVWGYLAIIRDAVFIYLMYLYMSQMVVLIRGRGMIASIRIFIHAISKRGFQFLLSIPPIKKKIDQELSETTKKIEEELMQNDESLMQFKSLPEKGLDATIVKKELDRLQDLKHSDWYNGRVSGAVYHGGNELLDLQSDAYHKYSIANQLHPDVFPGIRKMESEIVSMVLRLFNAPEEGCGSTTSGGTESLLLAGLSAREYGKFYKNISNPEIIAPITIHAGIEKACYYFGMKLHKVDLDPVTFKVDVNKVKKLINGNTVLLVGSAPNFPHGIIDDIEALSNLAVKYKIPLHVDACLGSFIVSFLEKSKVHGDKPIPKFDFRLPGVTSISCDTHKYGFAPKGSSIVMYRNSKLRQCQYYILTDWTGGMYGSPTLAGSRPGALMAGCWATLVNFGEDNYAESCRTIVGASMKLKCAIKEHEMLSKYLEVIGDPIGSVVAFGVTKNYRSTLSIYKIGECLSSKGWHFSTLQNPAALHFALTRLTVPVIGELISDLVEVTSAALKDESNSESEIAALYGVAGSVKTTGVAERVVVAFLDTLYKI

SEQ ID NO: 6751 - protein, 351 aa, Passiflora edulis
QVSFDLLEAYLEQHPEASTWGNGAPGFRDNALFQDYHGLKSFRQAMASFMEQIRGGRAKFDPDRIVLTAGATAANELLTFILADPGDALLVPTPYYPGFDRDLRWRTGVKIVPIHCDSSNNFQVTPQALEAAYKNAEAMNLKVRGVLLTNPSNPLGATIQRSVLEEIFDFVTRKNIHLVSDEIYSGSTFSSAEFVSIAEILEARGYTEAERVHIVYSLSKDLGLPGFRVGTIYSYNDKVVTTARRMSSFTLISSQTQHPLACMLSNKEFAENYIKTNRERLRKRYDMIIQGLKDAGIECLKGNAGLFCWMNLSPLLETPTKEGELALWESIVHEVKLNISPGSSCHCSEPG

SEQ ID NO: 6752 - protein, 647 aa, Thermoanaerobacter tengcongensis
MSEFKFEKLLEPIQIGSMKLRNRIIMPPMVTNYAAEDGAVTERFKAYHQTRAKGGVGLIIVEATYIHPGGKGFQNQLGIYKDELISGLKELTEAVHKYGAKIAVQLYHAGRQTTLKVTGMQVVAPSPIPCPVKQEKPKELSVDEIKELIEAFGQAARRAKEAGFDAVEIHGAHGYLINQFLSPYSNKRTDEYGGSFENRMRFPLEVVRRVREEVGPDFPIIYRMSAEEYVPGGLTIEDTKIFAQKLVEEGIDALHISGGVYESSAMIIQPAAIPQGCFVENAAAIKKAINSKVPVIVVGRIKDPIMAEQIIREGKADLVSMGRALLADPELPRKVSEGKIEEIRKCIGCNQGCIDRLFQDIDIGCIANALTGHETEFDMESLAKTRKKVFIIGGGPGGLEAARVAALRGHEVILYEKQPELGGQMRIAAVPPHKGEINDLADYLINQVEKSGITIVKGKEADLNTIHEIKPDVVILATGSEPIIPEIPGINQKNVVTAHDVLKGTVTVGKKVAVIGGGLVGCETAEFLADQGKEVTVIEMLDDIAIDVGSLVRALLLNRMAEKKIKVLTKSKVKEISGDKVTIETVNGNQELSGIDTIVIAVGSKPKNDLLKLIEKEGIPVYAIGDCVKARKFMDAIHEGFRYAYSL

SEQ ID NO: 6753 - protein, 504 aa, Methanococcoides burtonii
MSDEKTSSLTTAFGIPVGDDQNSLTAGERGPVLIQDVHLLEKLGHFNRERIPERVVHAKGAGAGGYFEVTADVTKYTKAKFLSEIGKRTEVFARFSTVGGEKGSADAARDPRGFAIKFYTEDGNHDLTGNNTPVFFIRDPLKFPDFIHTQKRNPATNCKDPNMFWDFLSLTPESIHQVTILFSDRGTPATFRNMNGYSSHTYKWYNDKGEYFWVQYHFKTDQGTKTLTREEAEKLSGTDPDHAVRDLYDAIEKGDYPSWTLEMQIMTPEQAEEYRFDILDITKVWPHGDFPTIKIGKMVLNRNPTNYFAEVEQSAFSPGNLVPGIDISPDKMLQARVFSYHDSHVHRLGPNYHQIPVNAPKNAPETSYQRDGFMRIDANGGSGPNYWPNSFGGPAPDPDALKPPFEVSGKADRTPYVHSNDDFVQAGNLYRDVMDDQARENLVGNIISHLSGAQKRIQLRQTALFFKADPDYGGRVADGLGLDVKEIERLANMTQTERVKATEK

SEQ ID NO: 6754 - protein, 249 aa, Brassica napus
SVNKNPSKQRRFLLPNRERENTPTHASAQQQQSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIVLSVCGGFNCGK

SEQ ID NO: 6755 - protein, 565 aa, Saccharomyces cerevisiae
MKRTVISSSNAYASKRSRLDIEHDFEQYHSLNKKYYPRPITRTGANQFNNKSRAKPMEIVEKLQKKQKTSFENVSTVMHWFRNDLRLYDNVGLYKSVALFQQLRQKNAKAKLYAVYVINEDDWRAHMDSGWKLMFIMGALKNLQQSLAELHIPLLLWEFHTPKSTLSNSKEFVEFFKEKCMNVSSGTGTIITANIEYQTDELYRDIRLLENEDHRLQLKYYHDSCIVAPGLITTDRGTNYSVFTPWYKKWVLYVNNYKKSTSEICHLHIIEPLKYNETFELKPFQYSLPDEFLQYIPKSKWCLPDVSEEAALSRLKDFLGTKSSKYNNEKDMLYLGGTSGLSVYITTGRISTRLIVNQAFQSCNGQIMSKALKDNSSTQNFIKEVAWRDFYRHCMCNWPYTSMGMPYRLDTLDIKWENNPVAFEKWCTGNTGIPIVDAIMRKLLYTGYINNRSRMITASFLSKNLLIDWRWGERWFMKHLIDGDSSSNVGGWGFCSSTGIDAQPYFRVFNMDIQAKKYDPQMIFVKQWVPELISSENKRPENYPKPLVDLKHSRERALKVYKDAM

SEQ ID NO: 6756 - protein, 283 aa, Yersinia pseudotuberculosis
MQTVKLNNGIAMPLLGFGVFQMTNTAECERAVIDAIETGYRLIDTAASYQNETQVGNALKLSGIARDELFITTKLWLQDTSYEGAKAQFERSLNRLQLDYVDLYLIHQPYGDVHGAWRAMEELHQAGKIRAIGVSNFHPDRLADLMAFNKIIPAVNQIEVNPFNQQLHAVPWMQSRGIQPEAWAPFAEGRNGLFQNPVLTAIGEKYGKSVGQVVLRWIFQRGIVSLAKSVRKGRMEENINILDFELSAEDMLQIAALDTATSAFFSHRDPAMVEWLTGRKLDV

SEQ ID NO: 6757 - protein, 256 aa, Glycine max
MFSKLHSQHSQQPQPFQFSRECQSSKEDDIPSTCGLNLITAQKSGLSGDQNNETTSEIMRRPRGRPSGSKNRPKPPLIITCEPEPVMSPFILEIPGGSGVVEALARFSRRKNTGLCVLTGSGTVANVTLRQPSFTPAGASVATVTFHGRFNILSMSATFLHHGSPAAIPNALAVSLSGPQGQIVGGLVAGRLLAAGTVFVIAASFNNPSYHRLSSEEDAQNTSDGGGDRQSPAESSMYSCHRPSDVIWAPTPRPPF

SEQ ID NO: 6758 - protein, 77 aa, Zea mays
  misc_feature (55)..(55): Xaa can be any naturally occurring amino acid
  misc_feature (61)..(61): Xaa can be any naturally occurring amino acid
GMSGEKPAVSTYREFADNVLPRIRANNYNTVQLMAVMEHSYYASFGYHVTNFFAXSSRSGXPKGQNSWLKKEKFGFK

SEQ ID NO: 6759 - protein, 216 aa, Bartonella henselae
MVSFRTHIIPVTSFQQNCTLLFDNERKVGVLVDPGGDWLQIQDVIRKNGVIVEAIWITHGHFDHVGAAMQAKEALNVKIIGSHRDDKPVMDAVRESAESYGITDARICVPDQWLEDGDSVHFAGHVFRVYHTPGHSPGHVIYFNEKERFALLGDVLFRGSIGRTDFPFCSHKDLMKSLREKVLPLGDDVRFICGHGPGSYLGYERQWNPFLQGFHE

SEQ ID NO: 6760 - protein, 493 aa, Oryza sativa
MDSKSVIKKVLGIWYPYILKVAAAPVQEQEKCNGGGGGGFRGAAVRCHPALSTEKKASIRGVVGELLGAAAAAAGAGEERRRSLISLGVGDASSHACFRRGGEFAADAVADAARSGVFDCYAPSCGFPAARRWSNVSLFLEKVKLINIHICNSRAPETSAVADHLSAGARHRTRDADVFMTAGGTGAITAIATVLGGAPGANVLLPRPGFAPYEAACELAGAEPRFYDLLPRRGWEADLAGVRAMADGATAAIVVINPNNPCGAVYSAQHLFQIAETARELGIPIIADEVYAHMVFGGSKFVPMATFAHITPVITIGALSKKFMLPGWRLGWLAFCDPNGALKHVRNATEMLLNVTSGPASIVQAAVPKILSNEHNEFHRNVVNLLESAADALYRRVNQIEALQCYSKPHGSMFMMVEVNTSLLFGVEDDMDFARELIKEESVLVLPGSVIGLKNWIRIFFGAPTSVILEACDRIEAFCQKRAVQVKLLKKKF

SEQ ID NO: 6761 - protein, 382 aa, Zea mays
  misc_feature (74)..(74): Xaa can be any naturally occurring amino acid
MGRDKSRRLYGSRHFRQRLVLATLTSTAVTIEDIRSGDASPGLRPYEVSLLRLLDKISDHHTIDLNETGMDLPXTKLRYRPGVIIGGKGLEHDCGVHRGIGYFLEPLILLGLFSRAPISIRLKGITNDTKDPSVDTFRTTTLHMLKHFGVPLDGFNLNIDSRGSPPLGGGEVFLRVRNINSTLTAANWVDEGMVKRIRGVSFSTRVSPQLENRIIYAARGIFNRFIPDVHIHTDHRSGSAGGRSPGYGVSLVAETTTGCLLSVDVTVSYPSVDEINEESEKPELTSPEDLGVQAASMLLEEVAQGGVVDSTHQGLLFILCALCPPDVSKVRVGQLTPYGIETLRNIRDFLDVKFIIKPDPNSNTVTLKCVGAGVKNLARKIS

SEQ ID NO: 6762 - protein, 424 aa, Brucella suis
MVMVQGAPASTAFAAGKDSDVYKELALFGDIFERVRAQYVTPPDDKKLIESAINGMLTSLDPHSSYLNPEAAQDMRVQTKGEFGGLGIEVTMDNDLVKVIAPIDDTPASKAGVLSGDLITKIDGQEVRGLSLTDAVDKMRGEVGAPIELTILRKGADKPITLKINRAIIKVKAVRSRVENDVGYLRIISFTEQTSEDLKKAIKDIQEKVPADKLKGYVLDLRLNPGGLLDQAVAVSDAFLDKGEIVSTRGRDPQDVTRFDARKGDLTNGKPLIVLINGGSASASEIVAGALQDHRRATVLGTQSFGKGSVQTIIPLGENGSLRLTTALYYTPSGKSIQGKGITPDIKVDQPLPPELKGEDVVRGESELKGHIKGNAEDASGSGSSAYVPPDPKDDLQLNEALKLLRGEVPNAAFPPDPKKGVLN

SEQ ID NO: 6763 - protein, 356 aa, Unknown
  Acinetobacter sp. ADP1
MAELSSPLKIGAFEIKNRLVMAPLTRSRSGEDRIPNDLMLEYYQQRAGAGLILTEATVISPKAVGYEDTPGLWSEEQASAWHPIVDAVHQKGAKIVVQLWHVGRISDPQLLGGDIPVAPSAIQPEGHVSLLRPKRPFVTPRALSIEEIHEIVAQYQHAAELAKVAGFDGVELHAANGYLIDQFLQSGTNQRSDEYGGSLENRARLLLQVVDAFIDVWGAGRVGVHIAPRGDSHDMSDANPLETFGYVMRQLSERHIAFVFSREYEAADSISLQLRQKFNGVWIANENLSAESAKRILAQGDADAVSFGKAAIANPDLYERLIHNAPLNSVNPDTLYAKGAEGYTDYPTSQESALEA

SEQ ID NO: 6764 - protein, 462 aa, Arabidopsis thaliana
MSEEQPHANLAVPAFKTEKEPITQTRNGQSSVWRFGGSDKAAKASTVTLRGVIYMLFDNCGKDVNETILPLGHGDPSVYPCFRTCIEAEDAVVDVLRSGKGNSYGPGAGILPARRAVADYMNRDLPHKLTPEDIFLTAGCNQGIEIVFESLARPNANILLPRPGFPHYDARAAYSGLEVRKFDLLPEREWEIDLEGIEAIADENTVAMVVINPNNPCGNVYSHDHLKKVAETARKLGIMVISDEVYDRTIFGDNPFVSMGKFASIVPVLTLAGISKGWVVPGWKIGWIALNDPEGVFETTKVLQSIKQNLDVTPDPATIIQAALPAILEKADKNFFAKKNKILKHNVDLVCDRLKDIPCVVCPKKPESCTYLLTKLELSLMDNIKDDIDFCVKLAREENLVFLPGDALGLKNWMRITIGVEAHMLEDALERLKGFCTRHAKKTETETESLQALKLSDNNLEM

SEQ ID NO: 6765 - protein, 235 aa, Actinobacillus pleuropneumoniae
MLNITPIPALSDNYIWAIQKDNDVIIVDPSDAVPVLAFIAKNQLNLTAILLTHNHHDHTDGMPELLSRYPQLSVYGPQEVAQFANRIVQPEDHLTLFDYDVRVIESAGHTAQHVSYLFGNEYLFCGDALFSGGCGRVFTGNYQAQFDALQRFKALPEFVEIFPAHEYTLSNLKFAEAVLAPSCALFEIQERAEILRSRNQPTLPTTLERELQINPFLQAVDLDQFIALRHQKDNF

SEQ ID NO: 6766 - protein, 492 aa, Streptococcus mutans
LVRGVDILADTVKVTLGPKGRNVVLEKSFGSPLITNDGVTIAKEIELEDHFENMGAKLVSEVASKTNDIAGDGTTTATVLTQAIVREGLKNVTAGANPIGIRRGIETAVATAVDELKAIAQPVSGKEAIAQVAAVSSRSEKVGEYVSEAMEKVGNDGVITIEESRGMETELDVVEGMQFDRGYLSQYMVTDNEKMVADLENPYLLITDKKISNIQDVLPLLEEVLKTNRPLLIIADDVDGEALPTLVLNKIRGTFNVVAVKAPGFGDRRKAMLEDIAVLTGGTVITEDLGLELKDTTIDALGQAARVTVDKDSTVIVEGSGGKEAVANRVNLIKSQIETATSDFDREKLQERLAKLSGGVAVIKVGAATETELKEMKLRIEDALNATRAAVEEGIVAGGGTALINVIEKVAALDLTDDAATGRNLVLRALEEPVRQIAKNAGYEGSVIIDKLKNSSAGTGFNAANGEWVDMIDAGIIDPVKVTRSALQNAAS

SEQ ID NO: 6767 - protein, 480 aa, Bacteroides fragilis
MEDLNFRKGDAKTEAFGSNRMLQPSPVEKIPDGPTTPEIAYQMVKDETFAQTQPRLNLATFVTTYMDDYATKLMNEAININYIDETEYPRIAVMNGKCINIVANLWNSPEKDTWKTGALAIGSSEACMLGGVAAWLRWRKKRQAQGKPFDKPNFVISTGFQVVWEKFAQLWQIEMRQVPLTLDKTTLDPEEALKMCDENTICVVPIQGVTWTGLNDDVEALDKALDAYNAKTGYDIPIHVDAASGGFILPFLYPDTKWDFRLKWVLSISVSGHKFGLVYPGLGWVVWKGKEYLPEEMAFSVNYLGANITQVGLNFSRPAAQILGQYYQFIRLGFQGYKEVQYNSLQIAKYIHSQIAKMTPFVNYSEDVVNPLFIWYMKPEYAKNAKWTLYDLQDKLAQHGWMVPAYTLPAKLQDYVVMRVVVRQGFSRDMADMLLGDIKNAIAELEKLEYPTSTRIAQEKNLPVEAKVFNHTGKPQAAKK

SEQ ID NO: 6768 - protein, 246 aa, Prochlorococcus marinus
MEFNKEHKIIGIRVLRDNIIWLWKKNRSAVVIDPALSQPVKEYLKTNNLNLEAILQTHHHSDHIGGTRELIKEWPNVKVIASCKEKDRIPFQNSSVKDGDTLELLDEEVKVIEVIGHTRSHIAFYINNNVPILFIGDTLFSAGCGRIFEGTYKQMYYSLKRIKSLPKNTLIYCAHEYTKSNLLWALDLEPENQNIKNKLIEVEKKIALKELTIPCLLEEEMKINLFLRADNLKGFSFLRANKDSWV

SEQ ID NO: 6769 - protein, 492 aa, Streptococcus anginosus
MVRGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIETAVATAVEALKANSVPVSNKEAIAQVAAVSSRSEKVGEYISEAMEKVGNDGVITIEESKGMETELDVVEGMQFDRGYLSQYMVTDNEKMVADLDNPYILITDKKISNIQEILPLLENILKTSRPLLIIADDVDGEALPTLVLNKIRGTFNVVAVKAPGFGDRRKAMLEDIAILTGGTVITEDLGLELKDATIEALGQASKVTVDKDSTVIVEGSGDAEAIANRVAVIKSQIESSTSDFDREKLQERLAKLSGGVAVIKVGAATETELKEMKLRIEDALNATRAAVEEGIVSGGGTAFVNVLSAVEALDLSGDEATGRNIVLRALEEPVRQIALNAGFEGSIVIDRLKNSEAGTGFNAATGEWVNMIDAGIIDPVKVTRSALQNAAS

SEQ ID NO: 6770 - protein, 447 aa, Paenibacillus polymyxa
TIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQEGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRAIHDGLHVKGYMAWSLLDNFEWAEGYNMRFGMIHVDFRTQVRTPKQSYYWYRNVVGNNWLETRR

SEQ ID NO: 6771 - protein, 492 aa, Streptococcus oralis
MVRGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIEAAVAAAVEALKNNAIPVANKEAIAQVAAVSSRSEKVGEYISEAMEKVGKDGVITIEESRGMETELEVVEGMQFDRGYLSQYMVTDSEKMVADLENPYILITDKKISNIQEILPLLESILQSNRPLLIIADDVDGEALPTLVLNKIRGTFNVVAVKAPGFGDRRKAMLEDIAILTGGTVITEDLGLELKDATIEALGQAARVTVDKDSAVIVEGAGNPEAISHRVAVIKSQIETTTSEFDREKLQERLAKLSGGVAVIKVGAATETELKEMKLRIEDALNATRAAVEEGIVAGGGTALANVIPAVADLELTGDEATGRNIVLRALEEPVRQIAHNAGFEGSIVIDRLKNAEVGTGFNAATGEWVNMIEEGIIDPVKVSRSALQNAAS

SEQ ID NO: 6772 - protein, 734 aa, Nitrosomonas europaea
MKSLSSSSPGSSEDSAQSLLLTARLYDPCSFLGMHAAPNGRLIRVFQPYMSRVWLHTLSGYQPMRSVHQDGIFEWEGEGVMHPYLLRMENTATGVIEERHDPYAFPMQISGHDLYLFNEGRLLQAYHMLGAHRVRNHGVTGTRFAVWAPNAERVSVVGDFNRWDGRVYPMMVHGHSGVWELFIPDLPEGAIYKYEIRNRISGEILLKTDPYATTYELRPNNAALTPIEQKYDWKDDDWIARRKGWDWLHAPLNIYELHVGSWKRHPDGRFYSYHELADHLIPYLQDMGYSHVELLPISEHPLDESWGYQATGYFAVTSRYGSPEAFMSFVDRCHQAGIGVILDWVPAHFPQDSFSLARFDGTALYEHEDPRLGYHHDWGTYIFNYGRNEVKSFLLSSAHYWLSAFHIDGLRVDAVASMLYLNYSRKEGEWLPNRYGGHENLEAIEFLRALNTMVHGEFPGALTFAEESTSWPAVSRPAYLGGLGFSMKWNMGWMNDTLSYMQHDPVHRRYHHNELTFNQLYAYTENFVLPLSHDEVVHGKKSMLDKMPGDGWQKFANLRLLFTYQMTCPGKKINFMGNELGQGHEWRVGHELDWYLLERDPHRGIQALTRDLNHLYLNTPALHELDFFAEGFSWIDCHDVEQSVISYQRHARDGSFVLVVLNFTPILRTGYRVGIPGSSAYQEVFNSDSIYYDGSNAGNAGKISPTGQPWSGQPDSIIITLPPLAGVILKAADG

SEQ ID NO: 6773 - protein, 184 aa, Arabidopsis thaliana
MRTFSPKLLLLLLLVLRHHAESGSIVKFLPGFEGPLPFELETGYIGIAKYWANDERVREAMTRGYGSIGKWIRCNSNIHYDDDIISSIPYHMNNSINGYRSLIYSGDHDMEVPFLATEAWIRSLNYPIIDDWRPWIINNQIAGYTMTYANKMTYATIKASGHTAEYKPAESFIMFQRWISGQPL

SEQ ID NO: 6774 - protein, 637 aa, Passiflora edulis
MDSCDCIDTQWAHEGGILVKYQYISDVLIAFAYFSIPIELIYFVQKSAFFPYRWVLMQFGAFIVLCGATHFINLWTFSMHSKAVAVVMTVAKVSCAIVSCATALMLVHIIPDLLSVKTRELFLKNKAEELDREMGLILTQEETGRHVRMLTHEIRSTLDRHTILKTTLVELGRTLGLEECALWMPSRAGSTLQLSHTLNYQAQIGSSVSINIPEVNQVFNSARAMRIPYTCPLARIRPLVGRYLPPEVVALRVPLLHLSNFQINDWPDFSARSYAVMVLILPTDSARTWREHELELVEVVADQVAVALSHAAILEESMRARDQLMEQNVALKSARREAEMAIHARNDFLAVMNHEMRTPMHAIIALSSLLLETELTPEQRAMIETVLKSSNLLATLTNDVLDLSRLEDGSLELDVAMFNLHDIFREVINLIKPIASVKKLALTLTTTPDPPSFAVGDEKRLMQTILNVVGNAVKFTKEGSVSIIASVAKPDSLRDWRPPEFYPISTDGHFYLRIQVKDSGCGILPQDIPLLFTKFIRPQSGSNRGSSGAGLGLAICKRFVSLMGGHIWIESEGLNKGTVVTFIIKLGLCTNPEDLSMLQAASRRRANHGSVDLKGHKLLFRDNDGVPPPNPRYQRSF

SEQ ID NO: 6775 - protein, 158 aa, Brassica napus
  misc_feature (108)..(108): Xaa can be any naturally occurring amino acid
  misc_feature (120)..(120): Xaa can be any naturally occurring amino acid
MQYAKESIPLLTPYKMGRFNLSHRVVLAPLTRQRSYGNVPQPHAVLYYSQRTSPGGFLITEATGVSDTAQGYQDTPGIWTKEHVEAWKPIVDAVHAKGGVFFCQIWHXVGRVSNRGFQPXNGQAPISCSNKSLIPQARTESIKEVLFTPPRRLSTEEI

SEQ ID NO: 6776 - protein, 170 aa, Zea mays
  misc_feature (142)..(142): Xaa can be any naturally occurring amino acid
  misc_feature (154)..(154): Xaa can be any naturally occurring amino acid
YDKNLGRIEKWVLRKAFDDEEHPYLPQHILYRQKEQFSDGVGYNWIDGLKSFTEQQVTDEMMNSAAQMFPYNTPVNKEAYYYRIIFERLFPQDSARETVPWGPSIACSTPAAIEWVEQWKASNDPSGRFISSHDSAATDRTXTSWRWSTATGTXANGTVNGNDVAVAIAV

SEQ ID NO: 6777 - protein, 448 aa, Paenibacillus polymyxa
MTIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQEGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRTIHDGLHVKGYMAWSLLDNFEWAEGYNMRFGMIHVDFRTQVRTPKESYYWYRNVVSNNWLETRR

SEQ ID NO: 6778 - protein, 448 aa, Paenibacillus polymyxa
MSENTFIFPATFMWGTSTSSYQIEGGTDEGGRTPSIWDTFCQIPGKVIGGDCGDVACDHFHHFKEDVQLMKQLGFLHYRFSVAWPRIMPAAGIINEEGLLFYEHLLDEIELAGLIPMLTLYHWDLPQWIEDEGGWTQRETIQHFKTYASVIMDRFGERINWWNTINEPYCASILGYGTGEHAPGHENWREAFTAAHHILMCHGIASNLHKEKGLTGKIGITLNMEHVDAASERPEDVAAAIRRDGFINRWFAEPLFNGKYPEDMVEWYGTYLNGLDFVQPGDMELIQQPGDFLGINYYTRSIIRSTNDASLLQVEQVHMEEPVTDMGWEIHPESFYKLLTRIEKDFSKGLPILITENGAAMRDELVNGQIEDTGRHGYIEEHLKACHRFIEEGGQLKGYFVWSFLDNFEWAWGYSKRFGIVHINYETQERTPKQSALWFKQMMAKNGF

SEQ ID NO: 6779 - protein, 468 aa, Streptococcus gordonii
  misc_feature (230)..(230): Xaa can be any naturally occurring amino acid
  misc_feature (239)..(239): Xaa can be any naturally occurring amino acid
MTKSLPKDFIFGGATAAYQAEGATHTDGKGPVAWDKYLEDNYWYTAEPASDFYHKYPVDLKLAEEYGVNGIRISIAWSRIFPTGYGEVNPKGVEFYHNLFAECHKRHVEPFVTLHHFDTPEALHSNGDFLNRDNIEHFVDYAAFCFEEFPEVRYWTTFNEIGPIGDGQYLVGKFPPGIQYDLAKVFQSHHNMMVSHARAVKLYKDKGYKGEIGVVHALPTKYPYDPENPXDVRAAELEXIIHNKFILDATYLGHYSDVTLAGVNHILKVNGGQLDLRDEDFAALEAAKDLNDFLGINYYMSDWMRDFDGETEIIHNGKGEKGSSKYQIKGVGRRESPTHIPKTDWDWIIYPQGLYDQIMRIKKDYPNYKKIYITENGLGYKDEFVDNTVYDDARIDYVKQHLEVLSDAIADGANVKGYFIWSLMDVFSWSNGYEKRYGLFYVDFETQERYPKKSAHWYKKLAETQMIE

SEQ ID NO: 6780 - protein, 650 aa, Pseudomonas fluorescens
MTSAFPHLFQPLQIRGKRLKNRIMSSGHDTSMPTDNLVNEQLIAYHRARAEGGVGLIVLQVAGVHDSARYTSHVLMATDDACIDGYRRLAETCHAHGTVVLSQIFHPGREIMESADGLLAVAYAPSAVPNERFRVMPRALDQDMIDEIIQGYADAARRLHQAGLDGVELVASHGYLPAQFINPRVNRRTDGYNGELEQRLRFIREILGAMRASTDAEFIIGLRISADERDPEGLTEDESLAAVQLLQGQLDYVHIVAGTSASLGGAVHIVPPMAVEAAYLAREAGTFKAGLSIPLFVTGRINQPQEAEAIIAKGQADVCGMTRALICDPQMPNKSERGHSEDVRACIACNQACIGHFHKGLPISCIQHPETGRELLYGQPKPSARGKRILVVGGGPAGMKAAAVAAQRGHRVTLYEASAQLGGQIQLAQLLPRRSEFGGASTNLQREMQLAGVEVVRNTRVDRALIERENPDHVIIATGAQPYWPNFERGGDLQVVDAWQVLRDEVQLGRSVVVADWRCDWIGPGIAERLVRAGHQVQLAVNGTHCGENLPLYVRDQLAGELHKLAIPIIPYARLYGCDDSTVYLQHTASGEPMLLENVDSLVLCQGHQSVDDLGQQLKGLVPFQRIGDCLAPRTVEEAIHEGLKVAWAL

SEQ ID NO: 6781 - protein, 498 aa, Zea mays
LKDLAAIQQHHHQQQLAAAAADENMSNLTSASGDQASVSSHPVPPPAKKKRSLPGNPDPDAEVIALSPRTLMATNRYVCEVCGKGFQRDQNLQLHRRGHNLPWKLKQRNPKEVVRKKVYVCPEPGCVHHDPARALGDLTGIKKHFSRKHGEKKWKCDRCAKRYAVQSDWKAHSKVCGTREYRCDCGTLFSRRDSFITHRAFCDALAEESARAVTAAAAVAGQHHPGQAGMLFSQAAGGGDGGAGLHLPPGVLDPSQTLGGGHAHGMSFQELCLKREQQQQQQFAPSSWLTAQHHQQELELPGSAVFGLARPLDQQEYMGNSTTESTAGLSGFVGFSPSAAGGAAASAHMSATALLQKAAQMGATLSRPSNQGQMAGTHSSSTTNAGTGTANAAAAAASNVPGSGTGAGALGFGSPHHFGAEERTTRPADRDAGNGSGNAAAVAAGGGNEGLTRDFLGLRAFSHGDILSMAGFDPCMSSASPAAYEQGHHHPSSKQWHV

SEQ ID NO: 6782 - protein, 828 aa, Aspergillus oryzae
MTSNILQIPFRRSHTVSLSDAITQYISTKYDQRPDMFADDLLIIDRLRNEAIHVQEPHVSGISRLVTYAAQLKWLGGKFPVDIGVEFPWYPAFGFNTSRPISQNNIRFELANILFNLVALYSQLAFSVNRTTPDGLKQACNYLCQAAGVLAHLRADILPDLRASPPEDMDDMTLQSLEQLLLAQGQECFWQKAVKDGLKDASIARLAAKVSDFYAEGGDYAVQSNAISPEWIHHMTAKHHHFAAAAQYRQSLDCLEKRKYGEEVARLRDSEVCVNEALKESRWINRTVLGDLQGLKNRVTEDLKRAEKDNDVIYLNPVPPKSELKIIDRACMVAAKAPSQVTDAISMLGDNGPLGQPLFSKLVPYAVHIAASIYSDRRDRLVNETIIGELETMTDKLRDLLSSLNLPGSLQALEKPLGLPPTLVSHAEEMRQQDGLNRLRRSLEDTARVKANDKAAYNEGVELLAAEKAEDDSSRRKYGTDRWAREPSEAAASKLYTTAREIDGYFSSAQSSDNLVEQKLRDSEAVFRVLTGTNRDLEMYVPSSRRAAIPPEVERESIRLRGCLSEVSRLENRRKRRAQALKDKARTDDISKALLKEAARLEREFPMQAIQASQFEDLFEEQLHLYDTDLEMVTQEQHEQDQISAQVREANRAFTRAHTGDASTKEREKALQELENGYLKYKEIISNIEVGRKFYNDLAKIVGRFRDDCKAFVHQRRMEASQIEGDITSVAAMASLNLSQPHLRQYSQQPTQPAQPVQPAQPVQPPNQLPPQPQPVQHQPPRDEPLTAPQPTRANTRPSMAPGVWSPEMGIRFGAQGTWDPSKGVKFS

SEQ ID NO: 6783 - protein, 509 aa, Vicia faba
MDGSAGPGGGNVNAFLRNYKMGKTLGIGSFGKVKIAEHVLTGHKVAIKILNRRKIKNMEMEEKVRREIKILRLFMHHHIIRLYEVVETPTDIYVVMEYVKSGELFDYIVEKGRLQEDEARSFFQQIISGVEYCHRNMVVHRDLKPENLLLDSKWSVKIADFGLSNIMRDGHFLKTSCGSPNYAAPEVISGKLYAGPEVDVWSCGVILYALLCGTLPFDDENIPNLFKKIKGGIYTLPSHLSPGARDLIPRLLVVDPMKRITIPEIRQHQWFQLRLPRYLAVPPPDTLQQAKKIDEEILQEVVNRGFDRDQLVESLSNRVQNEGTVTYYLLLDNRYRVSTGYLGAEFQETMDPGLNRINSGEVVSPAGGHHFLAYQGVGMRQQFPAERKWALGLQSRAQPREIMVEVLKALQGLNVCWKKIGHYNMKCRWVVGIPGHQGGMVNNSVLNNNFLGNVGIIENEAVPKSSVVKFELQLYKTQEKYLLDLQRVEGPQFLFLDLCAAFLAQLRVL

SEQ ID NO: 6784 - protein, 509 aa, Pisum sativum
MDGSAGPGGGNVNAFLRNYKMGKTLGIGSFGKVKIAEHVLTGHKVAIKILNRRKIKNMEMEEKVRREIQILRLFMHHHIIRLYEVVETPTDIYVVMEYVKSGELFDYIVEKGRLQEDEARSFFQQIISGVEYCHRNMVVHRDLKPENVLLDSKWSVKIADFGLSNIMRDGHFLKTSCGSPNYAAPEVISGKLYAGPEVDVWSCGVILYALLCGTLPFDDENIPNLFKKIKGGIYTLPSHLSPGARDLIPRLLVVDPMKRITIPEIRQHQWFQLRLPRYLAVPPPDTLQQAKKIDEEILQEVVNRGFDRDQLVESLSNRVQNEGTVTYYLLLDNRYRVSTGYLGAEFQETMDPGLNRINSGEVVSPAGGHHFLGYQGVGMRQQFPAERKWALGLQSRAQPREIMVEVLKALQGLNVCWKKIGHYNMKCRWVVGIPGHQGGMVNNSVLNNNFLGNVGIIESEAVPKSSVVKFELQLYKTQEKYLLDLQRVEGPQFLFLDLCAAFLAQLRVL

SEQ ID NO: 6785 - protein, 125 aa, Triticum aestivum
  misc_feature (101)..(101): Xaa can be any naturally occurring amino acid
  misc_feature (107)..(107): Xaa can be any naturally occurring amino acid
  misc_feature (114)..(114): Xaa can be any naturally occurring amino acid
MMGRKALDYEELNENVKKVQYAVRGELYLRASELQKEGKRIIFTNVGNPHALGQKPLTFPRQVVALCQAPFLLDDPNVGLIFPADAIARAKHYLSLAPGGXGAYSDXRGILGVXREVPSYGVWFK

SEQ ID NO: 6786 - protein, 484 aa, Streptococcus intermedius
RRAILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIETAVATAVEALKANSVPVSNKEAIAQVAAVSSRSEKVGEYISEAMEKVGNDGVITIEESKGMDTELDVVEGMQFDRGYLSQYMVTDNEKMVADLDNPYILITDKKISNIQEILPLLENILKTSRPLLIIADDVDGEALPTLVLNKIRGTFNVVAVKAPGFGDRRKAMLEDIAILTGGTVITEDLGLELKDATIEALGQASKVTVDKDSTVIVEGSGDAEAIANRVAVIKSQIESVTSEFDKEKLQERLAKLSGGVAVIKVGAATETELKEMKLRIEDALNATRAAVEEGIVSGGGTAFVNVLDAVAALELEADEATGRNIVLRALEEPVRQIALNAGFEGSIVIDRLKNSEVGTGFNAATGEWVNMIEAGIIDPVKVTRYAL

SEQ ID NO: 6787 - protein, 476 aa, Streptococcus parasanguinis
LADTVKVTLGPKGRNVVLEKSFGSPLITNDGVTIAKEIELEDHFENMGAKLVSEVASKTNDIAGDGTTTATVLTQAIVREGIKNVTAGANPIGIRRGIETAVATAVEALKNNAIPVSSKEAIAQVAAVSSRSEKVGEYISEAMEKVGKDGVITIEESRGMETELEVVEGMQFDRGYLSQYMVTDNEKMVADLENPYILITDKKISNIQEILPLLESILQSNRPLLIIADDVDGEALPTLVLNKIRGTFNVVAVKAPGFGDRRKAMLEDIAILTGGTVITDDLGLELKDATIEALGQAAKVSVDKDSTVIVEGSGNPEAIANRVAVIKSQIETTTSEFDREKLQERLAKLSGGVAVIKVGAATETELKEMKLRIEDALNATRAAVEEGIVAGGGTALVNVISAVATLELEGDEATGRNIVLRALEEPVRQIAHNAGYEGSIVIDRLKNAEVGTGFNAATGEWVNMIDAGIIDPVKVT

SEQ ID NO: 6788 - protein, 472 aa, Guillardia theta
MNKLFSIKIGPYYLGKTLGVGSFGKVKLGEHELCGQKVAVKILNRKKIKNLKMEEKVKREICILKLFMHPHIIRLYEVIETPTDIFVVTEYITGGELFDYIVERGRLNEDESRKFFQQMISGIEYCHNHMVVHRDLKPENILLDAHLNVKIADFGLSNIMKDGNFLKTSCGSPNYAAPEVINGKSYLGPEVDVWSCGVIMYALLCGSLPFDDENIPNLFKKIKSGIYILPGYLSDLSRDMIAKMLITNPLLRITINEIRDHPWFNSRLPKYLSFPTFKKNFVIQKKLNIDDNILELVSNKTFLSKKYIKLGIMKHERNSTAIIYHLIRESITPFDMITVDNSYIRDIIKKENVIKKSNEKEHNTSLHQAFLGIESPRENLKDILNEIQRAIKTFRSKTHNLNHFSVIIVINTNSLFETKYKKKKEIILRTTTILIQIFKRSMKYLIDLQKINGDSFFFLSTCNFIKQELNLK

SEQ ID NO: 6789 - protein, 404 aa, Unknown
  Shewanella sp. ANA-3
MRPIIKSNKLDTVCYDIRGPVHKEARRLEDEGHRILKLNIGNPAPFGFEAPEEIVRDVILNLPSAQGYCESKGLFSARKAIVQHYQAQGIKGVDIEDVYIGNGVSELIMMAMQGLLNTDDEVLLPSPDYPLWTAAANLAGGKAVHYRCDEEADWFPDLDDIKSKISSRTRGIVLINPNNPTGAVYSKELLLQVIELCREHNLILFADEIYDKILYDEAKHIPAASLSDDILTVTFNGLSKAYRAAGFRVGWMMLSGNLKAAKSYIEGLEMLSSMRLCANVPNQHAIQTALGGYQSINELILPSGRLTVQRDTCYELLNQIPGVSVKKPKGALYAFPKLDMKKFNLRDDERLVLDLLRDKKILLVHGSAFNWPEPDHLRVVFLPYKEDLTKALTEFGNFLETYKQ

SEQ ID NO: 6790 - protein, 484 aa, Streptococcus sanguinis
GSSILANTVKVTLGPKGRNVVLEKSFGSPLITNDGVTIAKEIELEDHFENMGAKLVSEVASKTNDIAGDGTTTATVLTQAIVREGIKNVTAGANPIGIRRGIEAAVATAVEALKSNSVPVSNKEAIAQVAAVSSRSEKVGEYISEAMEKVGNDGVITIEESKGMETELDVVEGMQFDRGYLSQYMVTDNEKMVAELDNPYILITDKKISNIQEILPLLENILKTNRPLLIVADDVDGEALPTLVLNKIRGTFNVVAVKAPGFGDRRKAMLEDIAILTGGTVITDDLGLELKDATIEALGQASKVTVDKDSTVIVEGSGNPEAIANRVAVIKSQIESSTSEFDREKLQERLAKLSGGVAVIKVGAATETELKEMKLRIEDALNATRAAVEEGIVSGGGTAYINVLDAVAGLELAGDEGTGRNIVLRALEEPVRQIALNAGFEGSIVIDRLKNSEVGTGFNAATGEWVNMIEAGIIDPVKVTRSAS

SEQ ID NO: 6791 - protein, 340 aa, Unknown
  uncultured archaeon GZfos27B6
MIKIDGTYGEGGGQIIRTAIALAAITGEEVEIENIRANRPNPGLSAQHLHAVKAVAKLSGGRTEGRELRSTGLKFSPGALNGFEGEIDIGTAGSITLLLQCLIPVALFADSETKVKIKGGTDVKWSPPMDFYTEVFLKAIREMRCDVHLEVKKRGYYPKGDGLVEAKIAPSHQLKGIVLVESERTGEREGVVKGISHSCGLPAHVAERQAKAAEGVLNAAGYDSELKTEIDENGKRTTGCGITLWKGYKSGSALGERGKRAERVGEEAAGNIIKELASASTVDVYLADQLIPYIALADGKSEMKVREVTKHLETNVYVTKKFLDVEFEIEKKNGFFAIRR

SEQ ID NO: 6792 - protein, 272 aa, Unknown
  Bradyrhizobium sp. BTAi1
MLMIEANGARIPALGLGTWELRGRTCARIVEQALTLGYRHIDTAQVYENEQEVGEGLRASRVRRSELFLTTKVWTTHFAPNDLERSTKESLVRLRVSDVDLLLLHWPNSHVPLAETLGALAHAKTLGLTRHIGVSNFTVALLDEAVALSPEPLVCNQVEYHPYLEQTKIREACARHGIAMVAYSPIAKGKIRNDPTLTRIGHAHGKSPAQICLRWLVQQNVVAIPRTSKIERLSENLDVFDFELSEQDMTDIFAMGSAGGRMTDFAFAPKWD

SEQ ID NO: 6793 - protein, 385 aa, Burkholderia fungorum
MALSWWQIVLATLVSTHITIVSVTVYLHRCQAHRALDLHPLASHFFRFWLWMTTGIVTGKWAAVHRKHHAKCETQEDPHSPQFKGIWKVLLGGAELYRTEAKNGETLRRFGHGTPVDWMERNVYEKYPDLGVSLLMVIDILLFGVVGVSVWAIQMMWIPFWAGGVVNGLGHFWGYRNFGPPDASTNVFPIGILIGGEELHNNHHAYATSAKMSNRWYEFDIGWMYICVLSALGLAKVRKVALRPHLVKGKSVLDDETLQAVLRNRCEVMASYARTAEHAYRQELVRAKHMSRRERAALMRGVRKWFRDGQPAQDGARQPVPTELCDNHAKLLVYVELREDLAAIWERSNRSREQLLCQLEAWCRRAEQSRIDALREFSLRLRHYG

SEQ ID NO: 6794 - protein, 225 aa, Cucumis sativus
MGRGKIEIKRIENTTNRQVTFCKRRNGLLKKAYELSVLCDAEVALIVFSSRGRLYEYSNNSIKTTIERYKKACSDSSATSSVTELNTQYYQQESAKLRQQIQMLQNSNRHLMGDSLSALTVKELKQLENRLERGITRIRSKKHEMLLAEIEYLQKREIELENENVCIRTKIAEVERVQQANMVSGQELNAIQALANSRNFFSPNIMEPAGPVSYSHQDKKMLHLG

SEQ ID NO: 6795 - protein, 254 aa, Cucumis sativus
  misc_feature (202)..(202): Xaa can be any naturally occurring amino acid
MSCYEEEDEESGVVGLRRSSSSSRTGRGKIEIKRIENTTNRQVTFCKRRNGLLKKAYELSVLCDAEVALIVFSSRGRLYEYANNSVRATISRYKKAYSDPSTAMTVSEANTQFYQQESAKLRAQIGNLQNLNRHLLGESISSLSVKDLKSLEVKLEKGISRIRSRKNELLFSEIEYMQKREIELHTNNQLIRAKIAETERSXQNTNASNNNGIATRRGEEGSMGTNLEDNNHHQYDSTNYFDPHHNHPISLQLV

SEQ ID NO: 6796 - protein, 633 aa, Arabidopsis thaliana
MAAPIRFFELNTGAKLPCVGLGTYAMVATAIEQAIKIGYRHIDCASIYGNEKEIGGVLKKLIGDGFVKREELFITSKLWSNDHLPEDVPKALEKTLQDLQIDYVDLYLIHWPASLKKESLMPTPEMLTKPDITSTWKAMEALYDSGKARAIGVSNFSSKKLTDLLNVARVTPAVNQVECHPVWQQQGLHELCKSKGVHLSGYSPLGSQSKGEVRLKVLQNPIVTEVAEKLGKTTAQVALRWGLQTGHSVLPKSSSGARLKENLDVFDWSIPEDLFTKRSFAELLSLRMRHTASIRPLRNCGTLVPSAVCVEQPPPHLIMANAITFFKLNTGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSAYSPLGSPGTTWLKSDVLKNPILNMVAEKLGKSPAQVALRWGLQMGHSVLPKSTNEGRIKENFNVFDWSIPDYMFAKFAEIEQARLVTGSFLVHETLSPYKSIEELWDGEI

SEQ ID NO: 6797 - protein, 395 aa, Schizosaccharomyces pombe
MTIVNEGAENVGYFTPAQKIPAGAAIGVPQTKLFTPLKIRGVEFHNRMFVSPMCTYSADQEGHLTDFHLVHLGAMGMRGPGLVMVEATAVSPEGRISPNDSGLWMESQMKPLRRIVEFAHSQNQKIGIQLAHAGRKASTTAPYRGYTVATEAQGGWENDVYGPNEDRWDENHAQPHKLTEKQYDELVDKFVVAAKRAVEIGFDVIEIHGAHGYLISSTVSPATNDRNDKYGGTFEKRILFPMEVVHSVRKAIPDSMPLFYRVTATDWLPKGQGWEIEDTVALAARLRDGGVDLIDVSSGGNHKDQRIEVKDCYQVPFAEKIKDQVNGILLGAVGMIRDGLTANEILESGKADVTFVAREFLRNPSLVLDSANQLGENVAWPVQYDYAVKGHRKLR

SEQ ID NO: 6798 - protein, 237 aa, Cucumis sativus
MFQNQEEKMSDSPQRKMGRGKIEIKRIENTTNRQVTFCKRRNGLLKKAYELSVLCDAEVALIVFSSRGRLYEYANNSVKATIDRYKKASSDSSNTGSTSEANTQFYQQEAAKLRVQIGNLQNSNRNMLGESLSSLTAKDLKGLETKLEKGISRIRSKKNELLFAEIEYMRKREIDLHNNNQMLRAKIAESERNVNMMGGEFELMQSHPYDPRDFFQVNGLQHNHQYPRQDNMALQLV

SEQ ID NO: 6799 - protein, 347 aa, Schizosaccharomyces pombe
MKKDLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 6800 - protein, 430 aa, Yersinia pestis
MASEYIEHLAVFHAEDTLLPAKGSFFMSPIEKSSKLDNVCYDIRGPVLKEAKRLEEEGNKVLKLNIGNPAPFGFDAPDEILVDVIRNLPTAQGYCDSKGLFSARKAIMQHYQARNIRDLTVEDIYIGNGVSELIVQSMQALLNLGDEMLVPAPDYPLWTAAVSLSSGKAIHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 6801 - protein, 672 aa, Shewanella oneidensis
MSFPHLLEPLDLGFTQLKNRVLMGSMHTGLEEEKGGFEKLAAFYKERALGGVGLIVTGGISPNLRGRLTPHACQLSFPWQVGKHRIVTQAVHEAGGKICMQILHAGRYGYHPFSQAPSKIKSPITPFTPSAMSSRQVRGTIKDYASSAALAKRAGYDGVEVMGSEGYLINQFISSRTNTRTDEWGGSFEKRAQFPIEIVNAIRAKVGKDFIIIFRLSMLDLVDNGSTWDEVVQLAKWLEHAGVSIINTGIGWHEARVPTIATSVPRGAFAWVTQKLKQSVAVPLIATNRINTPEIGEQIIASGQADMVSMARPFLADPEFVNKAAANTPELINTCIGCNQACLDHTFSLKRATCLVNPRACYETEINFLPTSKKKRIAVMGAGPAGMAFSVYAAMRGHEVVLFEAKSEVGGQFNLARKIPGKEEFNETIRYFLNQIKLHKIDLRLNTRLDAKVLETEKFDEIVIASGVVPRELSLPGFDSPKVVDYQQVLTGQALVGGKVALIGAGGIGFDMAHYLCESESSTLNPDKWLKQWGIDKQYQHAGGLTQPEVENTDHRQVYLLQRKTSKMGQGLGKTTGWIHRLVLKQHDVKMKMGVSYEKFDDAGLHIRVGEQVEVLAVDNVILCAGQESNRTLVDEMKASGIPVHLIGGVDVAAELDAKRAIRQGAELAMRL

SEQ ID NO: 6802 - protein, 438 aa, Zea mays
MEDSATNGHGVVTAVPASWNFEPNETLLGLPALSVRGVLTRVMAGMLPDGGRAVVRLGSGDPTAFPCFRTAPEAVDAVASAVQSGQYNSYSTSVGLEPARRSIAQYLSCDLPYKLSPDDVYLTSGCTQAIEILCSALARPGANILLPRPGFMFYEARAIFNGMEARYFNLLPGNGWEVDIDGVQALADKNTVAMVIVNPGNPCGNVYSYEHLAKASSDMLLLVAETARKLGIFVIADEVYAHLTFGERKFVPMGVFGAVAPVLTLGSISKRWMVPGWRLGWIVTNDPNGVFQRTKVVHSIKSYLDISSDPATFVQGAIPKLVENTKEEFFEKTIEILKRCVDICCEKLKGINAITCPSKPEGSMFVMVKLDLSCLEGIKDDMDFCCRLAKEELVVVLPGCAVGYKDWLRITFAIDPSSLEEGLDRLKSFCLRYRKPTK

SEQ ID NO: 6803 - protein, 459 aa, Unknown
  Agrobacterium sp. ATCC 21400
MTDPNTLAARFPGDFLFGVATASFQIEGSTKADGRKPSIWDAFCNMPGHVFGRHNGDIACDHYNRWEEDLDLIKEMGVEAYRFSLAWPRIIPDGFGPINEKGLDFYDRLVDGCKARGIKTYATLYHWDLPLTLMGDGGWASRSTAHAFQRYAKTVMARLGDRLDAVATFNEPWCAVWLSHLYGVHAPGERNMEAALAAMHHINLAHGFGVEASRHVAPKVPVGLVLNAHSAIPASDGEADLKAAERAFQFHNGAFFDPVFKGEYPAEMMEALGDRMPVVEAEDLGIISQKLDWWGLNYYTPMRVADDATPGVEFPATMPAPAVSDVKTDIGWEVYAPALHTLVETLYERYDLPECYITENGACYNMGVENGQVNDQPRLDYYAEHLGIVADLIRDGYPMRGYFAWSLMDNFEWAEGYRMRFGLVHVDYQTQVRTVKNSGKWYSALASGFPKGNHGVAKG

SEQ ID NO: 6804 - protein, 390 aa, Thiobacillus denitrificans
MQSGLLDLPWWGLVLVTLGLTHVTIAAVTIYLHRSQAHRSVDLHPVVSHFFRFWLWLTSGMVTREWVSIHRKHHAKCETPEDPHSPQTRGLKKVFWEGSELYRAEAKVAETLEKYSHGTPDDWVERNVYSRHSAKGIFLMMAIDLALFGPIGLTIWAVQMAWIPITAAGIINGVGHYWGYRNFACEDASTNILPWGILIGGEELHNNHHAYGTSARLSNKWYEFDIGWLYIKLMSYAGLATVRKVAPTVKWQAPKPLCDLDTLQAIITHRYDVMSRFVKSVRAESAAEIAKLRAGANLPQNWNFDSFRRWLHKEPAELAADDRAALDTLLGRSERLQTVYRMRQELAAIWGRSTASREQLLEQLQAWCKRAEESGIQSLRDFSVRLRCYA

SEQ ID NO: 6805 - protein, 257 aa, Nostoc punctiforme
MQVIRLEALSDNYIFLLYDDKRNIAAVVDPAEAQPVLKKLAELKADLVAIFNTHHHNDHVGGNKQLIEKFPQLIVYGGAEDRGRIPGQKVFLQQGDRVEFADRIAEVIFVPGHTRAHIAYYFPPQEASETGDLFCGDTLFSGGCGRLFEGTPTQMVDSLSKLRSLPDNTRIWCAHEYTLKNLQFALTVDGDNADLQRRFNEVKAYRSRGEATIPSLLGVEKHTNPFLRWDQASLQSTVKSSDGVQTFARIREMKNNF

SEQ ID NO: 6806 - protein, 405 aa, Zea mays
TSESVAIKVIDKDKIKKCGLMDQIIQEISVMKLVKHPNIVQLYEVMATKTKIYFVIEYVKGGELFKKVQRGRLKEDVARAYFQQLISAVDFCHTRQVYHRDLKPENLLLDGSRNLKISDFGLSALPNCKRKDGLLHTICGTPAYVAPEVISQKGYDGAKADIWACGVILYVLLAGYLPFQDKNMMDMYKKIFKAELKWPSWFSSDVRKLLRRILHPNPNRRISIEEIRTHPWFRIGLDARLFDSTTRDYVPSDMDLALNSLNSNMVECNSAAEKLTILNAFDIISLSNGFDLSGIFENSNKVSKFTSTNTAMTIITKLMEVAKSLDLKVITKTGGLLNMEAAESGIKGVMSINAEIFQITPNYHLVEIKKINGDILEYHNFMNQSMRPALEDIVWAWHGEQPDEK

SEQ ID NO: 6807 - protein, 488 aa, Streptococcus pneumoniae
RGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIETAVAAAVEALKNNAIPVANKEAIAQVAAVSSRSEKVGEYISEAMEKVGKDGVITIEESRGMETELEVVEGMQFDRGYLSQYMVTDSEKMVADLENPYILITDKKISNIQEILPLLESILQSNRPLLIIADDVDGEALPTLVLNKIRGTFNVVAVKAPGFGDRRKAMLEDIAILTGGTVITEDLGLELKDATIEALGQAARVTVDKDSTVIVEGAGNPEAISHRVAVIKSQIETTTSEFDREKLQERLAKLSGGVAVIKVGAATETELKEMKLRIEDALNATRAAVEEGIVAGGGTALANVIPAVATLELTGDEATGRNIVLRALEEPVRQIAHNAGFEGSIVIDRLKNAELGIGFNAATGEWVNMIDQGIIDPVKVSRSALQDA

SEQ ID NO: 6808 - protein, 679 aa, Pseudomonas aeruginosa
MTAAVPYPHLLAPLDLGFTTLRNRTLMGSMHTGLEEKPQGFERMAAYFAERARGGVGLMVTGGIGPNEEGGVYSGAAKLSTPEEAEKHRIVTQAVHEAGGKICMQILHAGRYAYSPKQVAPSAIQAPINPFKPKELDEEGIEKQIADFVNCASLAQVAGYDGVEIMGSEGYFINQFLVQHTNQRTDRWGGSYENRMRLPVEIVRRVREAVGPNFIIIYRLSMLDLVEGGSSWDEIVLLAKAVEKAGATLINTGIGWHEARIPTIATKVPRAAFTKVTAKLRGEVGIPLITTNRINTPEVAEKVLAEGDADMVSMARPFLADPDFVNKAAAGHAERINTCIGCNQACLDHTFGGKLTSCLVNPRACHETELNYIPTARPKKIAVVGAGPAGLAAATVAAERGHRVSLFDAAGEIGGQFNVAKRVPGKEEFHETLRYFRNKLESTGVELHLNRRVGVDDLVAGGYDEIVLATGIVPRTPAIPGIEHPKVISYLDAILERKPVGGKVAVIGAGGIGFDVSEFITHAGPSTSLEREAFWKQWGIDTRLEARGGIAGVKAEVHPAARQVFLLQRKKSKVGDGLGKTTGWIHRAGLKNKQVQMVNAVEYLGIDDAGLHIRVAEGEPQVLPVDTVIVCAGQDPLRELQDGLLAAGRSVHLIGGADVAAELDAKRAINQGSRLAAEL

SEQ ID NO: 6809 - protein, 701 aa, Xanthomonas oryzae
MAKSSGKPASAVSVDRSASAPDARGTGDELHQKARGRHPQLTTNQGIPVGDNQNSLRATPRGPTLLEDFILREKITHFDHERIPERIVHARGSASHGYFKLTKSLSQYTTAKIFTEVGEKTPLFTRFSTVAGGAGSVDTPRDVRGFAVKFYTKEGNWDLVGNNIPVFFIQDAIKFPDLIHAVKMEPDRGFPQAASAHDTFWDFISLTPESMHMIMWAMSDRTIPRSLRMIEGFGIHSFRFLNDKGESTFVKFHWRPKLGLQSTIWDEAVKIAGADQDFPPRDLFEAIQNGDFPEWELGVQLFTEAEADAFPFDHLDSTKIIPEELVPLQIVGRMVLDRWPDNFFAETEQVAYCPANIVPGIDFSNDPLLQGRLFSYLDTQLSRLGGPNFHQIPINAPKCPFANNQRDGHMQMDVPKARVAYEPSLLQADAPREALRGFPSHSTPAEDGAKGRVRAERFADHYSQARLFFRSQTAPEQAHMASALVFELSKVETAHVREAIVGHLRHIDQKLAQRVADGMGMTTLPPAPPAAVAPIDMPLSPALQVIGKMKDTLKGRTVGILIHDGSDASTIKAVRKAAEAEGATVKIVAPKLGGAKLSDGKQLAADGQLAGTPSVVFDAVAVLLSSEAAKLLTRESAALDFVSCAWAHLKAIAFDEGAQLLLKAGNIGKDAGVVPAADTKAFISAAKTRQWAREPKVRMLA

SEQ ID NO: 6810 - protein, 244 aa, Zea mays
MGRGRVELKRIENKINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFHPLEAAAEPTLQIGFAPEHMNNFMPAWLP

SEQ ID NO: 6811 - protein, 433 aa, Oryza sativa
KMLEEFVSHGLLEYSKHGMKVEGATTSLLSPYLHFGEVSVRKVYQLVRMQQIKWENEGTSEAEESIHFFMRSIGLREYSRYLCFNFPFTHEKSLLGNLKHYPWKVDEERFKSWRQGMTGYPLVDAGMRELWATGWTHNRIRVIISSFAVKFLLIPWTWGMKYFWDVLLDADLESDILGWQYISGSLPDGHELSRLDNPEVQGQKYDPDGVYVRTWIPELARMPTEWIHHPWDAPSCILEVAGVELGFNYPKPIVDLHIARECLDDSISTMWQLDTAEKLAELDGEVVEDNLSNIKTFDIPKVVLRETSPCALPIDQRVPHASSKDHNLKSKVLKASNRSSICVDMIRSSKMEATSSVANSPVSRKRSFCETAFHVPSYSSSAEVHSHIQDHGGSLVGPSRYLLQEAGRNCVDEVEDSSTADSGSSISRQRKAA

SEQ ID NO: 6812 - protein, 415 aa, Streptomyces coelicolor
MRRIVYLGGLTPRGVPERTLSPHLRSRAEVGPILVRDVLHYLAGAATMPDDIDRAFDVGGPDVPTYREMMRRHATVSGLRRRIIVPAPVLTPGLSSHWVGLVTPVPASIARPLTESLRHEVVCQEHDIARYVPDAPGRPLPFDVALTLALRRVREAQVATRWSSASVPGAPSDPLPTDPDWAGGSLYEDERHLPVDASPEALWKVVEGIGGDNGWYSFPPAWAVRGWLDRFVGGVGLRRGRRDAQRLHPARPVAWRGGRRRGHRRLAGRTGYPVVDAAMRQLRHQGWMHNRARLLVASFLTKTLYVDWRIGARHFLDLLVDGDVVNNQLNWQWAAGTGTDTRPHRVLNPLVQARRFDPDGVYVRRWVPELRSVEGGKVHEPWRLAAAERGELDYPDPLVELADGLARFKHARGRD

SEQ ID NO: 6813 - protein, 177 aa, Glycine max
  misc_feature (125)..(125): Xaa can be any naturally occurring amino acid
  misc_feature (169)..(169): Xaa can be any naturally occurring amino acid
MASSMISSPAVTTVNRAGAGMVAPFTGLKSMAGFPTKKTNNDITSIASNGGRVQCMHVWPPFGKKKFETLSYLPDLDDAQLAKEVQYLLKKGWIPCLKFKLKHNFMYHEHNKSPKYYDKHYCTIXNLPIFNYTDTSQVFKELQHANTTYPNNFIHIIIFDNVQQVHDIXFHHYEPQS

SEQ ID NO: 6814 - protein, 651 aa, Oryza sativa
MAGSERTVVWFRRDLRIDDNPALAAAARDGVVLPVFIWCPADEGQFYPGRCSRWWLKQSLPHLSQSLESLGCPLVLIRAESTLEALLRCIDSVGATRLVYNHLYDPVSLVRDDKIKKELSALGISIQSFNGDLLYEPWEIYDDSGLAFTTFNMYWEKCMELPIDISPSLAPWKLVPAPGLESVRSCSVDDLGLESSKDEESSNALLRRAWSPGWRNAEKMLEEFVSHGLLEYSKHGMKVEGATTSLLSPYLHFGEVSVRKVYQLVRMQQIKWENEGTSEAEESIHFFMRSIGLREYSRYLCFNFPFTHEKSLLGNLKHYPWKVDEERFKSWRQGMTGYPLVDAGMRELWATGWTHNRIRVIISSFAVKFLLIPWTWGMKYFWDVLLDADLESDILGWQYISGSLPDGHELSRLDNPEVQGQKYDPDGVYVRTWIPELARMPTEWIHHPWDAPSCILEVAGVELGFNYPKPIVDLHIARECLDDSISTMWQLDTAEKLAELDGEVVEDNLSNIKTFDIPKVVLRETSPCALPIDQRVPHASSKDHNLKSKVLKASNRSSICVDMIRSSKMEATSSVANSPVSRKRSFCETAFHVPSYSSSAEVHSHIQDHGGSLVGPSRYLLQEAGRNCVDEVEDSSTADSGSSISRQRKAA

SEQ ID NO: 6815 - protein, 548 aa, Buchnera aphidicola
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILVADKKISNVREMLPILESVAKSGKPLLIISEDLEGEALATLVVNSMRGIVKVAAVKAPGFGDRRKAMLQDISILTGGSVISEELAMELEKSTLEDLGQAKRVVISKDTTTIIGGVGEKHTIQSRISQIRQEIQEATSDYDKEKLNERLAKLSGGVAVLKVGAATEVEMKEKKARVEDALHATRAAVEEGVVAGGGVALVRVAGKTSNLRGQNEDQNVGIRVALRAMEAPLRQIVSNSGEEPSVVTNNVKDGKGNYGYNAATDEYGDMIDFGILDPTKVTRSALQYAASVAGLMITTECMVTDLPKEDKSSDSNSSPAGGMGGMGGMM

SEQ ID NO: 6816 - protein, 214 aa, Cytophaga hutchinsonii
MSKTWEKIFYVGCFIAQGSSYISANAYGKLHRLHHAHTDTPEDPHSPQNSSNALMMMWETRNNYIDVYTGKTPVDERFTKNLPDWPVFEKYAHTFYTRFAWIFLYVLFYVEFATAWWMFLFLPVTILMGSIQGVAVNWWAHKFGYVNCKVNNTSKNILPIDVIFWGESFHNNHHANPQNPNNSIKWFEFDSGYQMMRFLNMMRIIKLKPYYSVL

SEQ ID NO: 6817 - protein, 499 aa, Zea mays
MEGAGKDGNPLRNYRIGKTLGIGSFGKVKIAEHISTGHKVAIKILNRRKIRGMEMEEKVKREIKILRLFMHPHIIRLYEVIDTPADIYVVMEYVKCGELFDYIVEKGRLQEEEARRFFQQIISGVEYCHRNMVVHRDLKPENLLLDSKCNVKIADFGLSNVMRDGHFLKTSCGSPNYAAPEVISGKLYAGPEVDVWSCGVILYALLCGTLPFDDENIPNLFKKIKGGIYTLPSHLSGAARDLIPRMLVVDPMKRITIREIREHDWFKILLPRYLTVPPPDSAQQVKKVDEETLREVLGMGYDKNLLVESIQKRLQNEATVAYYLLLDNRLRTTSGYLGAECQEAMDSSFSNIASYETPSSARGNRQQIFMESPVGLRPHLPAERKWALGLQSRAHPKEIMSEVLKALQELNVYWKKIGHYNMKCRWSPGFPAQIHNNHNFSAGSIETDSLSERLSLIKFEIQLYKTRDEKYLLDLQRVSGPQLLFLDLCAAFLTQLRVL

SEQ ID NO: 6818 - protein, 561 aa, Bacteroides fragilis
MKKFLNRRNGVLLAAVLVAVAFFSFKSGDDRNFQIAKNLDTFNSIVKELDMFYVDTLDPNKTVREGIDYMLSSLDPYTEYYPEDDQAELQQMLNASFGGIGSLITYNQKLKRSMIAEPFEGTPAAKVGLKAGDILMEIDGKDLAGKNNQEVSQMLRGAVGTSFKLKVERPDEKGGTRPLEFDIVRQTIQTPMIPYDTIFNKNVGYINLSTFSGTPSKDFKKTFLKLKKEGITSLVIDLRGNGGGRLEEAVEIANFFLPRGKVIVTTKGKTKQASNTYKTLREPLDLDIPITVLVNGATASASEILSGAFQDFDRAVIVGSRTFGKGLVQTTRPLPYGGVMKLTTSKYYIPSGRCVQAIDYKHRNEDGSVGTIPDSLTTVFHTAAGREVRDGGGVMPDIEVKQEKLPNILFYLVRDNLIFDYATQYCLKHPSIPSPQEFKVTDADYNDFKAMVKKADFKYDQQSEKIMKTLKEAAKFEGYLDEASEEIKALEKKLTHNLDRDLDYFSKDIRSMIADEIIKRYYYTRGGIIQQLKDDDGLQAALKILADPVKYKETLSAPVKK

SEQ ID NO: 6819 - protein, 608 aa, Legionella pneumophila
MFVRICAMFGFVSDLLTAAVSSLDELLQDTPAHQIILGTAALYFLYNQYHNPSISRWYRSRNNASMKQRIIDSAYALAKNLPGVNQIIEKELNKELSSTREKLRIQRSGMTLREEIPEEGLSPQDILSAFDVDVEKCHFDFLSVTNDSPEREFLVERGDGKDSGALYAIHPKELTELLKEVYGATALTNPLHDKWPRINAMQAEVIRWCQNLFHGSKECYGLLTHGGTTSIIEAMAAYVIRARAKGIDYPEIVVPETAHAAFKKAAELTGAILITVPVDKKTGAVNPKVMSSYITRNTAVIVGSAPSFMNGIHDPVSELGQLAKKKNVPFHVDACLGGFLTAFLDTSSEPMDFRVPGVTSISADLHKYGCCPKGTSVCLFSEDSPALSVYAALNWSGGLYATPGILDGSTSGARVAEVYATLSYYGKNKYQEIAKSIITLRNAIQKELTTLLEEGNGLTSEDIYVYGNPQWSILGFRSNTCNAHFIADELEKRGWKLNLLQNPDGFHLCLTHVHTLVKGFETQFIKDLREAVIDVKNYPPGKKPSGNVKVYGAVGMMPIELQREICKQYQKARLNYTSASPGSLRIFTNVPVEEDEGLRNRKTEKYKV

SEQ ID NO: 6820 - protein, 813 aa, Rhodobacter sphaeroides
MIAEKSERFFPFAVSAELAPVGVSAAERSALADYLESSETLLTERVVAYASTRSYSHLVSTLPEAWRSSVQGLTDSVILMLDHQSAEAAIDYDADIGTDPSTAYGIEAGLRHRLRGISLETFIGAFKGYRDVYLNVTAEARVPAAMREGWLRLLRGFFDRAEIGICAHWSGELGTLDHDQLLSVNRALVNEKNKYLTIFESMNNPVLLVDDGGRIENMNFAAARLFLQDALPGSVYYGPEANLRFADLAGFDLEAVKLRGEAGDVLTCIGERWYSITAQEMLDVSRKFVGIVVTFHDVTEARRAREQAEALARAKTDFLATMSHEIRTPIHSIGGVTELLKQSELASRDRGYVDAIERSTEVLASIVSDVLDYARIESGLVELEQVDFSIDQILDDVARMMQPLVRRKPQLRIVIERTDLPPVLGDAGKLRQILINLTSNAVKFTPEGTVVIGAERLAGGHRFRFTVSDTGPGIAAEKLEEIFKPYIQSDSSISRRHGGTGLGLAICRRLAGHLGGRLDVRSTPGFGSRFTLEVALAPGGSEPPGDATADAPPPARALDLLVVEDDEVNALVAQSLLSAAGHGVRVAGTGEAALVALGEHRFDLVLTDLNLPDMDGLELARTIRRHADRHTAELPLVALSAHGPGVDPAALTEAGIDAFLGKPFHFARLEEILSRLVGSSSPTPLGKAAPARRALQSVDLCVLRGHAEALGRTSAARIVQTFRQSVLETARALELAMDEADMRSVTSLAHRLKGAARHLGFRGLSDKAEQVETAAAADGCEAALVLELVSDCRAAPALADLAWAEASAGVAES

SEQ ID NO: 6821 - protein, 1091 aa, Oryza sativa
MSSSRPTQCSSSSSRTRQSSRARILAQTTLDAELNAEYEEYGDSFDYSKLVEAQRTTGPEQQARSEKVIAYLHHIQRAKLIQPFGCLLALDEKTFNVIALSENAPEMLTTVSHAVPSVDDPPKLRIGTNVWSLFTDPGATALQKALGFADVSLLNPILVQCKTSGKPFYAIVHRATGCLVVDFEPVKPTEFPATAAGALQSYKLAAKAISKIQSLPGGSMEVLCNTVVKELFDLTGYDRVMAYKFHEDDHGEVFAEITKPGLEPYLGLHYPATDIPQAARFLFMKNKVRMICDCRARSIKIIEDESLHLDISLCGSTLRAPHSCHLQYMENMNSIASLVMAVVVNENEDDDEVGADQPAQQQKRKKLWGLLVCHHESPRYVPFPLRYACEFLAQVFAVHVNKEFELERQVREKSILRMQTMLSDMLLRESSPLSIVSGTPNIMDLVKCDGAALLYGGKVWRLQNAPTESQIRDIAFWLSDVHRDSTGLSTDSLHDAGYPGAAALGDMICGMAVAKINSKDILFWFRSHTAAEIRWGGAKHDPSDKDDSRRMHPRLSFKAFLEVVKMKSLPWNDYEMDAIHSLQLILRGTLNDDIKPTRAASLDNQVGDLKLDGLAELQAVTSEMVRLMETATVPILAVDSNGLVNGWNQKVAELTGLRVDEAIGRHILTVVEESSVPVVQRMLYLALQGKEEKEVKFEVKTHGSKRDDGPVILVVNACASRDLHDHVVGVCFVAQDMTVHKLVMDKFTRVEGDYKAIIHNPSPLIPPIFGADEFGWCSEWNAAMTKLTGWHRDEVINKMLLGEVFDSTNASCLVKNKDAFVSLCILINSALAGDETEKAPFSFFDRNGKYIECLLSVNRKVNADGVITGVFCFIQVPSHELQHALHVQQASQQNALTKLKAYSYMRHAINNPLSGMLYSRKALKNTGLNEEQMKEVNVADSCHRQLNKILSDLDQDSVMNKSSCLDLEMVEFVLQDVFVAAILSDFLFVSVKFSPVGGSVEISCSLTKNSIGENLHLIDLELRIKHQGKGVPADLLSQMYEDDNKEQSDEGMSLAVSRNLLRLMNGDVRHMREAGMSTFILSVELASAPAK

SEQ ID NO: 6822 - protein, 198 aa, Selaginella serpens
DEHGEVVAEIRRSDLEPYLGLHYPATDIPQAPRFLFMKNRVRMIADCSATAVRIVQDKDLRQPISLAGSTLRAPHGCHGHYMGNMGSIASLVMAVIINDSTMISSGTAAGRASSSAAPSTWRKLWGLVVCHHTSPRTVPFPLRSACEFLMQVFGLQLNTEVELASQLREKHILRTQTLLCDMLLRDAPIGIVSQSPNI

SEQ ID NO: 6823 - protein, 550 aa, Burkholderia mallei
MAAKDVVFGDSARAKMVEGVNILANAVKVTLGPKGRNVVLERSFGGPTVTKDGVSVAKEIELKDKLQNMGAQMVKEVASKTSDNAGDGTTTATVLAQSIVREGMKYVASGMNPMDLKRGIDKAVAAAVEELKKISKPCTTNKEIAQVGAISANSDSSIGDRIAEAMDKVGKEGVITVEDGKSLADELDVVEGMQFDRGYLSPYFINNPDKQVAVLENPFVLLHDKKVSNIRDLLPVLEQVAKAGRPLLIIAEDVEGEALATLVVNNIRGILKTVAVKAPGFGDRRKAMLEDIAILTGGQVIAEETGLTLEKATLAELGQAKRIEVGKENTTIIDGAGEAVNIEARVKQIRTQIEEATSDYDREKLQERVAKLAGGVAVIKVGAATEVEMKEKKARVEDALHATRAAVEEGIVPGGGVALIRARTAIASLTGVNADQNAGIKIVLRAMEEPLRQIVTNGGEEASVVVAAVAAGKGNYGYNAATGEYVDMVEAGVVDPTKVTRTALQNAASVAGLLLTTDAAVAELPKEDAPMPGGMPGGMGGMGMGMGMDM

SEQ ID NO: 6824 - protein, 266 aa, Brassica napus
MHIYIKERKLQSNKNKMGRGRVELKRIENKINRQVTFAKRRNGLLKKAYELSVLCDAEVALIIFSNRGKLYEFCSSYNMIKTLERYQKCSYGSIEVNNKPAKELENSYREYLKLKGRYEGLQRQQRNLLGEDLGPLNSKELEQIERQLDGSLKQVRSIKTQYMLDQLSDLQTKEQMLLETNRALAMKLDDMIGVRSHHMGGGGGGWEGNEHNVSYAHHQAQSQGLFQPLECNPTLQMGYDNPVCSEQITATTQAQAQPGYIPDWML

SEQ ID NO: 6825 - protein, 754 aa, Prochlorococcus marinus
MKETIQADWIKSEAFNLENCCNDNPLNILGPHFVNGQWITRVWMPEADEVNIIFKDKTYKTTTLNHKWLFEVTLPEDPKNNYQINVSRGGVSHSQQDPWAYRKEWMGELDRHLFAEGNHHHIWEKMGAHIHEETNQQGVMFCIWAPNAKSISIIGDINSWDGRHHPMQKRLGGIWELFMPIMKEGDAYKYEIRTQEGHIYEKADPYGFLHEIRPQNGSIVSKLNNFDWEDSSWITNRDSSSQINKPISVYEMHLGSWMHDSIENKYIEKNGQTRSPVPAADLKPGTRFLTYPELTEKLIPYVKERGFTHIELMPISEHPFDGSWGYQVTGWYAPTSRYGTPNEFKEFINRCHAEGIGVILDWVPGHFPKDKHGLAFFDGCHLYEHGDPRIGEHKEWGTLIFNYSRNEVRNFLVANLIYWFEEFHIDGIRVDAVASMLYRDYLRPEGEWIPNENGGNENLEAVKFLQQANHVLFQHFPGALSIAEESTTWPMVTEPTNVGGLGFNLKWNMGWMHDMLDYFEIDPWFRQFHQNSVTFSITYNYTENFMLALSHDEVVHGKSHLLHKMPGDDWKKFANTRALLTYMWTHPGKKTIFMGMEFGQRQEWNVWDDLQWELLEFEPHKGIRNLVDDLNKLYKNEPSLWKNDFDPYGFQWIDCNDTSNSVISFMRRENESNEWLVIVANFTPNFHGSYKIGVPLEGFYKEIFNSDGSKYGGSNKGNMGGKETLKYNIHNYENALEIVLPPLSVSIFKHQLKQ

SEQ ID NO: 6826 - protein, 108 aa, Oryza sativa
MAEEAQQPRGVKVGGIHDAPAGRENDLTTVELARFAVAEHNSKANAMLELERVVKVRQQVVGGFMHYLTVEVKEPGGANKLYEAKVWERAWENFKQLQDFKPLDDATA

SEQ ID NO: 6827 - protein, 634 aa, Bacillus clausii
MCGFVGDLLIRNGSHLPDHLWIQTLEAIHHRGPDSTGTYKDETVRFGFKRLSIIDLEHGDQPLAYSKGRYHIVFNGEIYNYIELRSQLIQRGYTFRTDSDTEVLLALYAADGKNAVKQLRGMYAFAIWDKHKKELFCARDRFGIKPFYYLKTDERFFFASEQKSIMPLLEQISIEQEALQHYATFQFVPEPNTLTKGIHKLLPGHTLTVNADFCVQIEAYAERTFQPRSGPTVTELANQTRKLLTDSVEKHMRSDVPVGAFLSSGIDSTSIAALAQQVHPNLLTFTVGFETEGYSEIAVAKETAKALGVKNIHKVISADEFIQELPNIVWHMDEPVADPAAVPLYFVAQEASKHVKVVLSGEGADELFGGYNIYREPLDLAWFKKLPPTFHAGLKRVVAHMPSKLKGRNYIIRGTTPLNERYIGNAFIFSEKEKTQLFRDYDRTKPYTNVTAPLYEQAKGMDESTIMQFVDMHTWLPGDILVKADRMTMAHSIELRVPFLDKDVFAFARMLGQDMKLSHKTTKFVLRQAMKDLIPANIVPRKKLGFPVPIRVWLKNELYDWAKQLIESSNTEDVFHKPFLLQMLQAHRDGHGDYSRRLWTVLTYMMWHDIHVAKRLISTHQQKDAERCKTLAHF

SEQ ID NO: 6828 - protein, 489 aa, Bacillus cereus
MPQDRKEEVQNDTYEEKEIMPDNPQYLPRRVQMELPPEFSINPLFARKGESVVPRFNMPDEGMLPETAYQIVHDEITLDGNARLNLAMFVSTWMEPTAERLYAKSFDKNMIDKDEYPQTAEIEERCVRILANLWHSPSPLTTMGVSTTGSSEACMLGGLALKRRWQNARKREGKSVDRPNIVFSSAVQVVWEKFANYWEVEPRYVKVSPEHSLLDPQGVIAAVDENTIGVVPILGETYTGRYEPVAAIAKALDDLQERTGLDIPMHVDAASGGFIAPFLQPDLVWDFQLPRVKSINVSGHKYGLVYPGLGWIIWREADDLPEDLIFRVSYLGGNMPTFALNFSRPGAQVLLQYYNYLRLGKRGYYDVQRASQKVALFLSKAIQKMEPFELLSNGSDIPVFAWRLKNGHTSNWNLYDLSRQLRVFGWQVPAYPLPPDLEAVTIMRVVVRNGFSVDLAHLFLRNLKQAVAFLDSLDGPMPHDTKCDNGFHH

SEQ ID NO: 6829 - protein, 1391 aa, Mesorhizobium loti
MAEADEAIGARGKRGPDKPVHRGDAPPCADRDSPDALRQLLEAGSDWIWETDAELRFSWLSPTYQAATGIDPADVLGRFRFDFLNQDLKGSRSAAAHLEDLQARRPFRDFVYELKAGGADCRWVLTSGFPRFDNEGKFAGYRGIGRNVTTLAGAFETVEQNPLSGSDPDRHLADLERTMDAMHMGVVLLDAKLDTLIVNKAYRDLSSIPDGAVTVGAPFSRLMELNRRNGIYGDIDEQQWQRYLASRIEEIRAGSVAPREFVHASGRTMMFSVTALSGGKRLLTYYEVTELKRRDAEIESANAKIAETFVNLRTMVDEMPIGVLVLDADMRAEVINSAFYDFWRIDPGRAGIGSAFRELMEASRAIDPYGADELAWQRHTTEREAEIRAGVAGSKQLPHNDGRTLVASLAPLPGGKRLISYVDVTDMKGRETEAQDARKHLASVLESLPAGVIIYDRDDKFVFANRKLQDTLPALKPFWQPGCSFREALEFGQSIGYFRSSGDAGIDRLYEVEPEHWLDSMLARYRLPNSSYERLNADGRWYQVYDMRTDDGTFIGVRVDITDIKSREAALRDSMRQIDLFRHVMDELPVAAFIKAQDLSIEFVNKAWCALTGIAKEDVIGRTDRELFGTQDAEGYSHDDTQVVVTGKGIEVEEPVTHRDGTVRQLMTRKSRLVATDGSVHLVGSSTDITDVKAREKALEESMRENEVFRSLIDNVPVSIYAKRSDLRQFYVNKGWCDLTGLSREDAIGKTDIEIFGEDGEAFVAGDLAVLRTGETQEVEETVRLADGSVRHQFARKGAMIASDGSLYLIGSTTDITELKMREAELSEARQRAVLADRAKSEFLANMSHEIRTPMNGVLGMAELLAKSNLDPKQKTFTDIIVKSGNALLTIINDILDFSKIDAGQMVLDPAPFNLAEAIEDVATLVSTRAKEKDLELIVRVEPRLESLFVGDVGRIRQIVTNLLGNAVKFTDEGHVLVDVTGERVPTGTRLTISVTDTGIGIPEEKLKLVFEKFSQVDTSSTRRHEGTGLGLAITSRLVELMGGTIGVESAEGKGSTFWFTVTLPRAGQQNGQRIMPVDVTGARVLIVDDNAVNRAILTEQMTSWTFDSCAAESGAEGLKVLIAAAAYGVPVDCVVLDYQMPEMSGAEMARIVRNTGGLADTPIIMLTSVDQSLANTSYRDLGIDAQLIKPARSSVLLETLVATIQRHRHATDSHAVQPLAAERPDVPQPPPLALSEQRAQLQPPPVRPRLPATGGDGHRLDILVAEDNEVNQMVFTQILGETGYGFEIVGNGRKALDAFGKLNPCMILMDVSMPEMSGLEATAAIRQLEQQTGTHVPIVGVTAHALKGDRERCLEAGMDDYLPKPISPRALLEKVERWLGAGRQVQRNAG

SEQ ID NO: 6830 - protein, 470 aa, Leuconostoc mesenteroides
MVSVMWFRRDLRLEDNIALFNALRHSNEILCVFHINPEQVTEKSTVNQSAFFASVLYFKNKLKKQGINLNIMYGDINDCFASLKQKLPDWHDIFFNFDERGFGRNRDQKSVAFFEDKLKVKAHPYIDYNLHGATEVKKDSGAGYKVFTPYFKRWIRQEKPAPVSYVIDKRIKSARLLFPENEQLLETFIDDRFSFIKKDLGSETAKKVLNRFINESLDQYDEERDFPANDSTSHLSRYLRTGEISIRTVWRAIDQSPDSDGKSTFMKELCWRDFYNMIYVMYPNQNVESVNKDFRHVDWINNEQQFEAWRTGQTGFPIVDAAMRQLNATGWMHNRLRMIVASFLTKDLLIDWRWGEAYFHNKLLDYDAASNIGGWQWAASTGTDSVPYFRIFNPTLQSKKFDSNGLFIKKYVPELKNVDNKMIHEPGKLSESEQTRFNVRIGQNYPFPIVDHSYARKRAISIYESSKDVN

SEQ ID NO: 6831 - protein, 116 aa, Carboxydothermus hydrogenoformans
  misc_feature (9)..(9): Xaa can be any naturally occurring amino acid
NPLTLQDFXPAGGIFEEGADVVVRAEIPGLNAKEDLEVIVEPESLTLRGEIRDERERKQERFYRSERYYGKFSRTIALPAEVEPDHARASYQNGILEVRMKKSGKNNPRARRIEIQ

SEQ ID NO: 6832 - protein, 277 aa, Staphylococcus aureus
MEVKTFYNGNTMPQIGLGTFRVENDENCMESVKYAIEQGYRSIDTAKVYGNEEQVGAGIRAGLESTGIAREDLFITSKLYFEDFGRENVAAAYEASLSRLGLKYLDLYLVHWPGTNEAVMVDTWKGMEDLYKNNKAKNIGVSNFEPEHLEALLAQVSIKPVINQVEYHPYLTQHKLKLYLAAQHIVMESWSPLMNAQILNDETIKDIAQELGKSPAQVVLRWNVQHGVVIIPKSVTPNRISENFQIFDFELSDEQMTRIDGLNQDKRIGPDPKTFEG

SEQ ID NO: 6833 - protein, 118 aa, Brassica napus
MEFVRFPIVSILDDMREVPEEHNEKSRISPSRAYMRDAKAMAATPADVIEHPSSYVFVVDMPGIRGEDIRVQVENENVLVVSGERQRENKENEGVKYVRMERRMGKFMRKFQLPENAD

SEQ ID NO: 6834 - protein, 704 aa, Pseudomonas syringae
MRYQLSSRRISMKQLFPSTALALFVGLSVLPMSASTFAANSWDNLQPDRDEVIASLNVVELLKRHHYSKPPLDDKRSAIIYQSYIKQLDPSRSYFMASDIAEFDKWQFQFDDFLKSGDLNPGFTIYKRYLDRIKARLDFALAELSKGVDKLDFNTKETLLVDRKDAAWPKDTAELDELWRKRIKDEVLRLKIAGKDPAKIQETLTKRYKNQQARLNQTRAEDIFQAYINTFAMSYDPHTNYLSPDSAENFDINMSLSLEGIGAVLQSDNDNVKIVRLVPAGPAAKTKQVAPADKIVAVAQGDKEMVDVIGWRLDEVVKLIRGPKGSVVRLEIIPASNAPNDQTSKIVAITREAVKLEEQAAKKSILHLKQDGKDYKLGVIDIPAFYLDFKAYRAGDPEYKSTTRDVKKLLTELQAEKVDGVVLDLRNNGGGSLQEATELTSLFIDKGPTVLVRNADGKVDVLEDEAKGAFYKGPMALLVNRLSASASEIFAGAMQDYHRALVIGGQTFGKGTVQTIQPLNHGELKLTLAKFYRVSGQSTQHQGVVPDITYPSLIDTKEIGESALPEAMPWDSIKPAIKPAIDPFKPFLAQLQARHEARSAKDAEFVFIEDRLALAKKLMNEKTVSLNEADRRAEHASIESKQLALENTRRKAKGEEPLKELKKEDEDALPVEDEKTKPEDDAYLAETGRILIDYLGLSAAVAKK

SEQ ID NO: 6835 - protein, 765 aa, Unknown
  Synechococcus sp. CC9605
MGVAAVLDWLVQDGERLASCRHDHPFAVLGPQASDQGWTVRMWMPEAQSVSLLQAGEEIAMTTPNHPWVFEAQVSQDPGCHYRVKVERGGIVHEQHDPWAFRGEWMGEMDRHLFAEGNHHHIWQKMGAHLTERDGITGVMFCLWAPNALSVSVIGDLNSWDGRHHPMQQRVGGIWELFVPGLEEGHLYKYEIRTQDGHCYQKADPYGFQHEVRPDNSSVVARLNGFQWSDQTWMQKRDSSNALDQPISVYEMHLGSWIHASADEPWIQPDGTPRPPVPAADMKPGARLLTYAELADRLIPYVKDRGFTHIEVMPITEHPFDGSWGYQVTGWYAPTSRYGTPDEFRAFVDRCHAEGIGVIIDWVPGHFPKDAHGLAFFDGAHLYEHSDPRIGEHKEWGTLIFNYSRNEVRNFLVANLIFWFEQFHIDGIRVDAVASMLYRDYLRPDGEWLPNESGGRENTEAVRFLQQANHVLFQHFPGALSIAEESTTWPMVTQPTDSGGLGFNLKWNMGWMHDMLDYFELDPWFRQFHQNNITFSIWYTYTENFMLALSHDEVVHGKSHLMHKMPGDDWQKYANTRALLSYMWTHPGKKTIFMGMEFGQRAEWNVWGDLQWDLLNYEPHKGIQRLVDDLNVLYKAEPALWRDDFDQFGFQWIDCNDNRHSVISFMRRESASGTWLVVVANFTPQSHSHYRVGVPLSGFYEEIFNSDAAKYGGSNLGNMGGKPTDEWGIHGYENSLDLCLPPLSLMVFKHDPKRSLNSSEPDNIV

SEQ ID NO: 6836 - protein, 279 aa, Streptococcus pyogenes
MVTTVKMTSGYEIPVLGFGTYQAADGEEAYQSTLAAIKAGYRHIDTAAIYKNEESVGRAIKDSGVLREDLFITTKLWNDAHSYEGAKDALAASLDHLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTQEDKKTIRYLSGMSAIPNPDTTSF

SEQ ID NO: 6837 - protein, 169 aa, Stigmatella aurantiaca
MADLSVRRGTGSTPQRTREWDPFQQMQELMNWDPFELANHPWFANRQGPPAFVPAFEVRETKEAYIFKADLPGVDEKDIEVTLTGDRVSVSGKREREKREESERFYAYERSFGSFSRAFTLPEGVDGDNVRADLKNGVLTLTLPKRPEVQPKRIQVASSGTEQKEHIKA

SEQ ID NO: 6838 - protein, 219 aa, Triticum aestivum
  misc_feature (169)..(169): Xaa can be any naturally occurring amino acid
  misc_feature (196)..(196): Xaa can be any naturally occurring amino acid
MGSEGPSIVTVHVTGFKKFHGVAENPTEKLVTNIKSFIEKRGLPKNLVLGSCEILETAGQGALGTLYKVLESAIADRENGSSAQGQIIWVHFGVNSGASRFALENQAVNEATFRCPDELGWKPQRVPIVPSDGSISRTRETTLPVKELTKSLRKTGYDVMPSDDAGRFXVCNYVYYHSLPVRGSQHGIKSLFVHVXPLFSTVDEEVQIHFVASLVEALG

SEQ ID NO: 6839 - protein, 545 aa, Campylobacter lari
MAKEIFFSDEARNKLYEGVKKLNDAVKVTMGPRGRNVLIQKSFGAPTITKDGVSVAKEVELKDSLENMGASLVREVASKTADQAGDGTTTATVLAHAIFKEGLRNITAGANPIEVKRGMDKACEAIVAELKKLSREVKDKKEIAQVATISANSDEKIGNLIADAMEKVGKDGVITVEEAKSINDELNVVEGMQFDRGYLSPYFITNTEKMTAELQNPFILLFDKKIANLKDLLPILEQIQKTGKPLLIIAEDIEGEALATLVVNKLRGVLNISAVKAPGFGDRRKAMLEDIAILTGGEVISEELGRTLESASIQDLGQASSVIIDKDNTTIVNGAGEKANINARINQIKAQIAETSSDYDREKLQERLAKLSGGVAVIKVGAATETEMKEKKDRVDDALSATKAAVEEGIVIGGGAALIKAKSKISLNLQGDEAIGAAIVERALRAPLRQIAENAGFDAGVVVNTVENSKEENTGFDAAKGEYVNMLESGIIDPVKVERVALLNAVSVASMLLTTEATISEIKEDKPAMPDMSGMGGMGGMGGMM

SEQ ID NO: 6840 - protein, 707 aa, Gibberella zeae
MASIVKNSSNSLDPNQANGAAGDIPNDGTGVVKLDPWLEPFSGALKRRYSKAQDWIKTINAAEGGLEKFSRGAEKFGFNVDANNNIVYREWAPNATAAYLIGDFNGWNRGAHPMKKNDFGVFEITLPAQNGQAAIPHNSKLKISLDLPSGEHVDRLPAWIKYVTQDLSVSPAYDARFWNPPASETYKFKNSRPKKPASARVYEAHVGISSPEQKVASYKEFTKNMLPRIKALGYNVIQLMAVMEHAYYASFGYQINNFFAASSRYGTPEELKELIDTAHGLGITMLLDVVHSHASKNVLDGINEFDGTDHQYFHGGGKGRHDQWDSRLFNYGHHEVMRFLLSNLRFWMDEYQFDGFRFDGVTSMLYVHHGMGTGFSGGYHEYFGSDVDEEAVVYMMLANEMLHQLYPEVITIAEDVSGMPALCVPLSLGGIGFDYRLAMAIPDMWIKILKEVKDDEWDIANICHTLTNRRHGEKTIAYAESHDQALVGDKTLMMHLCDAEMYTHMSTLSPLTPVIDRGMALHKMIRLVTHGLGGEGYLNFEGNEFGHPEWLDFPREGNNNSFWYARRQLNLTDDPLLRYKFLDNFDRMMNQTEAKYGWLSAPQAYISLKHEGDKVIVFERAGLVFIFNFHPTNSFSDYRIGIEVPGTYRVVLNSDHGDVGGHNRIDENTRFFTTPMEWNNRKNWTHVYIPSRTAIILALESTVTQSS

SEQ ID NO: 6841 - protein, 210 aa, Unknown
  Parachlamydia sp. UWE25
MFIQPFPSGPFSTNAYLIACLSTQKAIIVDPAPESANLLLDCLRKHHFILQSILLTHSHWDHIADINSIKKLYDIPIYVHPLDQLNLEKPGSDGLPCWLTIQPVKANIFLNDGDLIPVGQLTFKVIHTPGHSPGSVCFYEISQSKLLSGDTLFKGSIGNISFPTSQPDLMWTSLDKLAQLPPSTSVYPGHGPMTTIGNENWLPKAKQLFQ

SEQ ID NO: 6842 - protein, 1048 aa, Magnaporthe grisea
MTTAISSNHEPPYPPSSGDRGQAYPPVSRSQSTRHRPSTAQPPAPHRSVSHNHSGSMSSRPSSSARPVQDVLPNNDYETTNVAQKATKDSRPPQSSRDTATRQHRRSGSQRSGHHGHDGNAEAGPSTPSQASHGSSDPRTRKMRTVIPAQSGKWNLGKTIGAGSMGKVKLARKEDGTEQVACKIIPRVTPDDGHTPRAERERADLSKEVRTAREAAIVTLLSHPHICGLRDVVRTNFHWYMLFEYVNGGQMLDYIISHGKLKEKQARKFSRQIASALDYCHRNSIVHRDLKIENILISKTGDIKIIDFGLSNLFAPKSHLKTFCGSLYFAAPELLQARPYTGPEVDVWSFGIVLYVLVCGKVPFDDQNMPALHAKIKKGVVDYPNWLSSECKHLLGRMLVTDPKQRITMAEILSHPWMVKGYSGPPENYLPNREPLTLPLDQEVINGMTGFSFGPPEVIKAQLTRIIESEDYQRSIRAYQREKETQQTPKDPEKKRGFGFYRRRNSFSSKDTLTTPSSEGLALGNDPLNAFNPLVSVYYLVREKQEKDSASRRPATSARPNAVPEIAPPQEAHTNASAYEMPGENATGGRTRPRARTHGEDDAPTEPIRPPQLSPPAAPPPERLEPPKKESAAAGLLRRFSTRRRKEQPERLDKDRSHPPVVQVHSPAENSSQPTSAIRKSFSIRRGRRDREEQASAESQARMRAGSSQPQHSDLLSPPLSAGANTQTFRKGLGRSASVNSGEFSRRRAMGTARTSKDPPPTSGSDHSTIHEKPPKEQQEKRSPTTAGPSQSMTSRAKSLGHARQESIQARRQRREAEKKREANVPEETDAEVNGADDSSKERVTDFDLDKPVYLKGLFSVSTTSGKPVREIRTDIKRVLKQLGVDYTEIKGGFYCRHSPSIDLQNVADNGAASPAQTPSGAKRRFSFGALRSDGKEESNGERVPVTPRTPGRSGGGSGTDRDRHDSSSEVSENSEAREETSRRRDHPAGETRTHVRSDMGESMVSEFEIFIVKVPMISLHGIQFKRLGGNTWQYKNLADQILKELKL

SEQ ID NO: 6843 - protein, 557 aa, Unknown
  Parachlamydia sp. UWE25
MAKLLQFNEEALKSILKGVKTLAKAVKVTLGPKGRNVVINKGFGSPLSTKDGVTVAKEVVLKDKFENMGAQLVNQVAAKTSDVAGDGTTTAIVLAEAIYSAGVKNVAAGANPMSLKRGIDQAVETITRSLDHLSTPVNTAQEVRQIATISANNDGEIGRIIGEAMERVGKDGIITVAEAKGIETHVDYVEGMQFDKGYVSPYFITNAEQMSVELSNADILITDKKLSAAKDIIPVLEKIMEKGARPLLIIAEDIDGEALATLVVNKLKAGMTVCAVKAPGFGDRRKAMLQDIAILTGGKVVSEEVGLKLDEVGPEVLGRAKTIKVSKEETTIIDGAGQSNEVKSRLAQIKAELANASTSKYDKEKLEERLAKMVGGVAVVNVGAATETELKEKKARVEDALHATRAAVAQGIVPGGGVALLRAVKSLEKLQLTGDEAIGVTIIKQAAFAPAIAIANNCGKQGNLIAEKIYEATGSYGYDGLTDEFKDLLKAGVIDPVLVTKSALINAASIAGLLLTTAAMITDKPQPKSQPAGMPGMDGMGGMGMGGMGGMGGMGMM

SEQ ID NO: 6844 - protein, 1739 aa, Rhodopirellula baltica
MSDPQPESKPLVVGVGAGAGGIEALQELLASLGDSPDMAMVFVGHDASELHATRIEQLADATSLRVVELKSRKLIRPNTVYICPPNSLLSISSGSRLMLKPATEESPATPIDHFFHAIAETQGEQGIGVILSGMGTDGTLGLKSISDAGGMTFSQISSSAKFDSMPRNAATTGVADHVLTPKEIANELNDYVVYRKQQSNRLTRESMLEEIERSIPEIADVLYKATKHNFKHYKTATLTRRILRRMQILQISDVATYLGRLRDDQDETQNLFRELLIGITAFFRDPESFKALAEEVIPQLFEGRTASDPVRIWVPGCATGEEAYSLAILCYEHLDRLKTQRDDDHAKDSLPTFQIIASDIDEHALAIARQGVYPLGITESIPETRLKQFFVKRGKRYHAKRNLRESILFSLHNLISDAPFSRQDLISCRNLLVYLGPHLQKKLIPLFHYALRPNGHLFLGPSESISSHDELFRTVDAEHRINQRKGTETVTDTADSRGFVSATEATQTAAIVPNEEDTKEIHQVLQRIILDEFAPKAVVVDVDGKVICTLSDTSPYLSSGEGMHQNNLIKMAHVHLRIGLRGAFAEAKANRRRVVRDDLLIMSESGQQRVKLTIQPMMQLGHETELFMVAFEDLGPSIAPSDSSTDDSIGSDPSIAADPHAQQRIEQLERELATTRDDLDRSIQEMEATNEELTSSYNELLVMNQGLQTANEKLEISKEEIRSSSEAVARANADLQNLLRSTRIATIFLDDDLSIRSFTPAATEIYGLIATDVGRPLTQIAPNVQDMPPLPKWELLIQEDGVEHTIVANTGKAFIRRVLPYRSYSGDHDGIVLTFTDVTQLRESEELFQSLVRASAQIVWIANADGVVESDSPSWREYTGQTLEQWVGLGWLDVIHPDDRELTQKVWTDAVAKDRPLVLEYRLRNRHGEYRWFQVRTAPQRRPDGTVNRWVGMNIDIHDQKQSRLELADREAHLRRVINNQLGLVGVIDRNGLLLEVDDRSLEYARVNRHEVIGKPFHEAPWWNYDPNVAQQMRDAMERAFKGEPVRYDVSLFAHGDDGVLIDFMIAPVFDDDGNIEYLIPSGVDIRDRKKAELKQQEVAVRLEAIFNTAVDGIITIDRRGTINSVNVAAAKIFGYGVDELTGSNINALIPEPEHSEHDGYLKAYEETGQSHIIGHQRQVTGRRKDGSTFSLDLSVSETSLSGEHRYVGIVRDVSDRVRSEQAKKNASRRMQMALRAGGMAAWEWTPKKSYWTKEMYELFGVTDDRKGSPELCFSLTHPDDVESLKRHWQEAIEGNQDYEYEFRIVRPDGEMRWITGMGEVVRGKSGNVTRMYGVNWDSTQEHVQAETLRESERRANEASASKSAFLANMSHEIRTPMTAILGYAELLQDIIQDTEGLHHLQTIRRNGDYLLDIINDILDLSKIEAGKLDVESERFDPAHLIEDVRSIMEVRAKEAGLELTVEYGQQIPASIQSDAKRLKQVLINLVGNAIKFTPEGNVRLVVRMESEPIRLCIDVIDTGIGITPEQQEQLFLPFSQGDSSVNRTFGGTGLGLTISRRLAEMLGGTIHFQSEVGVGSTFTLSVFPGDLTGVAMVDHSQPVSKLVDDLENSSTTPIKLNCYALVVDDRRDIRFLSRRILTKAGATVDECEDGLQAVDKIIESMKARRLPDVIILDMQMPKLDGYATAKKLRELGYDAPIIALTADAMQGDMNLCLKAGCNDYLSKPIDAAKLVALVSKLT

SEQ ID NO: 6845 - protein, 441 aa, Arabidopsis thaliana
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGRR

SEQ ID NO: 6846 - protein, 216 aa, Zea mays
MTLTPFEAKRANTSTNTSAEQPSATHTPTRTNQPAGSRFAALTMMPRRALLFAAVLLAASAAAVSGFHLGGDESGLVRGVLAALRERAEAEDAARFAVAHYNKNQGAALEFTRVLKSKRQVVTGTLHDLILEAADAGKKSVYRAKVWVKPWEDFKSVVEFRLVGDSESEPEPSVASDVSSGQAIAKLSLEADIVQEEARLHTIENDGLSGDFTSSS

SEQ ID NO: 6847 - protein, 378 aa, Ralstonia solanacearum
MFQSLFPGAEMTQQLLSPIQVGQTALANRVVMAPLTRSRAAQPGDVPTELNGTYYAQRATAGLIVTEATQVSRQGQGYAWTPGMYTDAQEAGWKAVVDAVHAKGGRISQQLWHVGRISHTLLQEGGQAPVAPSAIVAQGAQSFVVQPDGTPANVPTSEPRALATEEIPGIIAQYRQAVQRARRAGFDFVEIHAANGYLLHQFLSTNSNQRADQYGGSLENRARLILEVVDAAIAEIGAERVGIRLSPHFVAHDIADAEAETSALYLARELTRRGVAYLHIAEPDWAGGPELSDAFRRQLRDAFKGALIVCGQYTAEEGEQMIASGLADAVAFGRPFIANPDLVARFRAGAGLNTPDRSTFYGGQEKGYTDYPTLEEAA

SEQ ID NO: 6848 - protein, 286 aa, Thermotoga maritima
MQVPKVTLNNGVEMPILGYGVFQIPPEKTEECVYEAIKVGYRLIDTAASYMNEEGVGRAIKRAIDEGIVRREELFVTTKLWVSDVGYESTKKAFEKSLKKLQLEYIDLYLIHQPFGDVHCAWKAMEEMYKDGLVRAIGVSNFYPDRLMDLMVHHEIVPAVNQIEIHPFYQRQEEIEFMRNYNIQPEAWGPFAEGRKNIFQNGVLRSIAEKYGKTVAQVILRWLTQKGIVAIPKTVRRERMKENISIFDFELTQEDMEKIATLDEGQSAFFSHRDPEVVKWICSLKR

SEQ ID NO: 6849 - protein, 527 aa, Brassica napus
MKHLGLILAFLLALATCKADEEITCEENLPFKCSQPDRLNSSSFEKDFIFGVASSAYQACCLGRGLNVWDGFTHRYPNKSGPDHGNGDTTCDSFSYWQKDIDVLDELNATGYRFSIAWSRIIPRGKRSRGVNKDGINYYHGLIDGLIDKGITPFVTLFHWDLPQVLQDEYEGFLDPQIIHDFKHYANLCFQEFGHKVKNWLTINQLYTVPTRGYGAGSDAPGRCSPMVDPTCYAGNSSTEPYIVAHNQLLAHATVVDLYRKNYSIGPVMITRWFLPYNDTDPDSIAATERMKEFFLGWFMGPLTNGTYPQIMIDTVGERLPSFSPEESNLVKGSYDYLGLNYYVTQYAQPSPNPVHWANHTAMMDAGAKLTFRGNSDETKNSYYYPKGIYYVMDYFKTKYYNPLIYVTENGISTPGNETRDESMLHYKRIEYLCSHLCFLSKVIKEKHVNVKGYFAWSLGDNYEFDKGFTVRFGLSYIDWNNVTDRDLKLSGKWYQKFISPAIKNPLKKDFLRSSLTFEKNKKFEDA

SEQ ID NO: 6850 - protein, 245 aa, Glycine max
MRASNSSSSISIAKRYFFFFLLFIFFALRSSSGDCSEYHHHHSPMATIGGLHDSQGSQNSVETEALARFAVDEHNKKQNSLLEFARVVRAQEQVVAGTLHHLTLEAIEAGEKKLYEAKVWVKPWLNFKELQEFKPAGDAPSFTSADLGVKKDGHQPGWQSVPTHDPQVQDAANHAIKTIQQRSNSLVPYELHEVADAKAEVIDDFAKFNLLLKVKRGQKEEKFKVEVHKNNQGGFHLNQMEQDHS

SEQ ID NO: 6851 - protein, 192 aa, Zea mays
  misc_feature (168)..(168): Xaa can be any naturally occurring amino acid
MVLSHAASAGSSDDSVHSTFASRYVRASLPRFRMPENSIPKEAAYQIINDELMLDGNPRLNLASFVTTWMEPECNKLMMDSINKNYVDMDEYPVTTELQNRCVNMIAHLFNAPLGETETAVGVGTVRSSEAIMLAGLAFKRRWQNKMKAAGKPCDKPNIVTGANVQVXCWEKFARYFEVELKEVKLSEGYYV

SEQ ID NO: 6852 - protein, 614 aa, Unknown
  uncultured archaeon GZfos18F2
MAHARLSIIDLAGGDQPIHNEDRSIWIVFNGEIFNYPELRKELKSRGHRFYTRSDTEVLVHLYEDHGPEFIHELNGQFAIALWDVRKKQLLLARDRMGIRPLFYFEKAGRLVFASEIKGLLADDRVPRTLDLKALSDIFTCWSPFGALTPFESVRQLLPGHYAMFSSNGMQIRSYWQPVFSAPPSKERSLDDWTEELNGLLYDAARIRLRADVPVGAYLSGGLDSTYISSLVKRSFNNRLCTFSVGFTDERFDETSFQEKAVQSLETDHRIVRCSERDIGKVFPQVIWHTETPILRTAPAPLFMLSGLVRENNFKVVLTGEGADEVFAGYNIFKEDRVRRFWARQPDSKLRPLLLERLYPYIFSRKNSRTRVFLENFFRKSLIQVDSPCYSHLIRWNNTALLKAFFSDELQAMAGKPPDFEERFISTLPSDFMSWDPLSRSQYTEMTIFLANYLLSSQGDRMAMGHSVEGRFPFLDHRVVEFACSMPPEYRLNGLKEKYILKHASRDLIPPELRRRPKQPYRAPISRCFFGKGSPDYVGELLSENAIRRAGYFHPKKVGRLVDKCQKQEGHLASERENMAVAGILSTQLLDHLFLRNFPPHPIQEPENVRVFGL

SEQ ID NO: 6853 - protein, 672 aa, Rhodospirillum rubrum
MESPLTPPVAPAPRPPLSSLVAAPPAEDPPSARSVAAAPPPAPPVRRLPQGAEVQPGGGVHFRVWAPGRQAVTLCLENGAAIAMTAEDDGSFAALVAEAGAGTAYRYRLEGVEALCPDPLARFQPEGPHGPSLVVDPAGFVWSDQAWAGVSHQGMVLYEMHIGTFTPEGTWAAAMAHLERLRDLGVTCLEIMPIAEFSGRFGWGYDGVNLFAPTRLYGQPDDMRRFVDRAHALGLAVILDVVYNHLGPDGNYLGHFTNDYFTDRYKNDWGVAINFDGPGSAGVRAFYLANAGYWIEEFHLDGLRLDATQQIYDRSEPSILAEIAREVRAAAKGRNTFVVAENEPQEVRLIEDETAQGYGLDALWNDDLHHAAMVALTGRREAYYLDYLGSPQELISAAKWGFLYAGQYYSWQRNGRGTTSFAIPGRAMVAFLQNHDQVANSARGLRLDKLSDEAQFRALTAYLLLIPATPMLFQGQEFRSSAPFYYFADHGPKLAAMVKDGRADFLTQFPSIDQGWRSEDLPDPAAEATFERCKLDHREWQSHAEWVALHRDLLTLRRETPAFAAQDCRRMEGAVLGPQTFVLRFFAEERLSDRLMLVNLGPQITLTPMAEPLLAPPMGKAWTTLWASSDQRYGGAGLTAVERTPLWEIPARTTVVLGPGEKKPFIAPRTSG

SEQ ID NO: 6854 - protein, 480 aa, Lactobacillus plantarum
MATTSGLRSDFLWGGAVAAHQLEGGWQAGGKGVSVADVMTAGANGVPREITDGVIAGKNYPNHEGIDFYGHYKEDIKLFAEMGFKCFRTSIAWTRIFPNGDEEEPNEAGLKFYDDMFDTCRQYGIEPVITLAHFEMPYHLVKEYGGWRSRKVIDFFVHYAETVFKRYKNKVKYWMTFNEINNQTTYTNQFLMATDSGLVLKPDDPDAEALMYQAAHYEVVASALAVKIGHAINPDFQIGNMINMTPIYPATAKPQDIMQAEKAMQRRYWFADVQSWGYYPNNMEAYFKQTGFRPDITAEDRQVLKEGTVDYIGFSYYNSNTVAAQDDNPSYHFVGTEAVDNPYLKTSEWDWPIDPEGLRYSLNWLQDRYHKPMMIVENGLGARDKVEADGSIHDPYRIDYLRAHISEMIKAVTEDGVDLIGYTPWGCIDLVSAGTGQMSKRYGFIYVDKDDEGNGTLERSKKDSFYWYQKVIRTNGADLK

SEQ ID NO: 6855 - protein, 479 aa, Lactobacillus plantarum
MTKGYKMPKDFLWGGAVAAHQLEGAWDVDGKGVSIADVMTAGRNGVPRKVTDGVKDGEIYPNHWGNDFYHRYSEDDRLFEEMGFKCFRTSIAWTRIFPNGDESEPNEAGLKFYDDLFDDLLSHGIQPVVTLSHFEIPYHLVKAYGGFSNRKMIDFFVHFAKTVFKRYQDKVKYWMTFNEINNQTAWSDPHPLLQNSGLQLSKDDNWEQAMYQAAHYELVASALAVQAGHAINPDFQIGCMVAMCPIYPLTAKPADVMMAERAMQKRYWFGDVHCLGEYPKWLPKYFERKGFDMDITAADLATLKAGTVDYVGFSYYMSFVTKGRDGDSDYDFKEPDDFVENPYVEKSDWGWQIDPTGLRYAMNWMQDRWHLPQFIVENGFGAYDKKEADGSVHDDYRISYFRDHILAMEQAVVLDGVDLIGYTPWGCIDLVSASTGEMAKRYGFIYVDADDNGQGSFDRSKKDSFNWFQQVIASDGEDL

SEQ ID NO: 6856 - protein, 495 aa, Kluyveromyces lactis
MNEYDAVDRHTFKVFNQDFTVDKRFQLIKEIGHGSYGIVCSARFTEAADETTVAIKKVTNVFSKTLLCKRSLRELKLLRHFRGHKNITCLYDMDIVFQPDGMFNGLYLYEELMECDMHQIVKSGQPLTDAHYQSFIYQILCGLKYIHSADVLHRDLKPGNLLVNADCQLKICDFGLARGYSENPVENNQFLTEYVATRWYRAPEIMLSYQGYTKAIDVWSCGCILAELLGGKPIFKGKDYVDQLNRILQVLGTPPEETLKRIGSKNVQDYIHQLGYIPKIPFSTLYPNANPDALNLLEGMLSFDPQLRITVDDALQHPYLSIWHDPADEPICTEKFDFSFESVNEIEQLKQMVIDEVTDFRQYVRLPLLHEQQQQQGKTDGGFDDQIREDQRTFQAQLEEQVNNGRTASNVPSFDEPFSSQMMGSASQQDPLVGIHSDNLPSHELDFPPRPSENVLDSPMGLSHQQTHNGSPECQDINDLLGLERELEFGLDRQF

SEQ ID NO: 6857 - protein, 491 aa, Staphylococcus epidermidis
MNDHQKNHATSQDDNTKSTPSKNSKHIKIKLWHFILVILGIILLTSIITVVSTILISHQKSGLNKEQRANLKKIEYVYQTLNKDYYKKQSSDKLTQSAIDGMVKELKDPYSEYMTAEETKQFNEGVSGDFVGIGAEMQKKNEQISVTSPMKDSPAEKAGIQPKDIVTQVNHHSVVGKPLDQVVKMVRGKKGTYVTLTIKRGSQEKDIKIKRDTIHVKSVEYEKKGNVGVLTINKFQSNTSGELKSAIIKAHKQGIRHIILDLRNNPGGLLDEAVKMANIFIDKGNTVVQLEKGKDKEELKTSNQALKQAKDMKVSILVNEGSASASEVFTGAMKDYHKAKVYGSKTFGKGIVQTTREFSDGSLIKYTEMKWLTPDGHYIHGKGIRPDVSISTPKYQSLNVIPDNKTYHQGEKDKNVKTMKIGLKALGYPIDNETNIFDEQLESAIKTFQQDNNLKVNGNFDKKTNDKFTEKLVEKANKKDTVLNDLLNKLK

SEQ ID NO: 6858 - protein, 434 aa, Zea mays
MATHASDNGSGHAEWRFARAAKEGALAVAGDKMSIRAARFKISASVDGRDPRPVLPLAHGDPSVFPAFRTAAEAEDAVAAALRTGKFNCYPAGVGLPEARRALAEHLSSDLPYKLSTDDIFLTAGGTQAIEVVVSVLAQPGANILLPRPGYPNYEARAGLHNLQVRHFDLIPERGWEIDIDSLESIADKNTTAMVIINPNNPCGSVYTREHLAKVAEVARKLGILVIADEVYGNLVFGDTPYVPMGVFGHIAPVLSIGSLSKRCILPGWRLGWVAVCDPNKILQETKIIASITNFLNVSTDPATFVQGALPHILENTKEDFFRRIIGLLAETSEICYREIKDIKCITCPHKPEGSMFVMVKLNLYLLEGIHDDIDFCCKLAKEESVILCPGSVLGMENWIRITFAIDSSSLLDGLERIKSFCQRHKKKNLLNGH

SEQ ID NO: 6859 - protein, 477 aa, Vitis labrusca
MSHKGLDYETLNENVKKVQYAVRGELYLRASELQKEGKKIIFTNVGNPHALGQKPLTFPRQVVALCQAPFLLDDPNVGLVFPADAIARAKHYLSLTTGGLGAYSDSRGLPGIRKEVAEFIGRRDGYPSDPELIFLTDGASKGVMQILNTIIRGERDGILVPVPQYPLYSAAISLYGGSLVPYYLEETANWGLDVNNLHSSVAAARSKGITVRAMVIINPGNPTGQCLSEANLKEILHFCNQENLVLLGDEVYQQNIYQDERPFISARKALMDMGPPISKELQLVSFHTVSKGYWGECGQRGGYFEMTNIPPQTVDEIYKVASISLSPNVPGQIFLGVMVNPPTPGDISYLQFMRESKGILESLRRRAQIMTDGFNSCRNVVCNFTEGAMYSFPQIRLPPKAIEAAKKAGKVADVFYCLKLLEATGISTVPGSGFGQKEGVFHLRTTILPAEEDMPAIMESFKKFNDEFMEQYEDHRG

SEQ ID NO: 6860 - protein, 466 aa, Bacillus subtilis
MKRQLKLFFIVLITAVVASALTLFITGNSSILGQKSASTGDSKFDKLNKAYEQIKSDYYQKTDDDKLVDGAIKGMIQSLDDPYSTYMDQEQAKSFDETISASFEGIGAQVEEKDGEILIVSPIKGSPAEKAGIKPRDQIIKVNGKSVKGMNVNEAVALIRGKKGTKVKLELNRAGVGNIDLSIKRDTIPVETVYSEMKDNNIGEIQITSFSETTAKELTDAIDSLEKKGAKGYILDLRGNPGGLMEQAITMSNLFIDKGKNIMQVEYKNGSKEVMKAEKERKVTKPTVVLVNDGTASAAEIMAAALHESSNVPLIGETTFGKGTVQTAKEYDDGSTVKLTVAKWLTADGEWIHKKGIKPQVKAELPDYAKLPYLDADKTYKSGDTGTNVKVAQKMLKALGYKVKVNSMYDQDFVSVVKQFQKKEKLNETGILTGDTTTKLMIELQKKLSDNDTQMEKAIETLKKEM

SEQ ID NO: 6861 - protein, 484 aa, Vitis vinifera
MSHKGLDYETLNENVKKVQYAVRGELYLRASELQKEGKKIIFTNVGNPHALGQKPLTFPRQVVALCQAPFLLDDPNVGLVFPADAIARAKHYLSLTSGGLGAYSDSRGLPGIRKEVAEFIGRRDGYPSDPELIFLTDGASKGVMQILNTIIRGERDGILVPVPQYPLYSAAISLFGGSLVPYYLEETANWGLDVNNLHSSVAAARSKGITVRAMVIINPGNPTGQCLSEANLKEILHFCYQENLVLLGDEVYQQNIYQDERPFISARKVLMDMGPPISKELQLVSFHTVSKGYWGECGQRGGYFEMTNIPPQTVDEIYKVASISLSPNVPGQIFLGVMVNPPTPGDISYLQFMRESKGILESLRRRAQIMTDGFNSCRNVVCNFTEGAMYSFPQIRLPPKAIEAAKKAGKVADVFYCLKLLEATGISTVPGSGFGQKEGVFHLRTTILPAEEEMPAIMESFKKFNDEFMEQYEDHRGYSRMKNH

SEQ ID NO: 6862 - protein, 218 aa, Rosa rugosa
NGLLKKAYELSILCDAEVALIIFSNRGKLYEFCSSSSILKTLERYQKCSYGAMEVNEPAKELEQSSYREYLKLKTRCESLQRTQRNLLGEDLGPLNTKELEQLERQLESSLKHVRSTKTQYMLDQLSDLQSKEHMLIEANRDLTMKLDEINSGTQLRQTWERGHAHQTMLYGTQHAQTQGLMFQPLDCNPTLQIGYNAVGSQQMTAATPAPTQPVNGF

SEQ ID NO: 6863 - protein, 532 aa, Zea mays
  misc_feature (113)..(113): Xaa can be any naturally occurring amino acid
  misc_feature (199)..(200): Xaa can be any naturally occurring amino acid
VHTGPVLSAASTPRFLHAQPPQSVAFPSATAIRRAKSAAIPLRPQRPPAAISPPAAPAIRRLSIRGRNRFHPRPQSTAPNPPPHPCARNASTLLLSPYMHFGELSVRKVFHQXNDSNHAGEESCTLFLRSIGLREYSRYLTFNHPCSHEKPLLSHLRFFPWVVNEVYFKVWRQGRTGYPLVDAGMRELWATGWVHDRIXXVVVSSFFVKVLQLPWRWGMKYFWDTLLDADLESDALGWQYISGSLPDGRELDRIDNPQFEGYKFDPHGEYVRRWLPELARLPTEWIHHPWDAPESVLQAAGVELGSNYPRPIVELDAANSRLQDALSEMWELEAASRAAMENGMEEGLGDSTDEPPIDFPQELRMEVDRQPVQPAIHAPGVTGRRREDQMVPSMTSSFIRAETELTADFGHTSEDSRPEVPSNIHHLQARPEREETVDGGTGNAVRVHGNHHQQNLQNNMHRVLGIAPSISEASSSWTGRDGGVVPVWSPPAASGHSDSYAADEADISSRGYLDRHPQSHTMMNWSQLSQSL

SEQ ID NO: 6864 - protein, 481 aa, Pseudomonas syringae
MSQKTLTTASGAPVADNQNSRSAGPRGPLLLDDFHLIEKLAHFNRENIPERRVHAKGSGAHGTFTVTRDISQYSSAKLFDTVGKQTPIFLRFSTVGGERGSADTERDPRGFAIKFYTEEGNWYIVGNNTPVFFIRDPLKFPDFIHTQKRLPQTNLKSPQMMWDFWSHSPEALHQVTILFSDRGIPDGYRHMHGFGSHTYSLISAAGERHWVKWHYKTRQGIKNLTPAEAARIAGTDPDYAQRDLFTAIERGDFPKWQVCIQLMSEAQAANHHENPFDVTKTWSQKEYPLIEVGELELNRNPLNYFAEVEQAAFGPSNMVPGVGLSPDRMLQGRVFAYADAHRYRVGTNHQQLPINAPRNPVHSYQRDGSMAFGTNGGAAPNYEPNSYSDAPKEDPRYAEPALALSGAAGRHDHRVDGDYYSQAGKLFNLMSDDQKALLISNIAGAMGGVSSDIVQRQLQHFYRADPAYGEGIANALGIKLG

SEQ ID NO: 6865 - protein, 606 aa, Anabaena variabilis
MKIGAHYLGNGECEFTVWSPKLNSVAVQILKPEQQLIPLKPLAEGYWQIKVNDVYPGTLYRYQLNDQEAFADPASQYQPEGVHGASEVVDHQFEWTDENWSGVPLESMIFYEVHVGTFTPEGTFTAIIPRLSELRELGINAIEIMPIAQFPGDTHIEADLAYRNWGYDGVYPFAVQNSYGSPSDLKQFVNACHENGIAVVLDVVYNHFGPEGNYMGQFAPYFTRTYKTPWGNAMNFDDAYSQGVRNYFIENALYWLEEFHIDGLRLDAIQAIYDLGAKHFLRELAEVVHNFSQRGTWKRLLIAESDLNNPQIIRPVELGGYGLDAQWSDDFHHALHALLTGDRQGYYQDFGKCADLAKAYADTFVYDWRYAPHRKRFHGISCRDRPLSQFSVCIQNHDQIGNQMQGERLSERISFAGLKLAAGAVLLSPYLPLLFMGEEYGETAPFIYFVSHSDPDLIQAVRAGRKEEFEAFHYAEDPPDPESAETFLRCKLNWELRHQGQHKVLWDWYRQLIHLRKTHPALQNYDRDSIEATSDEDKQIVVVRRWCESGEVILVMNFNTSPVTVVLPIQKSVRKLLDSSDSGGVEKLSVGEEVVLQPTSLVLYEV

SEQ ID NO: 6866 - protein, 337 aa, Yersinia pseudotuberculosis
MKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVAAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 6867 - protein, 512 aa, Zea mays [sequence omitted]

SEQ ID NO: 6868 - protein, 529 aa, Bacteroides thetaiotaomicron
MMMKKIKVYALLVCLLATSAAQAQSFGSAAMRKLQMAEFAISNFYVDKVDEDKLVEEAIIKMLAQLDPHSTYSDAEEVKKMNEPLQGNFEGIGVQFQMIEDTLLVVQPVSNGPSEKVGILAGDRIIAVNDSAIAGVKMSTEDIMKRLRGPKGSKVNLTIVRRGVQDPLVFTVKRDKIPILSLDASYMIQPKIGYIRINRFGATTAEEFKKAMKDLQKQGMKDLILDLQGNGGGYLNAAIDLANEFLGQKELIVYTEGRTAQRSEFFAKGNGEFRDGRLIVLVDEYTASASEIVSGAVQDWDRGIIVGRRSFGKGLVQRPIDLPDGSMIRLTIARYYTPAGRCIQKPYDSSTDYNKDLIDRFNHGELMNADSIHFPDSLKVQTKKLKRTVYGGGGIMPDYFVPIDTTLYTDYHRKLVGKGVIIKFTMKFIEDHRKELADKYKKFDSFNEKFVIDDDMLATLREMGEKEGVKFNEEQYQKALPLIKTQLKALIARDLWDMNEYFRVMNTTNESVQKALEIFRSGEYQKKLK

SEQ ID NO: 6869 - protein, 830 aa, Triticum aestivum
MLCLTAPSCSPSLPPRPSRPAADRPGPGISGGGNVRLSAVPAPSSLRWSWPRKAKSKFSVPVSAPRDYTMATAEDGVGDLPIYDLDPKFAGFKEHFSYRMKKYLDQKHSIEKHEGGLEEFSKGYLKFGINTENDATVYREWAPAAMDAQLIGDFNNWNGSGHRMTKDNYGVWSIRISHVNGKPAIPHNSKVKFRFHRGDGLWVDRVPAWIRYATFDASKFGAPYDGVHWDPPSGERYVFKHPRPRKPDAPRIYEAHVGMSGEKPEVSTYGEFADNVLPRIKANNYNTVQLMAIMEHSYYASFGYHVTNFFAVSSRSGTPEDLKYLVDKAHSLGLRVLMDVVHSHASSNKTDGLNGYDVGQNTQESYFHTGERGYHKLWDSRLFNYANWEVLRFLLSNLRYWMDEFMFDGFRFDGVTSMLYNHHGINMSFAGSYKEYFGLDTDVDAVVYLMLANHLMHKLLPEATVVAEDVSGMPVLCRSVDEGGVGFDYRLAMAIPDRWIDYLKNKDDLEWSMSGIAHTLTNRRYTEKCIAYAESHDQSIVGDKTMAFLLMDKEMYTGMSDLQPASPTIDRGIALQKMIHFITMALGGDGYLNFMGNEFGHPEWIDFPREGNNWSYDKCRRQWSLADIDHLRYKYMNAFDQAMNALDDKFSFLSSSKQIVSDMNEEKKIIVFERGDLVFVFNFHPSKTYDGYKVGCDLPGKYKVALDSDALMFGGHGRVAHDNDHFTSPEGVPGVPETNFNNRPNSFKILSPSRTCVAYYRVEEKAEKPKDEGAASWGKTALGYIDVEATGVKDAADGEATSGSEKASTGGDSSKKGINFVFLSPDKDNK

SEQ ID NO: 6870 - protein, 621 aa, Listeria monocytogenes
MCGFVGCVHDRITEITGADKETFRQMNSMITHRGPDDEGYFTDDHVQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDDKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPGVFKSLLNNVARIMPEGMRGKSFLERGTTPMEERYIGNAKMFTEKEKQILLPKYQAGHDYTNITDPFYAETTNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLDLLDDHCAGKFDYSRKIWTVVIFMIWYDVYVADKYDFGK

SEQ ID NO: 6871 - protein, 262 aa, Bacillus anthracis
LVRLGVFKVEEGPELVEAVKSAIKAGYRSIDTAAIYGNEKAVGEGIRAGIEATGISREDLFITSKVWNADQGYEETIAAYEESLKKLELDYLDLYLVHWPVEGKYKDTWRALETLYKEKRVRAIGVSNFQVHHLQDVMKDAEIKPMINQVEYHPRLTQKEVQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 6872 - protein, 359 aa, Streptomyces avermitilis
MSALFEPYSLRDLTIPNRVWMAPMCQYSAAPQGPAAGAPHDWHFAHYAARATGGTGLIVVEATAVSPEGRISPYDLGIWNDTQVEAFRRITRFLAAQGTVPAIQLAHGGRKASTDRPWKGGAPLAADEHGWQPLGPSPVAFDERHPVPTELSVAEIRQIVGQFADAARRALAAGFEIAEIHGAHGYLINEFLSPHSNRRTDEYGGSYENRVRFALEVVDAVREVWPAGKPLFFRVSATDWLDEGGWTADDTVRFAAELQAHGVDLLDVSTGGNASGVRIPTGPGYQVPFAARVKAGTSLPVAAVGLITDAEQAEKILANGEADAILLGRELLRNPSFARLAARELGGDVHVPAQYHRSV

SEQ ID NO: 6873 - protein, 178 aa, Triticum aestivum
MSLIRRSNVFDPFSLDFFDPFDGFPFGSGSNSSGSLIPRTSSDTAAFAGARIDWKETPEAHVFKADVPGLKKEEVKVEVEDGNILQISGERNKEQEEKTDTWHRVERSSGKFLRRFRLPENAKAEQVKASMENGVLTVTVPKVEAKKPEVKSIQISGQSDEVECRAVAWSLAPVVVIK

SEQ ID NO: 6874 - protein, 439 aa, Kluyveromyces lactis
MEANIISNQSNWNARQMPNVSRATKKLKKLLDPYVDHMKQSYELDQNNHIYVDPILTKRSIYSPANFSVPGRYEILQVLGKGSYGTVVSAVDKGNPTHEVQLAIKKVTSIFTREILLKRAIRELKFMSYFKGHRNIVSLIDLEIVNEEPYSGLYCYQELVDYDLARVIHSNVLFSEFHIKHFLYQILCGMKYIHSADVIHRDLKPGNILCSITGEIKICDFGLARGISPSFTVAGGISNHITNYVATRWYRAPELILSHKRYSKSVDMWAVGCILAEFYGRKPVFMGNDSLHQVMEIQKILGTPKQIVIRTYGSSRCYDIFSTSKPQYKKTPWCEIFPYASSEAVDLMERLIDWNPEARLTVEEALDHPFLQQVRNPEAEPICPHGPFDFTYEKHLYSMERLRECLCDEVSKFHNDRQTKDFVSPPLMTPHFIAESNSY

SEQ ID NO: 6875 - protein, 492 aa, Oryza sativa
MSHTSEEESLNNLQQQPKLEACAAGSSKGDTVMPVVKKRRGHPGNPDPDVEVVALSPKTLLATNRYICEVCHKGFQRDQNLQLHRRGHNLPWKLKQRSSTEAKKKVYVCPEITCPHHDATRALGDLTGIKKHYSRKHGEKKWKCDRCSKKYAVQSDWKAHTKICGTKEYRCDCGTIFSRKDSFITHRAFCDALAEDTSRVNHSLATMVGSLHGQQQDMFSHGVPSFSSSPTDMIANLASNDHNSDSHLRSLSPYALVTRNTTLFSNQISPKESGFPLDGSVTSYPYMSMNSPYMSATALLQKAAEMGAKTSQDPISPLLLKSFPNNLTSSRDHMNISSRSQGDSLGNSTVNSDCMKTTEDENSYMIGRGNILINAPWSSGIMRPGTVPLIGLMNHPFSMREEKDNPSIFPENQTQHNRQDNISGVVDADAGLTQDFLGLGGSGTLDMSSETYNADVTALSYSDEQEKPQEHIYSYHQSSLDPTALEKPIWDS

SEQ ID NO: 6876 - protein, 714 aa, Botryotinia fuckeliana
MYLATVLSLVGLVTAQCPYGMDKQPQKREPKDSQTSSSNFLDQFTLNDTNTYFTTDAGGPIQEDTSLKAGARGPTLLEDFIFRQKIQHFDHERVPERAVHARGAGAHGIFTSYGNYSNITAASFLNQEGKETPVFVRFSTVAESRGSADTARDVHGFATRFYTDEGNFDIVGNNIPVFFIQDAILFPDLIHAVKPSPDNEIPQAATAHDSAWDFFSQQPSSLHTLFWAMAGNGIPRSFRHMDGFGIHTFRLVTDSGTSKLVKWHWKSKQGKASLVWEEAQVLAGKNADFHRKDLWDAIESGNGPEWELGIQIVEEEDVLKFGFDLLDPTKILPEELVPVQKIGVMRLNANPRNYFAETEQVMFQPGHIVRGIDFTDDPLLQGRIFSYLDTQLNRHGGPNFEQLPINRPIVPVHNNNRDGAAHNYIPLNTAAYSPNTLNDAAPKQANQTVGRGFFTAPGRTVSGHLVREVSSTFSDVWSQPRLFYNSLIPVEQQFLINAIRFETSQLTSSVVKSNVLIQLNRVSHDLAARVASVLNLPVPEADNTYYNDNKTSSITIFGNELPTIATLNVGVLVSVKNNATLTQAANLATSFSTSGVNVKVIGEILTNGVDATYSASDATLFDGIIVTDGAENLFTNGSKSTYFPADRPRQILLDAYNWGKPVGTLGNARTSLNVASISTTPGVYSNSTSVSGLVKEFEAGLKTFRFVDRFALDD

SEQ ID NO: 6877 - protein, 142 aa, Unknown
  Silicibacter sp. TM1040
MPLKYLHTMVRVKDLEKSMAFYALLGLKETRRYDSEAGRFSLIFMAPPGQEEAPVELTWNWDGDDELPSDSRHFGHLAYEVDNIYETCQHLMDNGVVINRPPRDGRMAFVRSPDNISIELLQAGDALPPAEPWSSMENTGHW

SEQ ID NO: 6878 - protein, 850 aa, Geobacter sulfurreducens
MRQKAAAPSRAFLLERVNYLEEANHRYLSILDMLASSSMFHSDLGRAKDPQEIFRATLTQLRRVLDCRMTGFLISCSDGSFKLVSWEPDEGHDEIQRIIDAKIVDGTFAWALNRNQAILVPLADDRSLLLHVVATRSRIRGMFAGILPGSSHSPDAATLNAVSVIMHTCAHSLESTELYSMVRDTLASLEQRVQERTRDLAAAREQAESASRAKSDFLANMSHEIRTPLNGIMGMTDLLLGGGLNQTQQHQYLGAIKGSADCLMGVIGDILDFSKIEAGKVELDPVPFSLRTFVGQAVRSLSARAAEKGVELVCDPREDVIDPLIGDCGKLRQVLVNLVGNAIKFSDGGEVVVAVETAAVEGNEVLLRFSVSDQGCGIAPEALDRIFNVFEQADSSTTKRFGGTGLGLAISRRIVQLMGGDIRVESAPGEGSTFYFTCRFQLRPPEPDSLADHGLAGRPVLVVEAPTSSRRVLVSYLTGWGMRPRVAATVDDALELAAGMTTAAGEPLMALVDKKSLGAGWQEALQRLTEGVGTELRLILMTEVGDVVEKESRLWPDKARCLLKPLVHGDLGEAIVSALTGREPSETPPRSAQPGSGPGLSILVADDVEVNRMLVNAILGRMGHRVAQAANGEEVLKALEDSRFDLVLMDVQMPVMDGFETARRIREQERGSGRRTPILALTAYAGRQDREQCLSADMDGYVAKPFTAEELVRAVHSCCGVDGSLDGAGDGRETAPAVADEAPPVFDRQGLLARLRGKDELVPKFVGMFRDGTEKNLAKLWEAVEKRDVAGLRVGAHAIVGAAGNIGAQRVLALALRIEDAAISGRLDEAVSLLQPLAAEYDTFVRETER

SEQ ID NO: 6879 - protein, 441 aa, Arabidopsis thaliana
MANKYVSSVLKSLLVLLHLVFLSKQHVDSASIVKSLPGFEGQLPFELETGYIGVGEEEEVQLFYYFIKSERNPKEDPLILWLTGGPGCSAISGLLFENGPLTMKLDVYNGTLPSLVSTTYSWTKTSSIIFLDQPVGTGFSYSRTQQFNKPSDSGEAKRIHEFLQKWLGKHQVFSSNPFYVAGDSYSGLVVPATVQEISKGNYECCNPPINLQGYVLGNPLTDYTTGSNSRIPFAHGMALISDELYESLKKTCKGEYTNVHPRNTQCLKFVEEFNKCTNRIFQQLILDPLCETETPDCYIYRYLLTTYWANDATVREALQINKESIGEWVRCYYSIPYNNDIKSSMPYHVNNSISGYRSLIYSGDHDFEVPYLGTQAWIRSLNYSIIDDWRPWMVKNQIAGYTRTYANKMTFATIKGGGHTAESKPEEASIMFQRWINGQPL

SEQ ID NO: 6880 - protein, 472 aa, Shigella flexneri
MTTHLAWFRQDLRLHDNLALAAACRNSSARVLALYIATPRKWETHNMSPRQAELINAQLNGLQIALAEKGIPLLFREVDDFVASVEIVKQVCAENSVTHLFYNYQYEVNERARDVDVERALRNVVCEGFDDSVILPPGAVMTGNHEMYKVFTPFKNAWLKRLREGMPECVAAPKVRSSGSIKPAPSITLNYPRQSFDTAHFPVEEKAAIAQLRQFCENGAGEYEQQRDFPAVEGTSRLSASLATGGLSPRQCLHRLLAEQPQALDGGAGSVWLSELIWREFYRHLMTYYPSLCKHRPFIAWTDRVQWQSNPAHLQAWQKGKTGYPIIDAAMRQLNSTGWMHNRLRMITASFLVKDLLIDWREGERYFMSQLIDGDLAANNGGWQWAASTGTDAAPYFRIFNPITQGEKFDREGEFIRRWLPELRDVPGKAVHEPWKWAQKAGVKLDYPQPIVEHKEARVQTLAAYEAARKGK

SEQ ID NO: 6881 - protein, 511 aa, Oryza sativa
MARMGISKGGSGKEAKKPPLLLGRFEVGKLLGQGNFAKVYHARNVATGEEVAIKVMEKEKIFKSGLTAHIKREIAVLRRVRHPHIVQLYEVMATKLRIYFVMEYVRGGELFARVARGRLPEADARRYFQQLVSAVAFCHARGVFHRDIKPENLLVDDAGDLKVSDFGLSAVADGMRRDGLFHTFCGTPAYVAPEVLSRRGYDAGGADLWSCGVVLFVLMAGYLPFQDRNLAGMYRKIHKGDFRCPKWFSPELIRLLRGVLVTNPQRRATAEGIMENEWFKIGFRRFSFRVEDDRTFTCFELDDDAAVDAPTSPPDTPRTVDSGDVGSAPTRPRKAGSLTSCDSAPSLLEGRFGLGGSSRRRSSLNAFDIISFSPGFDLSGLFDQDDGGGAGAGSIPEQQKHTARFVSAAPVEVIVATLEAAAAAAGMAVREREDGSISMEGTREGEHGALAVAAEIYELTPELVVVEVRRKAGGAAEYEEFFRARLKPSLRELVCDDRPCPEDSGELSRSL

SEQ ID NO: 6882 - protein, 558 aa, Sulfolobus solfataricus
TFAYKIDGNEVIFTLWAPYQKSVKLKVLEKGLYEMERDEKGYFTITLNNVKVRDRYKYVLDDASEIPDPASRYQPEGVHGPSQIIQESKEFNNETFLKKEDLIIYEIHVGTFTPEGTFEGVIRKLDYLKDLGITAIEIMPIAQFPGKRDWGYDGVYLYAVQNSYGGPEGFRKLVDEAHKKGLGVILDVVYNHVGPEGNYMVKLGPYFSQKYKTPWGLTFNFDDAESDEVRKFILENVEYWIKEYNVDGFRLDAVHAIIDTSPKHILEEIADVVHKYNRIVIAESDLNDPRVVNPKEKCGYNIDAQWVDDFHHSIHAYLTGERQGYYTDFGNLDDIVKSYKDVFVYDGKYSNFRRKTHGEPVGELDGCNFVVYIQNHDQVGNRGKGERIIKLVDRESYKIAAALYLLSPYIPMIFMGEEYGEENPFYFFSDFSDSKLIQGVREGRKKENGQDTDPQDESTFNASKLSWKIDEEIFSFYKILIKMRKELSIACDRRVNVVNGENWLIIKGREYFSLYVFSKSSIEVKYSGTLLLSSNNSFPQHIEEGKYEFDKGFALYKL

SEQ ID NO: 6883 - protein, 547 aa, Pasteurella multocida
MAAKDVKFGNDARVKMLAGVNILADAVKVTLGPKGRNVVLDKSFGAPTITKDGVSVAREIELEDKFENMGAQMVKEVASKANDAAGDGTTTATVLAQAIVNEGLKAVAAGMNPMDLKRGIDKAVTAVVTELKALSKPCETSKEIEQVGTISANSDSIVGQIIAQAMDKVGKEGVITVEDGTGLEDELAVVEGMQFDRGYLSPYFINKPETATVELDNPFILLVDKKVSNIRELLPVLEGVAKAGKPLLIIAEDVEGEALATLVVNTMRGIVKVAAVKAPGFGDRRKAMLQDIAILTAGTVISEEIGMELEKATLEDLGQAKRVVINKDNTTIIDGIGDEAQIQGRVAQIRQQIEESTSDYDKEKLQERVAKLAGGVAVIKVGAATEVEMKEKKARVEDALHATRAAVEEGIVAGGGVALIRAASKVAGLQGDNEEQNVGIKLALRAMEAPLRQIVANAGEEASIVASAVKNGEGNFGYNAGTEQYGDMIEMGILDPTKVTRSALQFAASVAGLMITTECMVTDLPKEDKADLGAAGMGGMGGMGGMM

SEQ ID NO: 6884 - protein, 558 aa, Sulfolobus solfataricus
TFAYKIDGNEVIFTLWAPYQKSVKLKVLEKGLYEMERDEKGYFTITLNNVKVRDRYKYVLDDASEIPDPASRYQPEGVHGPSQIIQESKEFNNETFLKKEDLIIYEIHVGTFTPEGTFEGVIRKLDYLKDLGITAIEIMPIAQFPGKRDWGYDGVYLYAVQNSYGGPEGFRKLVDEAHKKGLGVILDVVYNHVGPEGNYMVKLGPYFSQKYKTPWGLTFNFDDAESDEVRKFILENVEYWIKEYNVDGFRLDAVHAIIDTSPKHILEEIADVVHKYNRIVIAESDLNDPRVVNPKEKVGYNIDAQWVDDFHHSIHAYLTGERQGYYTDFGNLDDIVKSYKDVFVYDGKYSNFRRKTHGEPVGELDGCNFVVYIQNHDQVGNRGKGERIIKLVDRESYKIAAALYLLSPYIPMIFMGEEYGEENPFYFFSDFSDSKLIQGVREGRKKENGQDTDPQDESTFNASKLSWKIDEEIFSFYKILIKMRKELSIACDRRVNVVNGENWLIIKGREYFSLYVFSKSSIEVKYSGTLLLSSNNSFPQHIEEGKYEFDKGFALYKL

SEQ ID NO: 6885 - protein, 206 aa, Candida albicans
LFKNIAAGNYPSWTAYIQTMTEAEAKEAEFSVFDLTKVWPHKKYPLRRFGKFTLNENPKNYFAEVEQAAFSPAHTVPYMEPSADPVLQSRLFSYADTHRHRLGTNYTQIPVNCPVTGAVFNPHMRDGAMTVNGNLGSHPNYLASDKPVEFKQFSLQEDQEVWNGAATPFHWKATPADFKQAQELWKVLKRYPNQQEHLAHNIAVHA

SEQ ID NO: 6886 - protein, 293 aa, Candida albicans
MKKALPEHAKLSKESKECIQECVSEFISFITSQAADRCLVEKRKTLNGEDILWAMYTLGFENYSETLKIYLAKYRQYEQEQLSLKPPRKKIRKRKTKSSLSQTQSKEQVDQDQDFQQIEQQYDDGEEEEEESENEEGDMSNIESNLILQNLPEYSDDYFDDEDEEEDRQQQREENSDNEPQQHHGDDSQPINLQPQLPSSAVPSLPTQQQQQFSDINPTTESNQQESFFTTQYYPNQTQYVNAAPLPTNPQPRQYQNQNQPNNYQNDQRQNDKQRIIPDLLNITNSYSEDEFI

SEQ ID NO: 6887 - protein, 242 aa, Unknown
  Petunia x hybrida
  misc_feature (120)..(120): Xaa can be any naturally occurring amino acid
MEFQSDLTREISPQRKLGRGKIEIKRIENTTNRQVTFCKRRNGLLKKAYELSVLCDAEVALIVFSSRGRLYEYANNSVKATIERYKKACSDSSNTGSIAEANAQYYQQEASKLRAQIGNXQNQNRNFLGESLAALNLRDLRNLEQKIEKGISKIRAKKNELLFAEIEYMQKREIDLHNNNQYLRAKIAETERSQQMNLMPGSSSYDLVPPQQSFDARNYLQVNGLQTNNHYPRQDQPPLQLV

SEQ ID NO: 6888 - protein, 544 aa, Agrobacterium tumefaciens
MAAKEVKPGASAREKMLKGVDILADAVKVTLGPKGRNVVIDKSFGAPPITKDGVSVAKEIELEDKFENMGAQLVREVASKTNDIAGDGTTTATVLAQAIVREGAKAVAAGMNPMDLKRGIDLAVAEVVKDLQAKAKKINTSEEVAQVGTISANGERQIGLDIAEAMQRVGNEGVITVEEAKTAETELEVVEGMQFDRGYLSPYFVTNPEKMVADLEDAYILLHEKKLSNLQAMLPVLEAVVQTGKPLVIIAEDVEGERLATLVVNKLRGGLKIAAVKAPGFGDRRKAMLEDIAILTGGTVISEDLGIKLESVTLDMLGKSKKVSISKENTTIVDGAGQKSDIEGRVAQIKAQIEETTSDYDREKLQERLAKLAGGVAVIRVGVSTEVEVKEKKDRIDDALKPTRAAVQEGIVPGGGVALLRSSTKITVKGVNDDQEAGINIVRKALQSLVRQIAENAGDEASIVVGKILDKNEDNYGYNAQTGEYGDLIALGIVDPVKVVRTALQNAASVASVLITTEAMIAELPKKESAMPQMPGGGMGGMDF

SEQ ID NO: 6889 - protein, 288 aa, Lactobacillus plantarum
MTKTPTITLNDGRAIPAIGFGTFQIPDDGSTYQAVKEALVIGYRHIDTAVAYFNEDEVGQAIKDSGIPRDQIWVTSKLWLQDYGFDAASRAIDRSLTKLRLDYIDLYLIHQPYGDVPGAWQAMEAAQKAGKLKSIGVSNMTPTLWQKFVPQFETIPAVNQVEFNPYFQQQPLRQLLAAQDVKLEAWAPLGQGNQALFKEPIIQQLAIKYHKDAGQIILRFEHQEGVIVFPKSVHSARIKSNRDIFDFELTSTEMAQLRALDTGKGHHDPDAPGVSEQLLHAFDVHADD

SEQ ID NO: 6890 - protein, 786 aa, Mesorhizobium loti
MLGLRMPEYSSFIRFVRVRYLSGLLIFALASTAIMVALNRVNSFRHEIDALSSNLVVFTRDLRNATSFAETTGSAWRNETRDALTASARDHSERLTSEIDTLSAQFAALRSRLSAKTLNELETASVNGDLFWSAHDMVRNFNLMSVAQKADEWSYREIRNQNDLFVQPMLVRVRTAMDEERHLADASSDRLLLWASGLLFGVLAIVAFWIFRPMEQAIRRAFAQSAESLFKAEAADRAKSEFLANMSHEIRTPMNGVLGMAELLAKTELTPRQKTFTDVIVKSGNALLTIINDILDFSKINAGQLTLDPAPFRLTEAVEDVATLVSARVAEKNLELIVRVDPRLPAHVVGDAGRFRQIVTNLVGNAVKFTEKGHVLIDVGGETVNDVVQLRLRVEDTGIGIPAEKLQNVFEKFAQVDGSSTRRHEGTGLGLAIAARLVDLMAGKIGVESEIGRGSVFWFAVPLPVHHAEAREAIVPVDVTGARVLVIDDNPVNREILLEQLRSWSFDCAAAESGAVGLAFLDRACQLGASVDCIILDYQMPGMNGADVARAIAADSRLSAIPIVILTSVDQVDFGKMIIDFGISAHLTKPARSAVLLGTVISVIQKARSQGGKAQFIREPVQPKPVPQAAPPAFTVIRGPAVPVMAVPESTAMPNGPIDILIAEDNEVNQLVFGQILNGLGLSYRIAGNGRTAVEMYRSLHPKLILMDVSMPEMNGYEATRAIRAIETSSGGHIPIIGVTAHALKGDRDKCIEAGMDDYLPKPVSPDRLGTKIGTWLSETVVAKTA

SEQ ID NO: 6891 - protein, 226 aa, Asparagus virgatus
MGRGKIEIKRIENTTNRQVTFCKRRNGLLKKAYELSVLCDAEVALIVFSSRGRLYEYANNSVKATIERYKKACTDTTNTGTVSEANSQYYQQEASKLRQQITNLQNSNRNLMGESLSSMGLRDLKQLESRLEKGISKIRSKKNELLYAEIEYMQKREMELQNDNMYLRNKIAENERAQQQMNMLPAATSNEYEGMPQFDSRNFLQVNLLDPNHHYSQQQQTALQLG

SEQ ID NO: 6892 - protein, 288 aa, Lactobacillus plantarum
MMVPTTKLNNGVVMPQLGFGVFQVPDLNECEAAVTAALKAGYRLIDTATAYQNETAVGRAIQKSGLRRDELFVTSKLWVSEFTYERAKQGIDASLQRLGVDYLDLYLLHQPYGDVMGAWRALEEAYHAGKIRAIGVSNFYADQLKNLELTMSVQPAVNQIEVNPWYQQADEVRFNQDEHVRVEAWAPFAEGKHAIFSNPSIQTIAQAHGKTTGQVILRWLLQRGITVIPKSVHPERMAENIAVFDFELTAAEMSAMAELDQGVSQFFDHRDPVTIEQIFGASLRQLHE

SEQ ID NO: 6893 - protein, 440 aa, Glycine max
MMGEKSNSNSGDAINSTLLHGKYELGRLLGHGSFAKVYHARHLNTGKSVAMKVVGKEKVVKVGMMEQIKREISAMNMVKHPNIVQLHEVMASKSKIYIAMELVRGGELFNKIARGRLREETARLYFQQLISAVDFCHSRGVFHRDLKPENLLLDDDGNLKVTDFGLSTFSEHLRHDGLLHTTCGTPAYVAPEVIGKRGYDGAKADIWSCGVILYVLLAGFLPFQDENLVALYKKIYRGDFKCPPWFSSEARRLITKLLDPNPNTRITISKIMDSSWFKKPVPKNLVGKKREELNLEEKIKHQEQEVSTTMNAFHIISLSEGFDLSPLFEEKKREEKELRFATTRPASSVISRLEDLAKAVKFDVKKSETKVRLQGQENGRKGKLAIAADLYAVTPSFLVVEVKKDNGDTLEYNQFCSKELRPALKDIVWRTSPAENPTLA

SEQ ID NO: 6894 - protein, 118 aa, Triticum aestivum
  misc_feature (83)..(83): Xaa can be any naturally occurring amino acid
  misc_feature (94)..(94): Xaa can be any naturally occurring amino acid
  misc_feature (99)..(99): Xaa can be any naturally occurring amino acid
  misc_feature (103)..(103): Xaa can be any naturally occurring amino acid
  misc_feature (107)..(107): Xaa can be any naturally occurring amino acid
FERDDGIFTVLSERATALHKAFSQMEGVECAEPQGSMYLFPTINLPAKAAEAAKAEGRSADEFYCMRLLEATGICVVPGSGFXQKENTLHFRTXFLAPXTERXGRIXKFHNEFLDKYR

SEQ ID NO: 6895 - protein, 131 aa, Zea mays
QSDETRKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 6896 - protein, 131 aa, Zea mays
QSDETRQMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 6897 - protein, 152 aa, Triticum aestivum
MSIVRRSNVFDPFADLWADPFDAFRSIVPAISGGSSSETAAFASARVDWKETPEAHVFKADLPGVKKEEVKVEVEDGNVLVVSGERSREKEDKNDKWHRVERSSGKFARRFRLPEDAKVEEVKAGLENGVLTVTVPKAHVKKPEVKAIEISG

SEQ ID NO: 6898 - protein, 131 aa, Zea mays
QSDETWKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 6899 - protein, 60 aa, Zea mays
QSDETWKMGDIVHTLTNRRWLEKCVTYAESHDQALVGDKTIAFWLMDKDMYDFMALDRPS

SEQ ID NO: 6900 - protein, 512 aa, Pseudomonas fluorescens
MNSTLGSGIIPRRTIGVLAASLLTLSVNAAPLTRDNGAAVGDNQNSQTAGANGPVLLQDVQLIQKLQRFDRERIPERVVHARGTGAHGTFTTTNDLSDLSKAKVFTAGQVTPVFVRFSAVVHGNHSPETLRDPRGFATKFYTADGNWDLVGNNFPTFFIRDAIKFPDMVHAFKPDPRTNLDDDSRRFDFFSHVPEATRTLTELYSNSGTPASYREMDGNSVHAYKLVNAKGDVHYVKFHWKSLQGIKNLDPKQVEKVQGRDYSHMTHDLVENIQKGNFPKWDLYIQVLNPQDLSKFEFDPLDATKIWPGVPERKVGQMVLNRNPANVFQETEQVAMAPSNVVPGIEPSEDRLLQGRIFAYADTQMYRLGANALQLPINAAKTAVNNGNQDGAMNAGASTSGVNYEPSRLQPREETAGARYSQTALQGSTQQAKIQREQNFKQAGDLYRSFSKKERQDLIESFGGSLASADDESKHIMLSFLYKADPEYGAGVTKVAKGDLSRVKALAAKLAD

SEQ ID NO: 6901 - protein, 497 aa, Vibrio vulnificus
MGLASISVHAQTLTRDNGAPVGDNQNSITAGENGSVLLQDVHLIQKLQRFARERIPERVVHARGTGAHGEFVVSGDFSDLTLSSPFAQSGKVTPVFVRFSTVIHSKGSPETLRDPRGFATKFYTDQGNWDLVGNNLPVFFIRDSIKFPDMVHSLKPSPVTNLQDPNRFFDFFSSQPSATNMLTWVYTNLGTPASYRTMDGFGVHAYKWINRKGEVNYVKFHWKSQQGVKSLRPAEVTKVQGEDFNHLTNDLYTQINAGNFPKWDLYVKVLSPKALSKLDYNGLDATKVWLDVPEKKVGTMTLNRVPDNFFLETEQSAFAPSNIIPGIEPSEDRLLQGRLFAYADTQLYRLGANLFQLPVNSPKSPVANHNQDGPSNNSTGLGNVDSLDVNYEPSRLVNLTVDKQARAVETPLSGHVQQQAIRNPRDFFQAGVLYRSLSEQDKADLIHNLSGDLNKVNDAEVKAIMVSYFYRADKEYGTRLAKATDVNLKQVTKLASM

SEQ ID NO: 6902 - protein, 216 aa, Daucus carota
MAAPPARPRADYDYLIKLLLIGDSGVGKSCLLLRFSDGSFTTSFITTIGIDFKIRTIEMDGKRIKLQIWDTAGQERFRTITTAYYRGAMGILLVYDVTDESSFNNIRNWIRNIEQHASDNVNKILVGNKADMDESKRAVPTSKGQALADEYGIKFFEASAKTNMNVEEVFFSIAKDIKQRLAETDSKTEPQTIKINQQEQGAGTSAASQKSACCGS

SEQ ID NO: 6903 - protein, 471 aa, Escherichia coli
TTHLVWFRQDLRLHDNLALAAACRNSSARVLALYIATPRQWATHNMSPRQAELINAQLNGLQIALAEKGIPLLFREVDDFVASVEIVKQVCAENSVTHLFYNYQYEVNERARDVEVERALRNVVCEGFDDSVILPPGAVMTGNHEMYKVFTPFKNAWLKRLREGMPECVAAPKVRSSGSIEPSPSITLNYPRQSFDTAHFPVEEKAAIAQLRQFCQNGAGEYEQQRDFPAVEGTSRLSASLATGGLSPRQCLHRLLAEQPQALDGGAGSVWLNELIWREFYRHLITYHPSLCKHRPFIAWTDRVQWQSNPAHLQAWQEGKTGYPIVDAAMRQLNSTGWMHNRLRMITASFLVKDLLIDWREGERYFMSQLIDGDLAANNGGWQWAASTGTDAAPYFRIFNPTTQGEKFDHEGEFIRQWLPELRDVPGKVVHEPWKWAQKAGVTLDYPQPIVEHKEARVQTLAAYEAARKGK

SEQ ID NO: 6904 - protein, 745 aa, Neurospora crassa
MAPSKVVIYAMRRELRLSDNPIFHHLSNPESKHGFSHLLPVYVFPAQQIDLSGFVPKGSENPHPAPKSAVGGYARCGPYRAKFLAESVWDLKTSLQSIGSDLLVRAGPYKDVIQSLVEGLKAKECQVGAVWMTSHEGSEEKSEEKTVASFCAKSGIDFKLWDDEKYLIHDRDTGITHLNDLPDVFTTYRKQIEPLREKARKTLPVPEKGALPAYPDIDMIPSQQPPFNIPGTCEELVDAVVRPVKNFLKDLPDFPEKAESSHPFRGGETSAHKRIDHLVLSGGMKSYKDSRNGLLGPDFSTKLSAYLAQGCVTARQIHHALVAYEDGTGTKYKGADGFGEGDNQGTETVRMELLWRDYMRLCHQKYGDKLFRVEGFNGKHTDYEGEDKKYGWRTANTSIALPGQEPTPEKVSEILARFNAGTTGMGLIDASQRELIHTGYTSNRTRQNVASFLAKHLEIDWRYGAEWYEMLLVDYDVSSNWANWQYVAGVGNDPRGAARIFNPVKQAFDYDKDGTYVRTWVPEVAKFENLENVFQAWTASKEDLKTAGLEGNIMVTDPVKPIKFNLDHKPSKVKKRPFFRKRGTKTRDAQGSAESPGSSDSHSGSGGSPDGSGGGNIPSESNCAAAGSGQAQQTHQGSGRSQSSSNHGGRSHSHQHNQQNYHHSHRGNDYTRGGGGGRGGRGGRGGGGGGYSASQGYYGIGGGYRGGGRGRGGGGGFRGRYAPTGGLGGHHHSEQQVASQFQTDA

SEQ ID NO: 6905 - protein, 505 aa, Oryza sativa
MEGAGRDGNPLGGYRIGKTLGIGSFGKVKIAEHILTGHKVAIKILNRRKIKSMEMEEKVKREIKILRLFMHPHIIRLYEVIDTPADIYVVMEYVKSGELFDYIVEKGRLQEEEARRFFQQIISGVEYCHRNMVVHRDLKPENLLLDSKCNVKIADFGLSNVMRDGHFLKTSCGSPNYAAPEVISGKLYAGPEVDVWSCGVILYALLCGTLPFDDENIPNLFKKIKGGIYTLPSHLSPLARDLIPRMLVVDPMKRITIREIREHQWFTVGLPRYLAVPPPDTAQQVKKLDDETLNDVINMGFDKNQLIESLHKRLQNEATVAYYLLLDNRLRTTSGYLGAEFHESMESSLAQVTPAETPNSATDHRQHGHMESPGFGLRHHFAADRKWALGLQSRAHPREIITEVLKALQELNVCWKKIGHYNMKCRWSPSFPSHESMMHNNHGFGAESAIIETDDSEKSTHTVKFEIQLYKTRDEKYLLDLQRVSGPQLLFLDLCSAFLTQLRVL

SEQ ID NO: 6906 - protein, 207 aa, Daucus carota
MERADQQARGFQGYRKIHQQQQLPASGTASTGTDNNPAAGDQDCLVREQDRFMPIANVIRLMRKSIPSHAKISDDAKELVQESVSEFISFVTSEANYRCQKEQRKTITAEDVLWAMSSLGFDDYVEPLTFYLDRFREADGGERSALRGEPLVRRSGEHGAPGIPPTFAPGYYMGPHNALLGAVTMGSFVNDVHNAGPSGAGVNTLDP

SEQ ID NO: 6907 - protein, 444 aa, Unknown
  x Doritaenopsis sp.
MSKMFGKEVPLSKMAVSKAHGEGSPYFAGWKAYEENRYDAVGNPDGVIQMGLAENQLSFDLLEEYLELHPEAFSWASDSSSFRENALFQDYHGLQTLRQALASFMEKIRGGRSKFDANRIVLTAGATAANEILTFILADRGDALLVPTPYYPGFLRDLQWRTGVTIFPVHCYSSNGFQLTLSSLEKAYAEAKASNFNVRGLLMTNPCNPLGTSASLSLLQDIIHFISDKTIHLISDEIYSGSVFSSTNLFSISDLITDAISEQVHIVYSLSKDLGLPGFRVGALYSYNDRVVKTARRMSSFSLVSSQTQRLLSFMLSDEEFTVRYIEKNRERLRERYELVVNGLKEAGIECLKGEAGLFCWVNMEKLMEEETKEGEAEPWKVIIDDLKLNISPGSSCCCAEPGWFRLCFANMSRETLEGVKRLKDFAQKKVAAKKKKMNNVYFC

SEQ ID NO: 6908 - protein, 76 aa, Zea mays
  misc_feature (1)..(1): Xaa can be any naturally occurring amino acid
XSDETWKMGDIVHTLTNRRWLEKCVTYAESHDQALVGDKTIAFWLMDKDMYDFMALDRPSTPTIDRGIALHKMIRL

SEQ ID NO: 6909 - protein, 721 aa, Oryza sativa
  misc_feature (9)..(9): Xaa can be any naturally occurring amino acid
  misc_feature (48)..(48): Xaa can be any naturally occurring amino acid
  misc_feature (372)..(372): Xaa can be any naturally occurring amino acid
MSASPSSMXSGAGAGEAGVRTVVWFRRDLRVEDNPALAAAARAAGEVXVPVYVWAPEEDGPYYPGRVSRWWLSQSLKHLDASLRRLGASRLVTRRSADAVVALIELVRSIGATHLFFNHLYGSIDPEFQIDPLSLVRDHRVKALLTAEGIAVQSFNADLLYEPWEVVDDDGCPFTMFAPFWDRCLCMPDPAAPLLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRELXATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPESVLQAAGIELGSNYPLPIVELDAAKTRLQDALSEMWELEAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTGREGGVVPVWSPPAASGPSDHYAADEADITSRSYLDRHPQSHTLMNWSQLSQSL

SEQ ID NO: 6910 - protein, 286 aa, Leuconostoc mesenteroides
MSLVDTYKLTNGIEIPIIGFGTWQSANGTEAYQSVRWALEAGYRHIDTAAVYGNEDSVGRAIKDSGIPRDELFVTTKLWNDAHTYERAIQALDTSLSKLGLDYVDLYLIHWPNPAALQKQGKDAWIDANADTWRALEDEYKIGKTTAIGVSNFQIEHLEALAKTQTIAPMVNQNFLNPSDNQQELVDYDKDHGMLNEAYSPLGTGKLVDLPQVVSLSEKYNKSVPQILIRWSLDKGFLPLPKSTHETYIKANADVFDFALTSAEIESLDSLTGVGGFHTDASSADF

SEQ ID NO: 6911 - protein, 730 aa, Pasteurella multocida
MVQLVSPSVINQFFEGTHADPFSVLGMHETEKGIEIRALLPDASRVVVIDRETHNAVCELEHVDERGFFAAVIPKTRTFFAYQLQVFWGAESQFIEDPYRFHPMLADLDNWLLSEGSHLRPYEVLGAHFMECDGVSGVNFRLWAPNAKRVSIVGDFNYWDGRRHPMRFHQKSGVWELFLPKASLGQLYKFELIDCHGQLRLKADPYAFSSQLRPDTASQISALPEIVPMTEQRRKANQFDQPISIYEVHLGSWRRNLENNFWLDYDQIADELIPYVKEMGFTHIEFLPISEFPFDGSWGYQPLGLYSPTSRFGTAEGFKRLIEKAHQAGINVILDWVPGHFPSDTHGLAAFDGTALYEHADPREGYHQDWNTLIYNYGRNEVRNFLSSNALYWLERFGLDGIRVDAVASMIYRDYSRAEGEWIPNQYGGRENLEAIEFLKHTNWKIDSEVQGAISIAEESTSFAGVTKPSTEGGLGFHFKWNMGWMNDTLSYMQKDPVYRQYHHDQMTFGMVYQYSENFVLPLSHDEVVHGKCSLLGKMPGDAWQKFANLRAYYGYMWGYPGKKLLFMGNEFAQGREWNYQESLDWFLLEEEHGGRWHQGVQLLVKDLNHIYQQHASLFELDGSPEGFDWLVVDDRQNSVFAFERRSKDGERIIVVSNFTPVPRHDYRFGVNMAGNYVEILNTDSAFYQGSNVGNYGEVGSEAIPSHARAQSICVSIPPLATIYLKYQGE

SEQ ID NO: 6912 - protein, 541 aa, Methanocaldococcus jannaschii
MCSISGIIVKDNQISAKYSIDMMKILKHRGRDNSGLLLDDEVIYFNDFEDVEDLEEEMIGNLSLAHNRLAIVGRYGVQPIPNEDETIWLVCNGEIYNYIELREYLKQNHEFRTDSDNEVIIHLYEEEKLEELDGDYAFAIYDKSKNVVRLARDMFGVKPLFYVDRDKYFAFASERKALWHLLINIDGCERDLDELNSKIKTLKPNSQLIYYLDDNRFEIIEGFKKLELNYMKERSYEEAKEYLDRALKNSVLKRVRGLDKVGIICSGGVDSSLIAKLASLYCEVILYAVGTENSEDLIYAERLAKDLNLKLRKKIISEEEYEEYVFKVAKAIDEVDLMKIGVGIPIYVASEMANEDGLKVVLSGQGADELFGGYARHERIYRERGEEELKKELLKDVYNLYKVNLERDDHCTMANGVELRVPFLDEEVVEIALSIPIEYKMSELSNRPYAESNISLKSEPINGLKNTNLNIKCVRSVRKKILRDVASQYLPDYIAYRPKKAAQYGSGGEKMIYKVAKKYGFSKKRINEFLDMLKRKIVSEF

SEQ ID NO: 6913 - protein, 397 aa, Pseudomonas aeruginosa
MWYHGILQPTLWQLIVATLALTHVSIISVTLYLHRHSAHRSVQLHPALKHFFRFWLWLTTGMNTRAWTAVHRRHHACCETPDDPHSPRFKGLLTVLLRGAELYRAEARNPETLQTYGRGCPDDWLERRLYSRFPNAGLGLMLGVDLVLFGVAGLTVWALQMIWIAFWAAGVINGLGHAFGYRTFECPDDSSNLLPWGVLVGGEELHNNHHAYPGSAKLSVQAWEFDLGWAWICLLRALGLAQVNRGLPTIQWDCDKRALDLEASGVILRNRLLVMAQYGKRVMRPLAREESARCDAATRHLLRRASRLLVRDPDRLSDLQQSLFHSAVGRSQVMQLACAHRLALQRTWSDAGADLGEVHAALKRWVTEAEASGIRPLREFAGLLCSYSLYAPRQIVP

SEQ ID NO: 6914 - protein, 142 aa, Thermotoga maritima
MLLGRREDIFRPFRELQREIDRLFDDFFRTEVRPAPDMDVFETDDEVVIEVEIPGIDRKDVQITVEENILKISGEKKLEREQKGKNYYYVERSAGKFERAIRLPDYVDVEKIKAEYKNGVLTIRVPKKEERKKKVIEVEVQE

SEQ ID NO: 6915 - protein, 130 aa, Zea mays
QSDETWKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFD

SEQ ID NO: 6916 - protein, 438 aa, Unknown
  Fervidobacterium sp. YNP
MIRRSDFPKDFIFGTATAAYQIEGAANEDGRGPSIWDVFSHTPGKTLNGDTGDVACDHYHRYKEDIQLMKEIGLDAYRFSISWPRIMPDGKNINQKGVDFYNRLVDELLKNDIIPFVTLYHWDLPYALYEKGGWLNPDIALYFRAYATFMFNELGDRVKHWITLNEPWCSSFLGYYTGEHAPGHQNLQEAIIAAHNLLRAHGHAVQAFREEVKDGKVGLTNVVMKIEPGDAKPESFLVASLVDKFVNAWFHDPVVFGKYPEEAVALYTEKGLQVPDSDMNIISTPIDFFGVNYYTRTLVVFDMNNPLGFSYVQGDLPKTEMGWEIYPQGLFDMLVYLKERYKLPLYITENGMAGPDKLENGRVHDNYRIEYLEKHFEKALEAINAGVDLKGYFIWSLMDNFEWAYGYSKRFGIIYVDYNTQKRILKDSALWLKEFLKS

SEQ ID NO: 6917 - protein, 544 aa, Unknown
  Acinetobacter sp. ADP1
MSAKDVKFGDSARSKMIAGVNVLADAVKVTLGPKGRNVVIDRSFGAPHITKDGVTVAKEITLKDKFENMGAQLVREVSSKTNDIAGDGTTTATVLAQAILNEGIKSVTAGMNPMDLKRGIDIAVRAVVENIRATAKPADDFKAIEQVGSISANSDETVGKLIAQAMEKVGKEGVITVEEGSGFEDALDVVEGMQFDRGYISPYFANKQDTLTAELENPFILLVDKKISNIRELITTLEAVAKTGKPLLIIAEDVEGEALATLVVNNMRGIIKVCAVKAPGFGDRRKAMLQDIAILTGATVISEEVGMSLEQASLQDLGTAHKITVSKENTVIVDGAGDANAIAERVQQIRAQIEESTSEYDKEKLQERVAKLAGGVAVIKIGAATEVEMKEKKDRVDDALHATRAAVEEGVVAGGGVALVRAVNSLDGLTGANDDQTVGINILRRAIEAPLRQIVSNAGDEPSVVINAVKAGEGNYGYNAATGVYGDMLEMGILDPAKVTRSALEHAASVAGLMLTTEAMITDIPEDKPAMPDMGGMGGMGGMM

SEQ ID NO: 6918 - protein, 126 aa, Yarrowia lipolytica
MSCTDLLLVIVAVFFPPIPVAIRRGVCSADFFINVALCCLGFLPGLIHAFYIISKYPGDEHGCRHGGYAPVNGSEQTFYGSSDLERAGPSSSHQQQPQHQAPPSGEYYTSLDNKKDNTNRPPPYSG

SEQ ID NO: 6919 - protein, 481 aa, Arabidopsis thaliana
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGVFHLRTTILPAEDEMPEIMDSFKKFNDEFMTQYDNNFGYSKM

SEQ ID NO: 6920 - protein, 220 aa, Brassica napus
MAQQQSLIYSFVARGTVILVEFTDFKGNFTSIAAQCLQKLPSSNNKFTYNCDGHTFNYLVEDGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIIALILIIVLSVCHGFKC

SEQ ID NO: 6921 - protein, 549 aa, Wolbachia endosymbiont
MTNVVVSGEQLQEAFREVAAIVDSTVAITAGPRGKTVGINKPYGAPEITKDGYKVMKGIKPEKPLNAAIASIFAQSCSQCNDKVGDGTTTCSILTSNMIMEASKSIAAGNDRVGIKNGIQKAKDVILKEIASMSRTISLEKIDEVAQVAIISANGDKDIGNSIADSVKKVGKEGVITVEESKGSKELEVELTTGMQFDRGYLSPYFITNNEKMIVELDNPYLLITEKKLNIIQPLLPVLEAIVKSGKPLVIIAEDIEGEALSTLVINKLRGGLKVAAVKAPGFGDRRKEMLEDIATLTGAKYVIKDELGIKMEDLTLDDLGTAKNVKITKDNTTVVSENSDSDSVKARIEQIKSQIETSTSDYDKEKLRERLAKLSGGVAVLKVGGATEVEVKERRDRVEDALHATRAAIEEGIVPGGGVALLYASSVLDKLKGASDEEQIGINIIKKVLSAPIRRLVKNAGLESAVIIDYLIKQNDKELIYNVEAMNYANAFTAGVIDPAKVVRIAFETAVSVASVLITTESMIVDVPSKENASSPMGAGEMSGMGGF

SEQ ID NO: 6922 - protein, 841 aa, Thiobacillus denitrificans
MKTALHQLLPAFLRRLLKRIKDRPDSEFQQTLIRIVIGLGFLLYFSRDLATLDESTREIAQLISAFFTAIAVVITALSLTSLKVSPPRRIVAMALDYATCSFLLTYTGEAGSPLLVVYLWVTLGNGFRYGVFYLYIAAAMAITGFLLVLTYSSYWNSHMSIGLAFLLSMIAVPLYSASLLKQLHSAVERERKASLAKSSFLANMSHELRTPLNGVIGVADLLAETKLNKEQKEFAQIIRTSADTLLELIDNVLDISRIEAGRILTSSEDFDLHRVINGTVAMMETQANAKGLVLAAHIAPQTPFQLQGDAPHLRQVLINLIGNAVKFTEHGRVDVYVRPVGQGNPQRLRLEVVDTGIGIPPDAQIRIFDSFTQADASITRRFGGTGLGTTIAKQLVEAMGGEIGLHSREGEGTTFWFELPFALRSSGQPAEERFDAPMRVALLASGDLADRMQAAIRAWDVEAVTLRSAAQLGSQLSASPASEASFGAIVVERSLLPADPVAFLSQLREGPVRSSLPVILIESDARIPPSEDALLLRAGYASVLRSPVNTGLLFNAIHAVTSRELPPNVISLANRFQAQTAQATGLNILVAEDNPVNQRVLRGLLEHAGHKTTLAHDGEEALDLLDSDGASFDLAIIDMHMPELSGPEVVQRWRFLEKGHLPIIMLTADARSEAETACKEAGADAFLTKPVNSRELIDAITRLGVPSPSPVTAPAAKAVRTGELDETVLDDLAELGGAEFVRELLASFEDDSARALRDAEFALVAHEYGQWHHHLHMLKGGASDVGANLLAERCAEAERVKPFELATPLARTRLDAVRTALEEARTALSRYQERRLRAEHS

SEQ ID NO: 6923 - protein, 386 aa, Yarrowia lipolytica
MADFIRTQIFGTCFEITSRYVDLNPVGMGAFGLVCSAKDQLTDQNVAIKKIMKPFGTPVLSKRTYRELKLLKHLRHENLICLSDIFISPLEDIYFVTELLGTDLHRLLMTRPLEKQFIQYFLYQILRGLKYVHSAGVVHRDLKPSNILVNENCDLKICDFGLARIQDTQMTGYVSTRYYRAPEIMLTWQKYDVEVDIWSTGCIFAEMLEGKPLFPGKDHVHQFSIITELLGSPPEDVIHTICSENTLRFVRTLPRRERIPLASKFRNADPEAIDLMEKMLVFDPKKRITAAEALAHPYLAPYHDPSDEPVAEERFDWSFNDADLPVDTWKVMMYSEILDFHNVDIDVNGQPPQGQFEQVHAQAQAAVAQNEAARAREQEQQQQEQQ

SEQ ID NO: 6924 - protein, 521 aa, Aspergillus nidulans
MVTLSRVSQESSSHRQRREIRDISVQTTEYAGVYGTKYAAEELPLYVMNDNGMPPDVAEQMIRDELSLDGNPLLNMASFVTTYMEPQVETLMAAAMRKNFIDFEQYPQSARMQTRCVNMIADLFNAPTNQESKEGTEHGESEGAEGAMGTSTVGSSEAIMLALLAMKKTWHKKRSDAGKDTSHPNIIMNSAVQVCWEKAARYFDVEERYCYCTDDRYVIDPVQAVELVDENTIGICAIMGTTYTGHYEDVKAINDLLVQRNIDCPIHVDAASGGFVAPFICPELVWDFRLEKVVSINVSGHKYGLVYPGVGWIFWRSPEYLPRELVFNINYLGSEQATFTLNFSKGASHIIGQYYQLIRLGRNGYKAIMQNLVQVSQNLARGLSDLGLLILSDNTGNGSGGVPLVAFRLPDDESRLFDEFAVSAVLRRRGWVVPAYTMAPRSNNLKLMRIVVREDFTAHRCGILIQDIKMAIEWLEEMDETTIQRYTTYLAQHGTRLPNAHSFYKDEHSLHGKTGKTHAVC

SEQ ID NO: 6925 - protein, 239 aa, Antirrhinum majus
MEFPNQDSESLRKNGRGKIEIKRIENITNRQVTFCKRRNGLLKKAYELSVLCDAEVALVVFSSRGRLYEYANNSVRATIERYKKASADSSNSVSTSEANTQFYQQEANKLRRQIREIQTSNRQMLGEGVSNMALKDLKSTEAKVEKAISRIRSKKNELLFAEIEHMQKRELELHNANMFLRAKIAEGERAQQQMNLMPGSDYQPMTSQSYDVRNFLPMNLMEPNQQQYSRHDQTALQLV

SEQ ID NO: 6926 - protein, 544 aa, Methanocaldococcus jannaschii
MRDMCSISGIIVKDNQISAKYSIDMMKILKHRGRDNSGLLLDDEVIYFNDFEDVEDLEEEMIGNLSLAHNRLAIVGRYGVQPIPNEDETIWLVCNGEIYNYIELREYLKQNHEFRTDSDNEVIIHLYEEEKLEELDGDYAFAIYDKSKNVVRLARDMFGVKPLFYVDRDKYFAFASERKALWHLLINIDGCERDLDELNSKIKTLKPNSQLIYYLDDNRFEIIEGFKKLELNYMKERSYEEAKEYLDRALKNSVLKRVRGLDKVGIICSGGVDSSLIAKLASLYCEVILYAVGTENSEDLIYAERLAKDLNLKLRKKIISEEEYEEYVFKVAKAIDEVDLMKIGVGIPIYVASEMANEDGLKVVLSGQGADELFGGYARHERIYRERGEEELKKELLKDVYNLYKVNLERDDHCTMANGVELRVPFLDEEVVEIALSIPIEYKMSELSNRPYAESNISLKSEPINGLKNTNLNIKCVRSVRKKILRDVASQYLPDYIAYRPKKAAQYGSGGEKMIYKVAKKYGFSKKRINEFLDMLKRKIVSEF

SEQ ID NO: 6927 - protein, 711 aa, Novosphingobium aromaticivorans
MSVRAYRHLLSPGRINRLELKNRIFFSPMGSNLAEEDGSVGDRLRTYYVARAKGGAALVTMGSVSVGFPEGASNWRQEAISDDRFVPGLKRLADEVHEHGAKLCVQLHHGGLVAMTDMLDGRPVACPNPPPAAKDSGDFVDVMLPEEQAKFFEPYAKMGEVRYNSLDASGVDHIVDLFARAAVRAKTAGIDAVELHAGHGYIFSTFLSPAYNHRTDEFGGSIENRARLLLKTIRAVRAAVGPDYPVWMRFDSQEFLMDYGITLEDAIAVARMAQEAGLDAIHVSAHGDGNYGRTYSTGHATDIRNGFVDNAAAIKAAVSIPVICPGRIEPEEADRFIAQGKLDFVTMGRKLLADPELPNKLAAGKPETVRPCVYCYTCISSIFNSSHIVCAVNPMTGFETDRQPQPASKRKVVLVVGGGPGGMAAARDLSDKGHKVVLCEATDRLGGTAQFASIAYAPNQRIVDWLRREVTARPIEVRLGTRATADLARRIGADEVIVATGARRAMPPIPGSERDFVFSGDDMRNLVLGQNLDSLASKTGLATRLAMKLGRATGLTKRIGLLRAGSKAWMPLGEHVVIIGGELVGLELAEFLAHRGRKVTVLEESARVGKGIPLVRRFRAVDDCHALGVALLTETSGFRIGDGTVTYSNAHGQERTLRADTVIVAQGATGDESLTKEMRSAGFLTHSVGDCTGVGYIEGAMRDAALAIQAI

SEQ ID NO: 6928 - protein, 442 aa, Arabidopsis thaliana
  misc_feature (402)..(402): Xaa can be any naturally occurring amino acid
MKSTPKLLLLLLFIINHHVDSGSIVKFLPGFEGPLPFELETGYIGIGEEEDVQLFYYFIKSERNPKEDPLLLWLSGGPGCSSITGLLFENGPLALKSKVYNGSVPSLVSTTYSWTKTANIIFLDQPIGAGFSYSRIPLIDTPSDTGEVKNIHEFLQKWLSKHPQFSSNPFYASGDSYSGMIVPALVQEISKGNYICCKPPINLQGYILGNPITYFEVDQNYRIPFSHGMALISDELYESIRRDCKGNYFNVDPRNTKCLKLVEEYHKCTDELNEFNILSPDCDTTSPDCFLYPYYLLGYWINDESVRDALHVNKSSIGKWERCTYQNRIPYNKDINNSIPYHMNNSISGYRSLIYSGDHDLVVPFLATQAWIKSLNYSIIHEWRPWMIKDQIAGYIIYFCVXTRTYSNKMTFATVKGSGHTAEYKPNETFIMFQRWISGHDL

SEQ ID NO: 6929 - protein, 165 aa, Nostoc punctiforme
MPLVRWNPFRDSERLEPFRDTESWEPFREIDTLQRQMNRLFDRLMPTTNGGERSGFIFSPAAELEETDDAIRLRLEVPGLEAKDINVEATPESISITGERKTETKSEENGITRSEFRYGKFQRVIPLPSQIQNDKVQAEYKNGILQLTLPKAESEKHKAVKVNLG

SEQ ID NO: 6930 - protein, 334 aa, Haemophilus influenzae
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVAAGYIVYGSSTMLVYTTGHGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIQPTELHQRVPLFVGSEDMVKKAQEMMEEFKEE

SEQ ID NO: 6931 - protein, 151 aa, Pseudomonas putida
MYESLLNLSSDPIAEFEKLQRELQHVLGTGLGRPGSIRALASGAFPAINVASTPSSMEVYAFVPGVDPSDIDLQIHRGLLSISGERRPARSTQEGNCSVYANERYAGPFKRTVSLNDQVDTDKVEAHYRDGVLRISLPRREALQPKRIVIQ

SEQ ID NO: 6932 - protein, 255 aa, Zea mays
MCQTVRRTPPLLSPSLGSWASLPTPEQPSSPCSASPPPRTAPPAPPARAGGTQLPASSLRRGYTMEGAGRDANPLGGYRIGKTLGIGSFGKVKIAEHILTGHKVAIKILNRRKIRSMEMEEKVKREIKILRLFMHPHIIRLYEVIDTPADIYVVMEYVKSGELFDYIVEKGRLHEEEARRFFQQIISGVEYCHRNMVAHRDLKPENLLLDSKCNIKIADFGLSNVMRDGHFLKTSCGSPNYAAPEVISGKLYAGP

SEQ ID NO: 6933 - protein, 130 aa, Zea mays
QSDETRKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFD

SEQ ID NO: 6934 - protein, 1129 aa, Petroselinum crispum
MSSSRPANSSSNPGRANQNARVVLTTLDAKIHADFEESGNSFDYSSSVRVTSAVGENSSIQSNKLTTAYLHHIQKGKLIQPVGCLLAVDEKSFKIMAYSENAPEMLTMVSHAVPSVGEHPVLGIGTDVRTIFTAPSAAALQKAVGFTDINLLNPILVHCKTSGKPFYAIAHRVTGSLIIDFEPVKPYEVPMTAAGALQSYKLASKAVNRLQALPGGSMERLCDTMVQEVFELTGYDRVMAYKFHDDDHGEVTAEVTKPGLEPYFGLHYPATDVPQAARFLFLKNKVRMICDCRANSAPVLQDEKLPFELTLCGSTLRAPHSCHLQYMENMNSIASLVMAVVINDSDEVVESSDRNSVKSKKLWGLVVCHNTSPRFVPFPLRYACEFLAQVFAIHVSKELELENQIVEKNILRTQTLLCDLLMRDAPLGIVSQSPNMMDLVKCDGAALLYKNKVYRLGATPSDYQLRDIVSWLTEYHTDSTGLSTDSLYDAGYPGALALGDVVCGMAVVKITSHDMLFWFRSHAAGHIRWGGAKAEPDENHDGRKMHPRSSFKAFLEVVKTRSTTWKEFEMDAIHSLQLILRKALSVEKAVAAQGDEIRSNTDVIHTKLNDLKIEGIQELEAVTSEMVRLIETATVPIFAVDADEIVNGWNTKIAELTGLPVDQAMGKHLLTLVEDSSVGTVVFLLALALQGKEEQGIPFEFKTYGSREDSVPITVVVNACATRGLHDNVVGVCFVAQDVTSQKTIMDKFTRIQGDYKAIVQNPNPLIPPIFGTDEFGWCSEWNQAMTELSGWRREDVMNKMLLGEIFGIQTSCCHLKSKEAFVNLGVVLNNALTGQISEKICFSFFATDGKYVECLLCASKKLHGEGTVTGIFCFLQLASQELQQALHIQRLTEQTAMKRLKTLSYLRRQAKNPLCGINFVREKLEEIGMGEEQTKLFRTSVHCQRHVNKILDDTDLDSIIDGYLDLEMSEFRLHDVYVASRSQVSMRSNGKAIQVVDNFSEEMMSETLYGDSLRLQKVLADFMSVCVNLTPVGGHLGISVTLTEDNLGQSVQLVHLEFRITHTGAGVPEEAVSQMFGSDSETSEEGISLLISRKLVKLMNGDVHYLREAGKSTFIITVELAAASKRES

SEQ ID NO: 6935 - protein, 131 aa, Zea mays
QSDEASKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 6936 - protein, 327 aa, Burkholderia vietnamiensis
MNSSIQVAPGVTAAGGLSAADGQIPGVSPLLGSGARVKRLTALAVMLVPLAGFALAVRQLVLGEFAATDLVLFAVFYFLHMGGITMGFHRYLAHKTFRTSKWFEGLLLICGSMAAQGPIMFWVTTHRRHHLYSDQQGDPHSPNLAGKGLFAKLRGLWYAHMPWMLAPDVSGWTFFAPDVLRDRRLFFYHRTYAWWIVLGLVLPAAIGGAVAGSWLGAWNGLLFGGLARIFVANQAAWCVGSVCHMFGGRPFKTGDNSANNWTVAVFTFGEGLQNNHHAFPASYRHSVKWYEPDLSAWVLWTLGKLGIVRDLRQPTPAAIRKLAKQPY

SEQ ID NO: 6937 - protein, 237 aa, Oryza sativa
ENKINRQVTFAKRRNGLLKKAYELSVLCDAEVALIIFSNRGKLYEFCSGQSMTRTLERYQKFSYGGPDTAIQNKENELVQSSRNEYLKLKARVENLQRTQRNLLGEDLGTLGIKELEQLEKQLDSSLRHIRSTRTQHMLDQLTDLQRREQMLCEANKCLRRKLEESNQLHGQVWEHGATLLGYERQSPHAVQQVPPHGGNGFFHSLEAAAEPTLQIGFTPEQMNNSCVTAFMPTWLP

SEQ ID NO: 6938 - protein, 319 aa, Burkholderia vietnamiensis
MAEADLSSSRTPAAARAADADTDSRARRLAYLTVGVPALGFVLAIAYTWTYGVRATDFILLAVMYFSTAIGVETGMHRYFSHRAFKGRPIVTVMLGVFGSMAAQGPILFWAATHRMHHAFTDQDGDPHSPLPRANRHGRPSRLAGLWHGHVGWLFSVRRENWSAYAADLLRDRLIVNLNLRYGWWVLLGLALPALAGALLAPAGQALTGAVGGFLWGGLARIFLLDQSTWAVNSLCHTIGTRPHATRDHSRNLGLLAIVSVGGAWHNNHHAQPAFANNDHAFWQLDPSAWVIRLLDALGLVTEVRYAPKRRATVPSISP

SEQ ID NO: 6939 - protein, 515 aa, Shigella flexneri
MCSIFGVFDIKTDAVELRKKALELSRLMRHRGPDWSGIYASDNAILAHERLSIVDVNAGAQPLYNQQKNHVLAVNGEIYNHQALRAEYGDRYQFQTGSDCEVILALYQEKGPEFLDDLQGMFAFALYDSEKDAYLIGRDHLGIIPLYMGYDEHGQLYVASEMKSLVPVCRTIKEFPAGSYLWSQDGEIRSYYHRDWFDFDAVKDNVTDKNELRQALEDSVKSHLMSDVPYGVLLSGGLDSSIISAITKKYAARRVHHEIHFTVQEGLDAIRDVIYHIETYDVTTIRASTPMYLMSRKIKAMGIKMVLSGEGSDEVFGGYLYFHKAPNVKELHEETVRKLLALHMYDCARANKAMSAWGVEARVPFLDKKFLDVAMRINPQDKMCGNGKMEKHILRECFESYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 6940 - protein, 77 aa, Zea mays
QSDETWKMGDIVHTLTNRRWLEKCVTYAESHDQALVGDKTIAFWLMDKDMYDFMALDRPSTPTIDRGIALHKMIRLI

SEQ ID NO: 6941 - protein, 432 aa, Arabidopsis thaliana
MVIKGMRVGKYELGRTLGEGNSAKVKFAIDTLTGESFAIKIIEKSCITRLNVSFQIKREIRTLKVLKHPNIVRLHEVLASKTKIYMVLECVTGGDLFDRIVSKGKLSETQGRKMFQQLIDGVSYCHNKGVFHRDLKLENVLLDAKGHIKITDFGLSALSQHYREDGLLHTTCGSPNYVAPEVLANEGYDGAASDIWSCGVILYVILTGCLPFDDANLAVICRKIFKGDPPIPRWISLGAKTMIKRMLDPNPVTRVTIAGIKAHDWFKHDYTPSNYDDDDDVYLIQEDVFMMKEYEEEKSPDSPTIINAFQLIGMSSFLDLSGFFETEKLSERQIRFTSNSLAKDLLENIETIFTEMGFCLQKKHAKLKAIKEESTQKRQCGLSVTAEVFEISPSLNVVELRKSHGDSSLYKQLYERLLNELGSSSQVQELLA

SEQ ID NO: 6942 - protein, 54 aa, Zea mays
QSDETWKMGDIVHTLTNRRWLEKCVTYAESHDQALVGDKTIAFWLMDKDMYDFM

SEQ ID NO: 6943 - protein, 738 aa, Prunus persica
MEACNCIEPQWPADELLMKYQYISDFFIALAYFSIPLELIYFVKKSAVFPYRWVLVQFGAFIVLCGATHLINLWTFSMHSRTVAIVMTTAKVLTAVVSCATALMLVHIIPDLLSVKTRELFLKNKAAELDREMGLIRTQEETGRHVRMLTHEIRSTFDRHTILKTTLVELGRTLALEECALWMPTRTGLELQLSYTLRQQNPVGYTVPIHLPVINQVFSSNRALKISPNSPVARMRPLAGKHMPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTPEQRLMVETILKSSHLLATLINDVLDLSRLEDGSLQLEIATFNLHSVFREVHNLIKPVASVKKLSVSLNLAADLPVQAVGDEKRLMQIVLNVVGNAVKFSKEGSISITAFVAKSESLRDFRAPEFFPAQSDNHFYLRVQVKDSRSGINPQDIPKLFTKFAQTQSLATRNSGGSGLGLAICKRFVNLMEGHIWIESEGPGKGCTAIFIVKLGFAERSNESKLPFVTKVQANHVQTNFPGLKVLVMDDNGSVTKGLLVHLGCDVTTVSSIDEFLHVISQEHKVVFMDVCMPGIDGYELAVRIHEKFTKRHERPVLVALTGNIDKMTKENCMRVGMDGVILKPVSVDKMRSVLSELLEHRVLFEAM

SEQ ID NO: 6944 - protein, 128 aa, Zea mays
QSDETWKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRR

SEQ ID NO: 6945 - protein, 210 aa, Neisseria gonorrhoeae
MTLRYEILPVTPFRQNCTLIWDDESGEAVLTDVGGDVPFLLQALANRKLTLTAIWLTHGHLDHAGGVVEMLETHKVPVLGPHREDEFLLQSLPQTTAQYGFPVSPAFAPNRWLEEGETLTVGRYAFQVLHIPGHTPGHVVFYCAEAELLIAGDVLFYETIGRTDFPRGNHADLINNIRNKLFAFPETVQVVAGHERMTSIGHEKRHNPFF

SEQ ID NO: 6946 - protein, 148 aa, Brassica napus
KNLIDQTHQARHKSLRLLSLLAASDSAPVLSSPRLFSSSSDMSGSGSDSSSSSLPVTLDSLNPKVLKCEYAVRGEIVNIAQKLQEDLKINKDAYPFDEIIYCNIGNPQSLGQQPITFFREVLALCSHTALLDESATHGLFSSDSIERA

SEQ ID NO: 6947 - protein, 537 aa, Cryptococcus neoformans
MTVYVIYNSNCFRWRFLVLLPHLAAVVIVAGFVDPTFPFTTCPSLPQKTSTTPYPPVTMDPTKAQTTATFAHLKAQKANKQCFDCHAKNPTWSSVTFGIYLCLDCSSVHRNLGVHISFVRSTNLDSWSIQQLRTLKVGGNASCAEFFNKNGGGNLLAPQSTDARARYTSRIASLYKEELAKRTQDDAARYPHGIHIDGLELTPLASPAKAAATDDDFFSSWDKPTSKPATPAASAQAATVPSIGLTRAPAPRTVTSSSLRSSTTSAPSSRPASASRLSSSTTTTTGAAPKVSKLGASKLGAKKAAAPIDFEEAQRKALEEEERAKQLSAENKKKEEEAAKAAREREAEEAKKAKAAAAAAASANASVGSSRSGTPANGAAKKSVVNSAPVPGRLGFGQTVGVAAPAQSKTRAAVADDVRTARDKFGNQKGISSDMYFGRGTYDPSAAAEAQTRLRDFQGATAISSNAYFGREEENEEEGGLGGDGGMGGDDAIAGLERGIRDMAERVLANPEVQQFGDQIRAGALKLSDYLASFEGR

SEQ ID NO: 6948 - protein, 701 aa, Xanthomonas oryzae
MAKSSGKPASAVSVDRSASAPDARGTGDELHQKARGRHPQLTTNQGIPVGDNQNSLRATPRGPTLLEDFILREKITHFDHERIPERIVHARGSAAHGYFKLTKSLSQYTTAKIFTEIGEKTPLFTRFSTVAGGAGSVDTPRDVRGFAVKFYTKEGNWDLVGNNIPVFFIQDAIKFPDLIHAVKMEPDRGFPQAASAHDTFWDFISLTPESMHMIMWAMSDRTIPRSLRMIEGFGIHSFRFLNDKGESTFVKFHWRPKLGLQSTIWDEAVKIAGADQDFHRRDLFEAIQNGDFPEWELGVQLFTEAEADAFPFDHLDSTKIIPEELVPLQIVGRMVLDRWPDNFFAETEQVAYCPGNIVPGIDFSNDPLLQGRLFSYLDTQLSRLGGPNFHQIPINAPKCPFVNNQRDGHMQMDVPKGRVAYEPSSLQADAPREALRGFPSHSTPAEDGAKGRVRAERFADHYSQARLFFRSQTAPEQAHMASALVFELSKVETAHVREAIVGHLRHIDQKLAQRVADGMGMTTLPPAPPAAVAPIDMPLSPALQVIGKMKDTLKGRTVGILIHDGSDASTIKAVRKAAEAEGATVKIVAPKLGGAKLSDGKQLAADGQLAGTPSVVFDAVAVLLSSEAAKLLTRESAALDFVSCAWAHLKAIAFDEGAQLLLKAGNIGKDAGVVPAADTKAFISAAKTRQWAREPKVRMLA

SEQ ID NO: 6949 - protein, 154 aa, Bacillus cereus
MSEEKKDSSRPPVRNYLKQIDDFFEQTPLRNVIADLNHFFQKGNRLLTFPVDLYEVGEELVVTAELPGIQKEQIQIEIQSEYLKVSVKEEILEEAEEETSHNYYRRERSISEASRLIKLPYSINKKAAKASYQNGVLEIRAPKLPQQHDILSID

SEQ ID NO: 6950 - protein, 538 aa, Armoracia rusticana
MKLLGIALVLLLAVVTCKAEITCEEDKPFTCNQTERLNRNHFDPDFIFGFASSAYQIEGSRGRGINTWDAFTHRYPEKGGADLGNGDTTCGSYEHWQKDIDVMAELGVNGYRFSFAWSRIVPRGKVSRGINQDGVNYYNNLIDGLLEKNITPFATLYHWDLPQCLQDEYEGFLDREIIEDFKNYADLCFQLFGDRVKNWITINQLFTVPTRGYATGTDAPGRCSSWLNKGCYAGDSGTEPYIVAHNQLLAHATAVDLYRKKYKKEQGGQIGPVMITRWFLPYDDTQASKDAVERNKAFFLGWFMEPLTKGKYPDIMRKLVGDRLPKFTESESKLVKGSFDFLGLNYYYTQYVYAIPKNPPNRLTVMNDSLSALSFVNKDGPIGPWFNADIYYRPRGILDTMEYFKTKYDNPLVYITENGYSSAGGDTPFEEVIADYNRTDFLCSHLCFLRKAIKESGCNVKGYFVWSLGDNYEFCQGFTVRFGVSYIDFKNITADRDLKESGKWYKRFLSVKDNKVPHESQDLLRSRFFLGQKKVADA

SEQ ID NO: 6951 - protein, 361 aa, Oryza sativa
  misc_feature (308)..(308): Xaa can be any naturally occurring amino acid
MAAAAIAAASLLPSSAFALRRLSSAANVSRFAQLKRFDRARRFAPAAAMSTSSGPKEAPANNPGLQAPSEKDPATKGYFMQQTSGRRVSWVKRDGWGSSGSLWAAVGQGGEDVAVLPRLWETRAAGQCQVWVGSSEWLGSGGWGGRFDMNNGITDGGGEAERGERGVVEEEGLWWREGTADRRFRCQAPSAETEAGCLMFRVKDPKVSLDFYSRVMGMSLLKRLDFPEMKFSLYFLGYEDVESAPTDPVKRTVWTFGQRATLELTHNWGTENDPEFKGYHNGNSDPRGFGHIGVTVHDVYKACERFEXLGVEYVKKPDDGKMKGIAFIKDPDGYWIEIFDLNRIGAVTSGSIMMCLKCYEL

SEQ ID NO: 6952 - protein, 520 aa, Neurospora crassa
MVHLTIIPKEDEIRDGLDIPLTGALKAVHLQLANDEDRFTTSVYGSKFAAADLPRHEMPDEEMPKEVAYRMIKDELSLDGNPLLNLASFVTTYMEEEAEKLMTESLPKNFIDYEEYPQTADIQNRCVSMIGRLFNAPVKDAEASSAVGTSSVGSSEAIMLGVLAMKKRWKNKRIAEGKPADKPNLIMSSAVQVCWEKATRYFEVEEKFVYCTPDRYVIDPKETVDLVDENTIGICCILGTTYTGEYEDVKAVNDLLVERGLDTPIHVDAASGGFVAPFVVPDLEWDFRLKNVVSINVSGHKYGLVYPGVGWVVWRSAEYLPQELVFNINYLGADQASFTLNFSKGASQVIGQYYQLIRLGKHGYRAIMSNLTRTADYLAESLAALGFIIMSQKSGQGLPLVAFRLKEDPDRTYDEFALAHQLRVRGWIVPAYTMAPKTEGLKMLRIVVREDFSRNRCDGLISDIRSCQGILEQMDKETVKKQQEFIHKHHVVSGKASHNHPKYHEKHSLQGKTGKTHSIC

SEQ ID NO: 6953 - protein, 716 aa, Arabidopsis thaliana
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENGIGGGSTTSSYLQNHHEILNWRRLSQTGYVKSAFGGAKGEEHHKGCNSGEIWLDCKPSTFGTV

SEQ ID NO: 6954 - protein, 398 aa, Pyrococcus furiosus
MIRASKRALSVEYAIRDVVLPARELEKKGIKVIRLNIGDPVKFDFQPPEHMKEAYCKAIKEGHNYYGDSEGLPELRKAIVEREKRKNGVDITPDDVRVTAAVTEALQLIFGALLDPGDEILVPGPSYPPYTGLVKFYGGKPVEYRTIEEEDWQPDIDDIRKKITDRTKAIAVINPNNPTGALYDKKTLEEILNIAGEYEIPVISDEIYDLMTYEGEHISPGSLTKDVPVIVMNGLSKVYFATGWRLGYMYFVDPENKLSEVREAIDRLARIRLCPNTPAQFAAIAGLTGPMDYLKEYMKKLKERRDYIYKRLNEIPGISTTKPQGAFYIFPKIEVGPWKNDKEFVLDVLHNAHVLFVHGSGFGEYGAGHFRAVFLPPIEILEEAMDRFEKFMKERLKE

SEQ ID NO: 6955 - protein, 611 aa, Geobacter sulfurreducens
MCGIVGKYYFNKNAGDSSDIDAMMQAIYHRGPDSSGKYINGRAALGFQRLSIIDTVSGHQPLYNETKTIVLLANGEIYNYKEFVPFLESKGHVFSTRSDCEVIIHLYEEYGIEFISKLNGMFAFCLYDTRNDVMFIARDRVGIKPLYYHLNKEAIIFGSEIKGILASGEVVTEEANDCLAEYLCFRYVANFRTFFSSVNALEPGTYIKISPNGCTFEKFWDLSKYVLNYAQDGDLVETVDAALTASVQRQMMTDVPLGTQLSGGVDSSLVSKLAAGYSPGLKTFTVSFFESAYDESAYARLLADSAGLEYHQIRVDGKTFADTLPKVIWYHDEPLCHANSVHMYLLCTYARQFVTVLLTGEGADELFAGYPRYQICRFGDAYNKLNPSVASLVKSVLKGVPARKIVKIVDNLGLGARELALWNSSFTTKEKVSWLLDSGDVTLDARSALVDSVWNDELSLFDNLLLYEQKSYLQPILMRQDKMSMAASVESRVPVLDNEMLDVANTIPYQYKVRHFTPKHVFKKVAERHISRKIVYKKKVGFGVPVDEWLRDHSGLGRYLDLLLDTARGINGVSRPRIEQLIAEHASRRYNHGDVLWPLVNYAIWREQFFK

SEQ ID NO: 6956 - protein, 204 aa, Schizosaccharomyces pombe
GPCKTVRHLNWLHCMLIFGLPMIAIYGVFTTPLQTKTLIFAIIYYAYSGLGITAGYHRLWSHRAYKAKKPLEYFLAAGGAAAFEGSIRWWSRDHRAHHRYTDTDKDPYNVKKGFWYAHVGWMIILQNPRRIGRSDVSDLNSDPFVMFNHRHFLPIASFMAFIFPSLFCGLLWGDYRGGYFYAGVCRLVFVHHATFCVNSLAHLI

SEQ ID NO: 6957 - protein, 157 aa, Magnetospirillum magnetotacticum
  misc_feature (156)..(156): Xaa can be any naturally occurring amino acid
MADQSPRLTTAFGNPVSDNQNSLTAGPRGPVLMQDYHLIEKMAHFNRERIPERVVHAKGYGAYGTFRLTKSLGEYTRAKVLTEVGKEVPMVARFSTVGGESGSADTARDPRGFALKFYTEEGNWDLVGNNTPIFFVRDAIKFSDFIRTQKRDPRTXI

SEQ ID NO: 6958 - protein, 430 aa, Arabidopsis thaliana
  misc_feature (147)..(147): Xaa can be any naturally occurring amino acid
MNPSKATGGIVEDLTKQLPKSMFLSMDADKTLLHIIQKKITSAKNVNCILGYCRCPRSLKSLHETDGIKFRVFHDAGNKLISTLRRVKTCAGARVLNMQMEEVDRAFTMSGQLHLTTWTRRRTKTTPQRSMCDPIREDGSNKRGAVXSKEKRPYIHREWSWADIIRALTVINVHFLCLLAPFNYKWEALRFGFVLYALTSLSITFSYHRNLAHRSFKLPKWLEYPLAYFAVFALQGDPLDWVSIHRFHHQFTDSDRDPHSPIEGFWFSHVWWICDTRYIKYKCGGRNNVMDLKQQWFYWFLRMTIGFHVLMFWTVLYLYGGLPYLTCGGGVGGVIGYHVTWLVNSACHIWGSRSWKTKDTSRNVWWLSLFTMGESWHNNHHAFESSARQGLEWWQIDITWYLIRLFEVLGLATDVKLPSEIQKQKLALTR

SEQ ID NO: 6959 - protein, 849 aa, Magnaporthe grisea
MSSQSAYQLPISFRKSNQLSFAPAVRQYISNKYDQHPDMFRQDIEVIDALRRDAINVREPHTSGIRKLQAYAAQLVWISGKFPIDIGADFTWYPALGYNTDRPLVQNNLQYELLNVLYNLAALYCQLALSTNSNGDSNAIKTAANYFSHAAGVLSHMKTAVLPELRMPSPPEDMDEATLESLEQLMLAQCQECYWQKAVAEGYKDATIAKLAARASDLYNSAAEAAMKSEAISSAWIHHISAKHHHFAAAAQYRASLDCLEKRKYGEEIARLQDAVACANEGLREARGGYLKEGVAEDLRRLKMRAEEDLKRAEHDNDMLYLLPVPTKPELKILDRANLAVARIPAQVSAPVDHIGDEAEFGPALFSKLVPYAVHMAVSIYEERRDRLVNNNIIHELEVLTERMHEILSSLNLPGSLQALEKPLGLPGPLIQHAEEIRQADGINRIQRSFADIDKLRSSDIAVFEEGKSLLVTEEEEDQRLRRRHGTQRWARPESRQDPAGGQKLWAQVGEIEGYFASSTSSDGIVREKYLAIEDTLMVLSGSDRSLMDFVPSSRRTEIPESVKPALGRLRGAYNDVLRMESRRRKRVEALRERARSDDIKPDILRETGRLERAYPGTTLAAAHFDDFFERRLDSLYEDDLALLERETAEQEKCLNEVSRVNREFESQRRAAGADKAGGKEREAALQKLDSAFYKYKEIVSNVEVGRKFYNDLSKIVGTFRDTCRTWVAERRKDARSLEDEISMPPLGSLSLQQTPSQQSSQYYSQQQQQQPRSPPQEAHHSAYADTGSMPPQQPRPLPAANAQQTWSQNMPIQFGGPPGTAQQTQPAQAGAKKPVGGTWDPSAGIRFG

SEQ ID NO: 6960 - protein, 131 aa, Zea mays
  misc_feature (6)..(6): Xaa can be any naturally occurring amino acid
QSDETXKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRGFDL

SEQ ID NO: 6961 - protein, 494 aa, Neisseria meningitidis
MSKPVFKKIALYTLGAISGVAVSLAVQGFAAEKDRRDNEVLPVQSIRTMAEVYGQIKANYYQDKPDADLFEGAMKGMVAGLDPHSEYMDKKGYAEIKESTSGEFGGLGMEIGQEDGFVKVVSPIEDTPAERAGVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDRMVLKAIPEDYVYGMGGDSLAGIPAELKTIPMTVLVNSGSASASEIVAGALQDHKRAVIVGTQSFGKGSVQTLIPLSNGSAVKLTTALYYTPNDRSIQAQGIVPDVEVKDKERIFESREADLVGHIGNPLGGEDVNGETLAVPLEKDADKPAVKEKGKKKKDEDLSSRRIPNPAKDDQLRKALDLVKSPEQWQKSLGLAAKKPVSNKDKKDKKDKK

SEQ ID NO: 6962 - protein, 105 aa, Zea mays
QSDETWKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRG

SEQ ID NO: 6963 - protein, 158 aa, Zea mays
MSLIRRSNVFDPFSLDLWDPFEGFPFGSGNSSSLFPSFPRTSSETAAFAGARIDWKETPEAHVFKADVPGLKKEEVKVEVEDGNVLQISGERNKEQEEKTDTWHRVERSSGRFLRRFRLPENAKTEQITAAMENGVLTVTVPKEDAKKPEVKSIQISG

SEQ ID NO: 6964 - protein, 70 aa, Zea mays
QSDETWKMGDIVHTLTNRRWLEKCVTYAESHDQALVGDKTIAFWLMDKDMYDFMALDRPSTPTIDRGITL

SEQ ID NO: 6965 - protein, 53 aa, Zea mays
  misc_feature (5)..(6): Xaa can be any naturally occurring amino acid
  misc_feature (21)..(22): Xaa can be any naturally occurring amino acid
  misc_feature (36)..(36): Xaa can be any naturally occurring amino acid
  misc_feature (39)..(39): Xaa can be any naturally occurring amino acid
  misc_feature (45)..(45): Xaa can be any naturally occurring amino acid
QSDEXXKMGDIVHTLTNRRWXXKCVTYAESHDQALXGDXTIAFWXMDKDYVYV

SEQ ID NO: 6966 - protein, 700 aa, Xanthomonas oryzae
MRAMCLALTSASLRAWRTLSSIGLRHALARARAARDACGARPVTPRCQQAGALTMCGLAGLLLASPRLHGEQLDALVRPMGAALRHRGPDDAGTWCDAQAGVALAHQRLSILDLSPLGHQPMRSADGRYVLAYNGEVYNFAQLRAALSALGHRFRGHSDTEVLLAAVVEWGLDETLTRCNGMFAIALWDERDNCLFLARDRVGKKPLYYGWAGDTLVFGSELKALWQHPDFDNGVDRNALTLLLRLGYIPAPACIHAHTFKLMPGRVLRMDAQAVAAGAAAHRADQAQQPFWNAREAMQRALAAPFTGSDAQAEEQLDSVLRDAVALRMVADVPVGVFLSGGTDSSIVTAMMQAQSAQPVHTFSIGFEGSHHDEAPLAREVATHLHTDHTELYVSGADALAVVPCLPDMFDEPFADASQVPTALVARLARGGVTVALSGDGGDELFFGYGRYQRALRNWRMHGLVPGPLRRLMAVAARRNGESSRTGGLAALVAEAGARGIGDIYRNRISRWRDPAAVVPGATEPDSFYSLADPLHGSGTPADAMMLADFAAYLPDDLLCKVDRTTMAVGLEARAPLLDWRVAEFAWSLPLSLKYRDGMSKYLLKRVLCRYLPDTMVYRGKRGFGAPVSAWLRGDLHGWADDLLAHGALQREGVFAADTVAGLWRDFNGGERKWHTHLWTVLMFQAWQAHWREQRAAITR

SEQ ID NO: 6967 - protein, 484 aa, Xanthomonas oryzae
MLRSLIVRCRVRMSYAIVWFRRDLRLQDNPALRAALDAGHHPIPLYIDAPHEEGEWTPGAASRTWRHRSLAALEDALRALGSGLVIRAGDSAQVLDAVIAQTGAVAVYWNRKYEPATQPRDAQIKRALRERGIEAQSCNCALLFEPWQLSTQQGGPYKVFTPFWRNALTQLQLPATAPAPRSLPPLPAMLKTDALDTLQLVPSLNWDQGFWEHWHAGEAGAHEMLEFFIDGGLSGYRKNRDRPDRVGTSQLSPHLHFGEIAPWRIASALEAQRTARNGAEIDGYIRQLGWRDFAYHLLHHFPDTTNQNLNPRFEGFDWAKVDPVALQAWQRGRTGIPIVDAGMRQLWHTGWMHNRVRMIVASFLCKHLRIHWIEGARWFWDTLVDADLANNTLGWQWVAGTGADAAPYFRVFNPVTQAEKFDPHATYITRWVPELGKLPVKERFAPWLHPLSLARFAPEYPRTPIIGLAEGRDAALAAYSKSRA

SEQ ID NO: 6968 - protein, 445 aa, Arabidopsis thaliana
MVVRKVGKYELGRTIGEGTFAKVKFAQNTETGESVAMKIVDRSTIIKRKMVDQIKREISIMKLVRHPCVVRLYEVLASRTKIYIILEYITGGELFDKIVRNGRLSESEARKYFHQLIDGVDYCHSKGVYHRDLKPENLLLDSQGNLKISDFGLSALPEQGVTILKTTCGTPNYVAPEVLSHKGYNGAVADIWSCGVILYVLMAGYLPFDEMDLPTLYSKIDKAEFSCPSYFALGAKSLINRILDPNPETRITIAEIRKDEWFLKDYTPVQLIDYEHVNLDDVYAAFDDPEEQTYAQDGTRDTGPLTLNAFDLIILSQGLNLATLFDRGKDSMKHQTRFISHKPANVVLSSMEVVSQSMGFKTHIRNYKMRVEGLSANKTSHFSVILEVFKVAPSILMVDIQNAAGDAEEYLKFYKTFCSKLDDIIWKPPDASMRNRVTKAKSKRR

SEQ ID NO: 6969 - protein, 648 aa, Pseudomonas aeruginosa
MNFPHLFSPLEIRGKRLKNRIMSSGHDTSMPTDNLVNEPLVAYHRARARGGAGLIVMQVAGVHDSARYTSHVLMATDDACIPGYRRVAEACHAEGCVVLSQIFHPGREIMESADGLLAVAYSASASPNERFRVMPRELDQPLIDEIVAGYAAAARRLHQAGLDGVEVVASHGYLPAQFLNPRVNRRTDGYNGDLDARLRFLREVLAAVRAATSEDFIVGLRLSADERDPEGLSESESLQAAEAVQGELDYLHIVAGTSASLGGAIHIVPPMAIEPAYLAREASTFKARLAIPLFVTGRINQPQEAEAILARGQADVCGMTRALICDPQMPNKAEAGRSDDVRACIACNQACIGHFHRGYPISCIQHPETGRELTYATPNPASRRKRVLVAGGGPAGMKAAAVAAQRGHEVVLCEAGAQLGGQVNLAQLLPRRAEFGGASTNLQREMQLAGVEVRRNTPVDRALVERERPDLVIVATGAEPYWPPFERGGELQVVDAWQVLRGEVRVGRSVLVTDWRGDWIGPGIAEKLVREGHQVRLAVNGTHCGESLPLYVRDQLAGELHRLGIPVTPYARLYGCDDTTVYMQHSASGEAMLFEEVDTLVLCQGHQPVDRLADSLHGLAEVLRIGDCLAPRTAEEAIYEGLKAAWSI

SEQ ID NO: 6970 - protein, 547 aa, Pseudomonas aeruginosa
MAAKEVKFGDSARKKMLVGVNVLADAVKATLGPKGRNVVLDKSFGAPTITKDGVSVAKEIELKDKFENMGAQLVKDVASKANDAAGDGTTTATVLAQAIVNEGLKAVAAGMNPMDLKRGIDKATVAIVAQLKELAKPCADTKAIAQVGTISANSDESIGQIIAEAMEKVGKEGVITVEEGSGLENELSVVEGMQFDRGYLSPYFVNKPDTMAAELDSPLLLLVDKKISNIREMLPVLEAVAKAGRPLLIVAEDVEGEALATLVVNNMRGIVKVAAVKAPGFGDRRKAMLQDIAILTGGTVISEEVGLSLEGATLEHLGNAKRVVINKENTTIIDGAGVQADIEARVLQIRKQIEETTSDYDREKLQERLAKLAGGVAVIKVGAATEVEMKEKKARVEDALHATRAAVEEGVVPGGGVALVRALQAIEGLKGDNEEQNVGIALLRRAVESPLRQIVANAGDEPSVVVDKVKQGSGNYGFNAATGVYGDMIEMGILDPAKVTRSALQAAASIGGLMITTEAMVAEIVEDKPAMGGMPDMGGMGGMGGMM

SEQ ID NO: 6971 - protein, 374 aa, Vibrio parahaemolyticus
MNQNKPPFIWLNILIFSASFVLTFIVMPWYAYHYGLGWEHLIWGILAFSFTNLSITAGYHRLWSHKTYEAHPVLRAIFAIGGAFSLQNSALHWSSDHRVHHKHVDNNDKDPYSAKRGFWYSHIGWMLRDYNKSKENEYTNCRDLKRDSIVMWQHNYYVPLALLTNIGFPVALGLIYGDVWGMLLVVGAARLFLSHHTTFFINSLAHVWGKQTFTDKNTARDNGVLAFFTFGEGYHNFHHIFENDYRNGVYWWHYDPTKWLIKSCSWLGLTSKLRTTSTFRIEKARATQLLKKAKEKLESKPNAQTVLDQLQQEFDALVHHMQEYYEARKELLGEKTANVVKKYECSVSKLKYQQLKTEFERQQRSWNLMIRRYA

SEQ ID NO: 6972 - protein, 475 aa, Erwinia carotovora
MHYQQQKHFPAGFLWGASTSAYQVEGGWQADGKSPSIIDKCQHPENTADFTVASDHYHRFKDDVQLFAELGLKAYRFSIAWTRILPNGTGDVNPLGIAFYNELIDELNAHGIEPVVTLYHFDLPYCLEAQGGWQNRATIDAFVHYARTLFTHFGDKVKYWLTINEQNTMILHPGAIGLPEGGVLPSKKALYQQNHHMMLAQAQVMALCHELAPNGLIGPAINTTSMYQATSKPEDAIAAHNWETLRCWSFLDVAVHGRYNALAWRYLEDRGLAPETLPGDDEILQSGKPDYVAINYYSTATIAASKGDASDVSARAGDQQIMLGEPGVYRAAENPHVDKTPYGWVIDPIGLRLTLRKTYERYHLPILITENGMGAPDKLEADGTINDQYRIDFIARHIEQIQLAISDGVDLIGYCPWSAIDVVSTHQGYGKRYGFIYVNRDEFDLKDLRRIKKKSFYWYQGVIESNGTRLFPREP

SEQ ID NO: 6973 - protein, 415 aa, Triticum aestivum
  misc_feature (393)..(393): Xaa can be any naturally occurring amino acid
MAFDAFTDKTAVFRRLKAKPENKMCFDCNAKNPTWASVTYGIFLCLDCSAFHRSLGVHITFVRSTNLDSWTPDQLKMMAFGGNNRAHAFFKQHGWTEGSGKVDSKYTSRAAELYRQILQKEVAKSSTVNVLPSSPVAASQAPNPSDDFPDFKLADAPEETTNGKHEPAVANPPKEPAQAPKAPTHPTYVSSVKKPLGAKKLGAKTGGLGVKKLTTKSNESLYDQKPEEPKPALPTMTTTTSAAKSGPSSHSRFQYVENETSTESKTGGGNKTGHVSAPKTSDFFHEYGMDNGFQRKTSTAASKTQIEETDEARKKFSNAKAISSSQYFGNTDREQKEAQLSLQKFSGSSSISSADLFGRDTNDSDLDASAADLINRISFQASQDLSSLKNMAXEKPGKKLTSFASNFITDLDRIL

SEQ ID NO: 6974 - protein, 668 aa, Unknown
  Vibrio sp. Ex25
MNCRSKVTLIAASLWLAASAQALEAKLHKDDLPVLAPEVQHETASKRVTSRFTRSHYKHFSLNDDFSKAIFERYVELLDYNRNIFTQADIDSFKDWSIELDDQLKAGNNQIAFDVYNLSMQKRFERFAYALTLLDEEIKFDTDDEIELDRSEAAWPKDEAELNELWRKRVKYDALNLKLTGKEWPEIKEVLEKRYNNAMKRITQTNNEDAFQLYMNAFARQVDPHTSYLSPRNAEQFQSEMNLSLEGIGAVLQMTDDYTVIRSLVVGGPASKSKQLGEGDRIIGVGQDGEEIVDVIGWRLDDVVQLIKGPKGTKVNLQILPEGNDAKSYIVTIVRDKVRLEDRAVKSEIIEKDGKKIGILEVPSFYVGLSKDTDKLLAELKTKNVDGVIVDLRNNGGGALTEATALTGLFIKEGPVVQVRDSYGRIKVNADTDGKVSYDGPLTVLINRYSASASEIFAAAMQDYNRAIILGENSFGKGTVQQHRSLNHIYDLFDKELGYVQYTIQKFYRIDGGSTQNRGVAPDISYPTPIEASETGESVEDNALPWDQIDKAKYQTFPSNEALVEKLTALHNKRISDEMEFRFINEDIEKYRKEKDDNMLSLNEKVRKAESDKAEALRLQRINERQAALGKEAFKTLDDIPKDYEAPDVYLDESVAIMVDLLKQKNQS

SEQ ID NO: 6975 - protein, 1122 aa, Armoracia rusticana
MSGSRPSQSSEGSRRSRHSARIIAQTTVDAKLHADFEESGSSFDYSTSVRVTGPVVENQPPRSDKVTTTYLHHIQKGKLIQPFGCLLALDEKTFKVIAYSENAPELLTMASHAVPSVGEHPVLGIGTDIRSLFTAPSASALQKALGFGDVSLLNPILVHCKTSAKPFYAIVHRVTGSIIVDFEPVKPYEVPMTAAGALQSYKLAAKAITRLQSLPSGSMERLCDTMVQEVFELTGYDRVMAYKFHEDDHGEVVSEVTKPGMEPYLGLHYPATDIPQAARFLFMKNKVRMIVDCNAKHARVLQDEKLSFDLTLCGSTLRAPHSCHLQYMANMDSIASLVMAVVVNEEDGEGDAPDSTTQPQKRKRLWGLVVCHNTTPRFVPFPLRYACEFLAQVFAIHVNKEVELENQIVEKNILRTQTLLCDMLMRDAPLGIVSQSPNIMDLVKCDGAALLYKDKIWKLGTTPSEFHLQEIASWLYEYHTDSTGLSTDSLYDAGFPKALSLGDAVCGMAAVRISSKDMIFWFRSHTAGEVRWGGAKHDPDDRDDARRMHPRSSFKAFLEVVKTRSLPWKDYEMDAIHSLQLILRNAFKDGESTDVNTKFIHSKLNDLKIDGIQELEAVTSEMVRLIETATVPILAVDSDGLVNGWNTKIAELTGLPVDEAIGKHLLTLVEDSSVEIVKRMLENALEGTEEQNVQFEIKTHLSRADAGPISLVVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQTACCRLKNQEAFVNLGIVLNSAVTSQESEKVSFAFFTRGGKYIECLLCVSKKLDREGVVTGVFCFLQLASHELQQALHVQRLAERTALKRLKTLAYIKRQIRNPLSGIMFTRKMMEGTELGPEQRQILQTSSLCQKQLSKVLDDSDLERIIEGCLDLEMKEFSLNEVLTASTSQVMMKSNGKSVRITNETGEEVMSDTLYGDSIRLQQVLADFMLMSVNFTPSGGQLTVTASLRKDQLGRSVHLAYLEIRLTHTGAGIPELLLNQMFGTEKDVSEEGLSLMVSRKLVKLMNGDVQYLRQAGKSSFIISAELAAANK

SEQ ID NO: 6976 - protein, 1122 aa, Armoracia rusticana
MSGSRPSQSSEGSRRSRHSARIIAQTTVDAKLHADFEESGSSFDYSTSVRVTGPVVENQPPRSDKVTTTYLHHIQKGKLIQPFGCLLALDEKTFKVIAYSENSPELLTMASHAVPSVGEHPVLGIGTDIRSLFTAPSASALQKALGFGDVSLLNPILVHCKTSAKPFYAIVHRVTGSIIVDFEPVKPYEVPMTAAGALQSYKLAAKAITRLQSLPSGSMERLCDTMVQEVFELTGYDRVMAYKFHEDDHGEVVSEVTKPGLEPYLGLHYPATDIPQAARFLFMKNKVRMIVDCNAKHARVLQDEKLSFDLTLCGSTLRAPHSCHLQYMANMDSIASHVMAVVVNEEDGEGDATDSTTQPQKRKRLWGLVVCHNTTPRFVPFPLRYACEFLAQVFAIHVNKEVELENQIVEKNILRTQTLLCDMLMRDAPLGIVSQSPNIMDLVKCDGAALLYKDKIWKLGTTPSELHLQEIASWLYEYHTDSTGLSTDSLHDAGFPKALSLGDAVCGMAAVRISLKDMIFWFRSHTAGEVRWGGAKHNPDDRDDARRMHPRSSFKAFLEVVKTRSLPWKDYEMDAIHSLQLILRNAFKDGESTDVNTNIIHSKLNDLKIDGIQELEAVTSEMVRLIETATVPILAVDSDGLVNGWNTKIAELTGLPVDEAIGKHLLTLVEDSSVEIVKRMLENALEGTEEQNVQFEIKTHQSRADAGTISLAVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQKSCCRLKNQEAFVNLGIVLNGAVTSQESEKVSFAFFTRGGKYIECLLCVSKKLDREGVVTGVFCFLQLASHELQQALHVQRLAERTALKRLKAIAYIKRQIRNPLSGVMFTRKMMEGTELGPEQRQILHTSALCQEQLSKVLDDSDLESIIEGCLDLEMKEFSLNEVLTASTSQVMMKSNGKSVRITNETGEEVMSDTLYGDSIRLQQVLADFMLMSVNFTPSGGQLTVTASLRKDQLGRSVHLAYLEIRLTHTGAGIPEFLLNQMFGTEEDVSEEGLSLMVSRKLVKLMNGDVQYLRQAGKSSFIISAELAAANK

SEQ ID NO: 6977 - protein, 431 aa, Glycine max
MEASPPPSPSPSPRTTILAKYQLTRFLGRGNFAKVYQARSLLDGATVAVKAIDKSKTVDAAMEPRIVREIDAMRRLHHHPNILKIHEVLATKTKIYLIVDFAGGGELFSKLTRRGRLPEPLARRYFAQLVSALRFCHRHGVAHRDLKPQNLLLDAAGNLKVSDFGLSALPEHLHDGLLHTACGTPAFTAPEILRRVGYDGSKADAWSCGVILYNLLAGHLPFDDSNIPAMCRRISRRDYQFPAWISKSARSLIYQLLDPNPITRISLEKVCDNNKWFKNNSMVEVKESVWESDLYNKCCDGGYKSGMNAFDIISMSSGLDLRGLFETTSEKGRRREKRFTSDKKVETVEAKVKEVGEKLGFRIEIGKNGAIGLGKGKVGVVVEVFEIVADLLLVAVKVVDGGLEFEELHWDDWRIGLQDLVLSWHDVGLEL

SEQ ID NO: 6978 - protein, 473 aa, Pyrus communis
MCMLSRNATFNSHGQDSSYFLGWQEYEKTPYHEVHNTNGIIQMGLAENQLCFDLLESWLAKNPEAAAFKKNGESIFAELALFQDYHGLPAFKKAMVDFMAEIRGNKVTFDPNHLVLTAGATSANETFIFCLADPGEVLLIPTPYYPGFDRDSKWRTGVAIVPIHCTSSNGFQITETALEEAYQEAEKRNLRVKGVLVTNPSNPLGTTMTRNELYLLLSFVEDKGIHLISDEIYSGTAFSTPSFRSVMEVLKDRNCDENSEVWQRVHVVYSLSKDLGLPGFRVGAIYSNDDMVVAAATKMSSFGLVSSQTQHLLSAMLSDRKLTKNYIAENHKRLKQRQKNLVSGLQKAGISCLNGNAGLFCWVDMRHLLRSNTFEAEMELWKKIVYEVHLNISPGSSCHCTEPGWFRVCFANLPERTLDLAMQRLKAFVGEYYNVPEVNGRSQSSHLSHSRGQSLRKWVSRLSFDDRCPIHGR

SEQ ID NO: 6979 - protein, 748 aa, Unknown
  Vibrio sp. Ex25
MIQISGLEKDIGSREKDLKTTKTKKIKKQHERAYELLAEAAYSDPFSALGPFIDDGEGSLRVWMPGANKVELLVNGEPRVALERDGDSGFILKEQRDLHLTHYRLAVDWNGVEQIIDDPYQYHNIYQEYEHLHTPKDMYHYMGAHFVTLERGGENISGVRFLVYAPHASAVSLVGCFNQWDGRRHPMQRLDYGIWGLFIPGLEEGVQYKFELKGPNGEGLPHKQDPWGFYSEQYPSFASITYDHKRYQWQDAKWQNRAVTQKRDEALSFYELHAGSWKRNEKGDFLNYRELAEQLVPYLVDMGYTHVELMPVSEHPFYGSWGYQPVGLFAPTSRFGSPDDFKFFVDTCHQAGIGVVLDWVPAHFPSDDHGLANFDGTPLFHDPDPRRGWHQDWNSYIYDLGREHVRRFLVSNALYWFEQFHIDGIRVDAVASMLYLDYSRSHDQWVPNVDGGNENYDAIATLKWMNEEVYKHFPNAMTIAEESTAFPGVSAPTFMGGLGFGFKWNMGWMHDSLSYIKEDPVHRKYHHNTITFPLVYAHSENYVLSLSHDEVVYGKGSIHNKMPGDEWQQTANLRAYYGYMYGQPGKKLNFMGAEIGQTAEWNHDDQLQWFLLEYERHQGVQKLMRDLNHLYRNEAAMHDQDCVPAGFEWRLQDEADASILAHERISKEGERILIITNFTPVPHERFRLGVPNAGQYELLLNTDDSKYGGSDFKVLTSVKTEKVESESLPQSLELRLPPLSTVFYKLNK

SEQ ID NO: 6980 - protein, 1122 aa, Armoracia rusticana
MSGSRPSQSSEGSRRSRHSARIIAQTTVDAKLHADFEESGSSFDYSTSVRVTGPVVENQPPRSDKVTTTYLHHIQKGKLIQPFGCLLALDEKTFKVIAYSENAPELLTMASHAVPSVGEHPVLGIGTDIRSLFTAPSASALQKALGFGDVSLLNPILVHCKTSAKPFYAIVHRVTGSIIVDFEPVKPYEVPMTAAGALQSYKLAAKAITRLQSLPSGSMERLCDTMVQEVFELTGYDRVMAYKFHEDDHGEVVSEVTKPGLEPYLGLHYPATDIPQAARFLFMKNKVRMIVDCNAKHARVLQDEKLSFDLTLCGSTLRAPHSCHLQYMANMDSIASLVMAVVVNEEDGEGDAPDSTTQPQKRKRLWGLVVCHNTTPRFVPFPLRYACEFLAQVFAIHVNKEVELENQIVEKNILRTQTLLCDMLMRDAPLGIVSQSPNIMDLVKCDGAALLYKDKIWKLGTTPSELHLQEIASWLYEYHTDSTGLSTDSLHDAGFPKALSLGDAVCGMAAVRISLKDMIFWFRSHTAGEVRWGGAKHNPDDRDDARRMHPRSSFKAFLEVVKTRSLPWKDYEMDAIHSLQLILRNAFKDGESTDVNTNIIHSKLNDLKIDGIQELEAVTSEMVRLIETATVPILAVDSDGLVNGWNTKIAELTGLPVDEAIGKHLLTLVEDSSVEIVKRMLENALEGTEEQNVQFEIKTHQSRADAGTISLAVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQKSCCRLKNQEAFVNLGIVLNGAVTSQESEKVSFAFFTRGGKYIECLLCVSKKLDREGVVTGVFCFLQLASHELQQALHVQRLAERTALKRLKAIAYIKRQIRNPLSGVMFTREMIEGTELGPEQRQILHTSALCQEQLSKVLDDSDLESIIEGCLDLEMKEFSLNEVLTASTSQVMMKSNGKSVRITNETGEEVMSDTLYGDSIRLQQVLADFMLMSVNFTPSGGQLTVTASLRKDQPGRSVHLAYLEIRLTHTGAGIPEFLLNQMFGTEEDVSEEGLSLMVSRKLVKLMNGDVQYLRQAGKSSFIISAELAAANK

SEQ ID NO: 6981 - protein, 122 aa, Zea mays
  misc_feature (96)..(96): Xaa can be any naturally occurring amino acid
GKHRIVSLVFALLILLALPVLSTRNAQEDSMANNTGTLVGGIQDVPGNENNLPLQELARFPVDEPTKKANAFLGFEKLVKAKTQVVAGPMYYLPIXVKDGEVKKLFEVKVWEKPWENLKKPV

SEQ ID NO: 6982 - protein, 632 aa, Archaeoglobus fulgidus
MKLFEPIEFGGMKVKNRIVMPAAELNYHTPDGRPTDRLLRFYEERAKGGIGFAVVGIAKIEPHFFGGIAAHSDEFIPDLKKIADVFHKYDVKCALQLWHPGRYEISFDPNRQPVAPSPIPPPIFTKRTPKELTKEEILQIEEEFADAAVRAKKAGFDAVELIGSAGYLISQFFSPATNKRTDEYGGSLENRTRFAVEIIQKIKEKCGESYPVMIRIPGDEFIEGGNTVREMKQIAKILEDAGVVAINVMAGWHESRKPLTTMLVPRGGFAYLAAEIKSAVSVPVIASHRINDPIVAEKILQEGKADMVAMLRALIADPELPKKAKEGRFDEIRYCVACNQGCMDMVMQAQPVTCLVNPIVGREAEFENLKAEKPKKVVIVGGGPGGCMAAEMLARKGHKVVLFEKTDKLGGQLNLAAKSPLGYEFAEVGKYFMNVLPKLGVEVRYNTEADAGKVLAENPDVAVIAVGASPLIPPIPGVENAVTAFDVLAGRAEVGNSVVVIGGGGVGCDVAAELANEGKKVTIVEMLPKIGQDIGISTRWTVLMYLKEKGVEMLTNTKAVEIKPNAVVVEQNGERKELQCDTAVIAVGTKPNNGLYDELQGKVSELYKIGDCVKPRKALDATREGADLALKV

SEQ ID NO: 6983 - protein, 513 aa, Methanococcus maripaludis
MCSISGIIAKDEEGSGSRSLLKNIQKHVINMMKILKHRGPDYSGMMFDDEVLYFENFDDITENTETISRMAMGHNRLAIVGTAVQPIPNTDESIWIICNGEIYNHVELRDELSVDHEFKTDTDSEAIIHTYEDELVDVLDGDYAYAIYDKEKNIIELRRDLMGVKPLYYIDTDEYFAFASEKKALYGLLMEINEMDYKSAFNYDISRLNPNSRLIYELDENSWYIEEDLEKVNPDYFEENDYELCKNELETTILDSVLKRVKGLERVGIIYSGGVDSTLVSKLASENCDVTLYSVGSANSEDLIYAERAAKDMGLKFRKKIILEDEFEEYVIKVAKAIDELDVMKLSVGIPIFAASEMAKEDGIKVVLSGQGADELFAGYNRYQRILNEKGEEGLKKSIISDVFDIHKVNLERDDHCTMANGVELRVPFLDKFVIDVGLSIPVEYKIEEPRKKILRDIASKYVPDYIAQRPKKAAQYGSGSEKMVYAVAKKHGYSKKEINKFFEEYLIEKIKF

SEQ ID NO: 6984 - protein, 368 aa, Pseudomonas fluorescens
MSLLLEPFTLRQLTLSNRIAVSPMCQYSSVDGLANDWHLVHLGSRAVGGAGLVFTEATAITADGRITAEDLGLWNDEQILPLQRITRFINAQGAVAGIQLAHAGRKASTHRPWIGKHGSVKPEDGGWIPVGPSPIAFDPQHTQPKQLDEGQIAQVIQDFVAAAKRALTAGFSVVEVHAAHGYLLHQFLSPLSNQRRDQYGGSFENRIRLVLQVTEAVRAVWPEELPVFVRLSATDWVEDGWNPDETVELARRLKALGADLIDVSSGGTAVNAEIPVGPGYQTRFAERVRKESGIATGTVGMITEPAQAEHILRTCQADIIFLARELLRDPYWPLHADDDLGGRKAVWPAQYQRATHRDQPIHESDLRD

SEQ ID NO: 6985 - protein, 48 aa, Zea mays
  misc_feature (6)..(6): Xaa can be any naturally occurring amino acid
QSDETXKMGDIVHTLTNRRWLEKCVTYAESHDQSLVGDKTIALWLMDK

SEQ ID NO: 6986 - protein, 220 aa, Pyrus communis
CDFEPVKPYEVPMTAAGALQSYKLAAKAIAAIARLQSLPSGSMERLCDTMVQEVSELTGYDRVMAYKFRDDDHGEVVSEITKPGLEPYLGLHYPSTDIPQASRFLFMKNKVRMIVDCCAKQVKVLQDEKVPFDLTLCGSTLRAPHSCHLQYMKNMDSIASLVMAVVVNEGDDEVASPDSVQPQKRKRLWGLVVCHNTSLRFVPFPLRYACEFLAQVFAIP

SEQ ID NO: 6987 - protein, 48 aa, Zea mays
  misc_feature (45)..(45): Xaa can be any naturally occurring amino acid
QSDETWKMGDIVHTLTNRRWLEKCVTYAESHDQALVGDKTIAFWXMDK

SEQ ID NO: 6988 - protein, 131 aa, Zea mays
  misc_feature (43)..(43): Xaa can be any naturally occurring amino acid
QSDETWKMGDIVHTLTNRRWLEKCVTYAESHDQALVGDKTIAXWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 6989 - protein, 573 aa, Saccharomyces cerevisiae
MPIRSISSASQMNVFGKKEEKQEKVYSLQNGFPYSHHPYASQYSRPDGPILLQDFHLLENIASFDRERVPERVVHAKGGGCRLEFELTDSLSDITYAAPYQNVGYKCPGLVRFSTVGGESGTPDTARDPRGVSFKFYTEWGNHDWVFNNTPVFFLRDAIKFPVFIHSQKRDPQSHLNQFQDTTIYWDYLTLNPESIHQITYMFGDRGTPASWASMNAYSGHSFIMVNKEGKDTYVQFHVLSDTGFETLTGDKAAELSGSHPDYNQAKLFTQLQNGEKPKFNCYVQTMTPEQATKFRYSVNDLTKIWPHKEFPLRKFGTITLTENVDNYFQEIEQVAFSPTNTCIPGIKPSNDSVLQARLFSYPDTQRHRLGANYQQLPVNRPRNLGCPYSKGDSQYTAEQCPFKAVNFQRDGPMSYYNFGPEPNYISSLPNQTLKFKNEDNDEVSDKFKGIVLDEVTEVSVRKQEQDQIRNEHIVDAKINQYYYVYGISPLDFEQPRALYEKVYNDEQKKLFVHNVVCHACKIKDPKVKKRVTQYFGLLNEDLGKVIAECLGVPWEPVDLEGYAKTWSIASAN

SEQ ID NO: 6990 - protein, 283 aa, Oenococcus oeni
MSILTDTYTLNNGTKIPKVAFGTWQTPDGDVAYQAVSSALKFGYRHIDTAKIYGNEKSVGRAIADSDVKREDLWVTTKLPSQDKTRDLVLADFESSLSRLGLDYVDLYLIHAPWPWGEAGSKHFDEENAEAWKTLEELQKSGRVKSIGISNFDVHDMENILKIAEIKPVVNQIQYYIGFTEPKISKFAAEHDIRIEAYSPLATGDILNSEAIRKIAGRYNVSVAQLALRFTLQNGTVTLPKAISERHIQENTQLDFTINDDDMRTLNSMPDAAPAHFHNSTQG

SEQ ID NO: 6991 - protein, 280 aa, Streptococcus mutans
METVVLSNGVKMPILGFGVFQVPDLEECERVVTEAIKVGYRLLDTAQVYGNEEAVGNAVRKSGLAREEFFITTKVWISNAGYEKAKASLDESLRKLQTDYVDLVLIHQPFGDYYGTWSALEAYYKSGKIKAIGVSNFYPDRLVDLASFNEIVPMVNQVETHVFNQQIEAKKVSEEYGVQLESWGPFAEGKNNFFTNPTLTAIGEKYGKSAAQVGLRYLIQRGVVVIPKTVHQERMVQNFDVFGFNLSDDDMADILKLDQGESLFINHYDPETVKFLANYK

SEQ ID NO: 6992 - protein, 288 aa, Streptococcus mutans
MEYITLNTGVKMPMEGFGVFQVTDPEICKESVLNAIKTGYRLFDTAAVYGNEKALGEAIHEAIEQGLVTRNELFITSKLWVQDMNYEAAKKGIERSLEKLGLDYLDLYLLHQAMRDYFGAYRALEEAYQAGKLRAIGVSNFYPNILTNFCETVSVIPAVNQIELHPFFTQEEALETARYYGVVPEAWAPLGGGRYDAFNNAILQEVASAHQKTVGQIMLRWNVQRGVVVIPKSTHKERIEENFAIWDFSLTDDEMTKIASLDMGYGDTRTKHFDPNFVRSVLNVKIHD

SEQ ID NO: 6993 - protein, 92 aa, Glycine max
GNRDVTGSQNSVEIDALARFAVEEHNKKQNALLEFEKVVTAKQQVVSGTLYTITLEAKDGGQKKVYEAKVWEKSWLNFKEVQEFKLVGDAPA

SEQ ID NO: 6994 - protein, 103 aa, Glycine max
AALEKVQELGGITDVHGAANSVEINNLARFAVEEQNKRENSVLEFVRVISAKQQVVAGVNYYITLEAKDGLIKNEYEAKVWVREWLNSKELLEFKPVNVSSTQ

SEQ ID NO: 6995 - protein, 478 aa, Rhodospirillum rubrum
MTIPVLVWFRDDLRLADNPALCAALDSGAPVIPFYLLDDSTSDGHRPLGGATRWWLGRSLTSLAESIAQRGGRLVLRRGEALSAVPELAAETDAAALFANRLYGMDSLRDDDLFMVLRVAGLTVRLFDSGLLHRPEAVTTKTGRPFRVFTPFWKTLSATLDPGLPLAAPDSFPPVDDPPPASDSLADWSLEPTTPDWAGGLRDTWQPGEAGAQARLEAFFNGPVADYASGRDRPDKPLTSKLSPHLRFGEISPRQVWTAARHHPPGGGMDAFLRELGWREFCHHLLFQAPTMAEEPLKAEFLAFPWTEAKEIGPALAAWQSGETGYPIVDAGMRELWHTGWMHNRVRMIAASFLIKDLLIPWQHGERWFWDTLVDACPANNAAGWQWVAGCGADAAPFFRIFNPVTQGERFDPEGAYVRRWLPELADLPSSLIHRPWEAPPLILRQAGVTLGKTYPPPLIDHAHARVRALEALAVVNR

SEQ ID NO: 6996 - protein, 100 aa, Glycine max
LGGFTDITGAQNSIDIENLARFAVDEHNKKENAVLEFVRVISAKKQVVSGTLYYITLEANDGVTKKVYETKVLEKPWLNIKEVQEFKPITVAVNPLSVTV

SEQ ID NO: 6997 - protein, 363 aa, Photobacterium profundum
MIFQEFSHELLKAKNRIVMAPMTRSRTSQPGDVPNEMMASYYKQRANAGLIVTEGAPISAVGRGYSMTPGIYTQDHIDGWKKVTQAIHEEGGKVFIQLWHVGRRSHSTISGQQPFSSSVIKVPDQVFGPLSEGGFGMIETEQPKAMTQQDIDNTIADFVQAAKNAIDAGFDGIEIHAAHGYLFDTFMHLESNQRDDQYGGSQENRMRFLLDTLKAVADEICSDKVAVRVSPHVIEGFAEEDPEIVEVILKALAKMAAMNLAYVHFSENISRYVEVPESFRQQVREVYPNPIMVAGKLTKQTAQELVDKKYVDLVAFGTPYVTNPDLVERFKNDWPLTEFDADARLTLYGGSEEGYIDYPAYQA

SEQ ID NO: 6998 - protein, 98 aa, Lycopersicon esculentum
EYREHVKDLVCISKDLSRIVIVDNNPFSFLLQPLNGIPCIPFSAGQPHDIQQLLEVILPLLKHLSKQKDVRPELYDRFHMPECLQKHGIPASALTSEE

SEQ ID NO: 6999 - protein, 327 aa, Photobacterium profundum
MATYYAQRATAGLIISEGTQISPMAKGYAWTPGIYTPEQITGWKKVTDAVHAKGGAIFAQLWHVGRVTHPDNICGQQPISSSAIKAENVKVFIDNGTDEPGFVDVVEPREMTADDIQQVIEQYRQAALNAIEAGFDGIELHAANGYLINQFIDSEANNRTDEYGGSLENRLRFLDEVVAAMVKAIGAERVGVRLAPLTTLNGTVDADPINTYTEAATLLNKHKIVYLHIAEVDWDDAPDTPNAFKQALRNAYQGVLIYAGRYNAEKAQQAIKAGLADMIGFGRPFVANPDLPNRIQNGYPLAEHVPETLFGGNEKGLIDYPVYQLED

SEQ ID NO: 7000 - protein, 214 aa, Prunus dulcis
TGVRPYEVPMTAAGALQSYKLAVKAIARLQSLPSGSMERLCDTMVQEVFELTGYDRVMAYKFHDDDHGEVVSEITKPGLEPYLGLHYPSTDIPQASRFLFMKNKVRMIVDCCAKQVKVLQDEKLPFDLTLCGSTLRAPHSYHLQYMKNMESIASLVMAVVVNEGDDEVASPDSVQPQKRKRLWGLVVCHNTSPRFVPFPLRYACEFLAQVFPYT

SEQ ID NO: 7001 - protein, 459 aa, Bacillus anthracis
MGENHDKQRQSLLGKDFNENGERNEQAILHSQTVGSRGPVLEQDSVLHEALQEFIHEKILERPVHVKGFGAFGYFQTIYPMSEHTKLSFLQHSNEKVPVMVRFSLAVSTKGTPDTARNVRGFSTKFYTKEGIFDLLCNHIPVFSVRDPMRFPETIQALSPSPKNNLLDPNRFWSFVARAPESIHFVVHLYSDNGTAKSFRRIPGHSVNTYVWRNAEGNRKYVKYHWYPFEGVQSITNEEANKLAAENPDYSGKDLYDAIANGKPVEYGLYVQLMDPKDEAHLSYDPLDDTKAWDEKAYPLIPVGKMVLNKNPENYMEQVEKVAFSPSNLLNGAELSDDKMLQGRANIYSDSQRRRIGPEFRKLAINQQQDWTPANQITSGDGRYVEGKLERTSIPKQDDFTQAGEFYAKLQPIEKEHLAENLASDLKVISDDIRKVVLGYFHNVSADLVKRIESAMQQL

SEQ ID NO: 7002 - protein, 280 aa, Streptococcus agalactiae
METYTLSNTLNIPKIGFGTWQLTEGEEAYKAVTHALKVGYTHIDTAQIYGNEHSVGRAIRDSGLARESIFLTTKIWNDKHDYHLAKASIDESLQKLGVDYIDLLLIHWPNPKALRENDAWKAGNAGTWKAMEEAYKEGKVKAIGVSNFMKHHLEALFETAEIKPMVNQIILAPGCAQEDLVRFCKGNDILLEAYSPFGTGAIFENESIKAIAEKYGKSVAQVALRWSLDNGFLPLPKSATPKNIEANLDIFDFQLNEDDIATLIQLDSGIKPKDPDNVSF

SEQ ID NO: 7003 - protein, 335 aa, Triticum aestivum
  misc_feature (83)..(83): Xaa can be any naturally occurring amino acid
AYLGDTIEQVCTKKQAGTGPEFPGYRRPTRPANYLGTMHHEFTFTVQDGIDAIEDVIYHTETYDVTTIRASTPMFLMSSKIKXLGVKMVISGEGSDEIFGGYLYFHKAPNKEELHRETCQKIKALHQYDCLRANKATSAWGLEARVPFLDKEFINEAMSIDPEWKMIRPDLGRIEKWVLRKAFDDGEQPFLPKHILYRQKEQFSDGVGYSWIDGLKAHAESNVTDRMMSNAKFIYPHNTPTTKEAYCYRMIFERFLPQNSAILTVPGGPSVACSTAKAVEWDAQWSGNLDPSGRAALGVHLSAYEQEHLPATILTGTSKKPRMIEVAAPGVAIES

SEQ ID NO: 7004 - protein, 393 aa, Chromobacterium violaceum
MQSIMSSLERLPLRGGRIPRLNDMPAPDLFSPLQAGALPLPSRIVMAPMTRCRTDQPGDIPNAMMARYYAQRAGAGLIVSEATQISRQGQGYSFTPGIYSQDQIDGWRRVTDAVRQAGGRMVLQLWHVGRMSHPMFHDGAPPVAPSAIAPDAQVWVADETGAGRMVDCPTPRALETAEIAAIVGDYRQAARNAMAAGFDGVEIHAANGYLIDQFLRSTSNRRDDAYGGSLENRLRFLMEVAAAVADEIGAARVGVRLAPYITARGMNCPEIVPAILEAAVRLNGLGIAYLHLSEADWDDAPQVDDAFRHALRARFRGAIIVAGRYDQPRGERLLAEGLADLIAFGRPFIANPDLPERLARGWPLADFDPSALFGGDGRGYDDYPRYREMATAR

SEQ ID NO: 7005 - protein, 252 aa, Prunus emarginata
AHYKSEADVGNAIAEAIRSGLVKREELFITSKASNHGHVVEACKNSLEKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRESLVRFCKKHGVTPMAHTPLGGATANVKSFGSISPLEDPVLLGLAKKYKKSVAQIALRWNIERDTPVIPKSSKVERLKENLEVLNFKLEKEDIELINTIDKKSRTTL

SEQ ID NO: 7006 - protein, 548 aa, Haemophilus influenzae
MAAKDVKFGNDARVKMLKGVNVLADAVKVTLGPKGRHVILDKSFGAPTITKDGVSVAREIELEDKFENMGAQMVKEVASKANDAAGDGTTTATVLAQAIVNEGLKAVAAGMNPMDLKRGIDKAVSAVVSELKNLSKPCETAKEIEQVGTISANSDSIVGQLISQAMEKVGKEGVITVEDGTGLEDELDVVEGMQFDRGYLSPYFINKPETATVELDNPYLLLVDKKISNIRELLPVLEGVAKAGKPLLIIAEDVEGEALATLVVNTMRGIVKVAAVKAPGFGDRRKAMLQDIAILTAGTVISEEIGMELEKATLEDLGQAKRVVINKDNTTIIDGIGDEAQIKGRVAQIRQQIEESTSDYDKEKLQERVAKLAGGVAVIKVGAATEVEMKEKKDRVDDALHATRAAVEEGIVAGGGVALVRAAAKVAASLKGDNEEQNVGIKLALRAMEAPLRQIVTNAGEEASVVASAVKNGEGNFGYNAGTEQYGDMIEMGILDPTKVTRSALQFAASVAGLMITTECMVTDLPKDDKADLGAAGMGGMGGMGGMM

SEQ ID NO: 7007 - protein, 363 aa, Pseudomonas syringae
MSALFEPFKLKDVTLRNRIAIPPMCQYSAIDGVVNDWHHVHLASMARGGAGLLVVEATAVAPEGRITPGCTGIWNDEQAQAFVPIVKAIKDAGCVPGIQIAHAGRKASANRPWEGDDHIVASDSRGWDTIAPSAIAFGANLPKVPRAMTLDDIARVRQNFVDAARRARDAGFEWIELHFAHGYLGQSFFSEHSNQRTDEYGGSFDNRSRFLLETLAAVREVWPENLPLTARFGVLEYDGRDEQTLTESIELARRFKAGGLDLLSVSVGFSTPDANIPWGPAFMGPIAERVRREAAIPVTSAWGFGEPKLAEEAVKSGQLDLVSIGRAHLADPHWAYFAAKELGVEKSAWTLPAPYAHWLERYR

SEQ ID NO: 7008 - protein, 48 aa, Zea mays
  misc_feature (6)..(6): Xaa can be any naturally occurring amino acid
QSDETXKMGDIVHTLTNRRWLEKCVTYAESHDQALVGDKTIAFWLMDK

SEQ ID NO: 7009 - protein, 304 aa, Oryza sativa
MVCCCDDDDGSRVLEGGAGMADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQSNFHILVVLQSFAFPYMYQVAQIYCNKYEVSREQIWDTPQIMELSPWIPYTINRIWKETHGSQDIRIQGRPREAANSALDWQWPSKHSSLASNFYGTRVVGGHHEYQRSTKKDTTHVNFASGLGDLG

SEQ ID NO: 7010 - protein, 80 aa, Zea mays
QSDETWKMGDIVHTLTNRRWLEKCVTYAESHDQALVGDKTIAFWLMDKDMYDFMALDRPSTPTIDRGIALHKMIRLITMG

SEQ ID NO: 7011 - protein, 368 aa, Prunus armeniaca
MATLVEPPDGIRQRGKHYYSMWQTLFEVDTKYVPIKPIGRGAYGIVCSSINRATNEKVAIKKINNVFENRIDALRTLRELKLLRHIRHENVIALKDVMMPIHRTSFKDVYFVYELMDTDLHQIIKSSQPLSSDHCKYFLFQLLRGLKYLHSANILHRDLKPGNLLINANCDLKICDFGLARTSGGTGQFMTEYVVTRWYRAPELLLCCDNYGTSIDVWSVGCIFAEILGRKPIFPGTECLNQLKLIINVLGSQHEPDLAFIDNPKARKYIKSLPYSRGTHFSRLYPQADPLAIDLLQRMLVFDPTKRISVTEALQHPYMSGLYDPRCNPPAQVPINLDIDENLAEPMIREMMWHEMLHYHPEAAFVNA

SEQ ID NO: 7012 - protein, 125 aa, Zea mays
WKMGDIVHTLTNRRWLEKCVTYAESHDQALVGDKTIAFWLMDKDMYDFMALDRPSTPTIDRGIALHKMIRLITMGLGGEGYLNFMGNEFGHPERIDFPRGPQRLPSGKFIPGNNNSYDKCRRRFD

SEQ ID NO: 7013 - protein, 420 aa, Triticum aestivum
  misc_feature (395)..(395): Xaa can be any naturally occurring amino acid
NKFVQKSRLVPVRNSRDIVDPRVRERVGSTMKLIRHPNVIRMYEVMASRTKIYIVMELVTGGELFDKIASRGRLKEDDARKYFQQLINAVDYCHSRGVYHRDLKPENLLLDANGTLKVSDFGLSALSQQVREDGLLHTTCGTPNYVAPEVINNKGYDGAKADLWSCGVILFVLMAGYLPFEDSNLMALYKKIYKADFSCPSWFSTSAKKLIKKILDPNPNSRITIAEVINNEWFKKGYQPPRFETAEVNLDDINSIFNESGDPAQLVVERREERPAVMNAFELISTSQGLNLGTLFEKQTDSVKRETRFASRLPANEILSKIEAAAGPMGFNVPRPRPRLKLQGENPGRKGQLAIATEVFEVTPSLYMVELRKSNGDTLEFHKFYHSISNGLKDXMWKPEGSIAEGDETRHRSLRDISKC

SEQ ID NO: 7014 - protein, 428 aa, Nostoc punctiforme
MHLLWFRRDLRLTDNEIVTSSSGNDARVLPFFIIDPWFYTWADVGTARVRFLFESLEKLNSNLQKLSSRLYLFEGNSTGIVQELTRQLTERGYKPKLFFNRDVQVEYGINRDKTIVDFYKQLNLDYHIGLNNFLQSAEQRDEWVNEYYTYQRQSQYKTPAIINTPQITLNLPQLTFEELKQKYHRFWAVEKVYFPGGETQAQAQLDSFLKKRYYGYHWKLSRPMLSQLGATSHLSPHLTFGTISTRTVYQSTKALAEQLKTQPKAEFSLKAFRDRLRWHDSFTQRLYFHPEIAYTNRYREFDKLYTPETLSGAKQELYQAWQQGMTGFPLVDASMRQLQTMGWMNFRMRAMCATFLTINCGVSWHHGAKHYMNYLVDGDLAIDNWQWQMQAGVTNPLSDTFRIYNPSKNIAEKDPLGVNIAKLSPGAR

SEQ ID NO: 7015 - protein, 245 aa, Triticum aestivum
  misc_feature (34)..(34): Xaa can be any naturally occurring amino acid
  misc_feature (78)..(78): Xaa can be any naturally occurring amino acid
  misc_feature (112)..(112): Xaa can be any naturally occurring amino acid
  misc_feature (135)..(135): Xaa can be any naturally occurring amino acid
  misc_feature (196)..(196): Xaa can be any naturally occurring amino acid
  misc_feature (221)..(221): Xaa can be any naturally occurring amino acid
  misc_feature (241)..(241): Xaa can be any naturally occurring amino acid
MSSSAMEALHALIPEQHQRDVEAAAALSGATRGXDSGHVLHGWANRKRSRRQRSEEENLALCLLMLSRGGKQRVQAPXPEAYAVPVPAEFKCSVWGKSFSSYQALGGHKTSXHGVKQPSPPADAAAAPLVALPGXAAVLPSAEPATSYTVASSDGTTNRVHRCSICQKEFPTGQALGVHKRKHYEGGVGADDSSTXLLAAAAADFEVGSTGYGTSSGRAFXLEIPGVPEFGWRPCPRCKLXWEDH

SEQ ID NO: 7016 - protein, 97 aa, Zea mays
  misc_feature (6)..(6): Xaa can be any naturally occurring amino acid
  misc_feature (39)..(39): Xaa can be any naturally occurring amino acid
QSDETXKMGDIVHTLTNRRWLEKCVTYAESHDQALVGDXTIAFWLMDKDMYDFMALDRPSTPTIDRGIALHKMIRLITMGLGGEGYLYFMGNECGHP

SEQ ID NO: 7017 - protein, 205 aa, Glycine max
MTNYGTIPTSSTPSTNLEFISRAKQRVKEGLGTRRPWKLMFNFRSFALPAGVGDAVSRVRENISYFQMNYAIVVLIVLFLSLLWHPISLIVFVVLMAAWLFLYFLRDEPLIIFGRLISDRVVLIVMAVLTVVLLLLTGAIGNILVALLIGAVLVVAHAALRKTDDLFFDEEEATRLSPPGAPLSGSPNLLLLLLSVNFLFGQFSK

SEQ ID NO: 7018 - protein, 544 aa, Chlamydia muridarum
MVAKNIKYNEEARKKIQKGVKTLAEAVKVTLGPKGRHVVIDKSFGSPQVTKDGVTVAKEVELADKHENMGAQMVKEVASKTADKAGDGTTTATVLAEAIYTEGLRNVTAGANPMDLKRGIDKAVKVVVDQIKKISKPVQHHKEIAQVATISANNDAEIGNLIAEAMEKVGKNGSITVEEAKGFETVLDVVEGMNFNRGYLSSYFATNPETQECVLEDALVLIYDKKISGIKDFLPVLQQVAESGRPLLIIAEDIEGEALATLVVNRIRGGFRVCAVKAPGFGDRRKAMLEDIAILTGGQLISEELGMKLENASLAMLGKAKKVIVSKEDTTIVEGMGEKEALDARCESIKKQIEDSTSDYDKEKLQERLAKLSGGVAVIRVGAATEIEMKEKKDRVDDAQHATIAAVEEGILPGGGTALIRCIPTLEAFLPMLTNEDERIGARIVLKALSAPLKQIAANAGKEGAIIFQQVMSRSANEGYDALRDAYTDMIEAGILDPAKVTRSALESAASVAGLLLTTEALIAEIPEEKPAAAPAMPGAGMDY

SEQ ID NO: 7019 - protein, 161 aa, Chenopodium rubrum
MSLIPNNWFNTGRRSNIFDPFSLDEIWDPFFGLPSTLSTVPRSETAAETAAFANARIDWKETPEAHVFKADLPGVKKEEVKVEVEDGNVLRISGQRAREKEEKNDTWHRVERSSGQFMRKFRLPENAKVDQVKAGMENGVLTVTVPKNEAPKPQVKAINVY

SEQ ID NO: 7020 - protein, 246 aa, Lycopersicon esculentum
MGRGRVELKRIENKINRQVTFAKRRNGLLKKAYELSVLCDAEVALLVFSNRGKLYEFCSTNNMLKTLDRYQKCSYGTLEVNRSIKDNEQSSYREYLKLKAKYESLQRYQRHLLGDELGPLTIDDLEHLEVQLDTSLKHIRSTRTQMMLDQLSDLQTKEKLWNEANKVLERKMEEIYAENNMQQAWGGGEQSLNYGQQQHPQSQGFFQPLECNSSLQIGYDPITTSSQITAVTNAQNVNGMIPGWML

SEQ ID NO: 7021 - protein, 277 aa, Staphylococcus aureus
MEVKTFYNGNTMPQIGLGTFRVENDENCMESVKYAIEQGYRSIDTAKVYGNEEQVGAGIRAGLESTGIAREDLFITSKLYFEDFGRENVAAAYEASLSRLGLKYLDLYLVHWPGTNEAVMVDTWKGMEDLYKNNNVKNIGVSNFEPEHLEALLAQVSIKPVINQVEYHPYLTQHKLKLYLAAQRIVMESWSPLMNAQILNDETIKDIAQELGKSPAQVVLRWNVQHAVVTIPKSVTPNRISENFQIFDFELSDEQMTRIDGLNQDKRIGPDPKKFEG

SEQ ID NO: 7022 - protein, 90 aa, Artemisia vulgaris
MAVCGGVTECKNFENNVEIETIAKFAVEEHNKKENATLEFVKVVSAKEQVVSGKIYYITIETNDGKTYEAKLWVKPWENFQELQEFKPAA

SEQ ID NO: 7023 - protein, 534 aa, Zea mays
MGDWVPRGRPGSSDLLLSSRTRQIYRQRTAKARGPQPLSPKGEDEMALSTTNTNAAESQLHCSTFASRYVRTALPRFKIPEQSIPKEAAYQIINDELMLDGNPRLNLASFVTTWMEPECDKLIQSSINKNYVDMDEYPVTTELQNRCVNMIAHLFNAPIGDDETAVGVGTVGSSEAIMLAGLAFKRKWQNKMKAAGKPYDKPNIVTGANVQVCWEKFARYFEVELKEVKLKEGYYVMDPEKAAEMVDENTICVAAILGSTLNGEFEDVKLLSDLLTAKNAETGWDTPIHVDAASGGFIAPFLYPELEWDFRLPLVKSINVSGHKYGLVYAGVGWVIWRSKEDLPDELIFHINYLGADQPTFTLNFSKGSSQIIAQYYQLIRLGFEGYKDVMQNCRDNAAVLREGINKMGYFDVVSKDSGVPLVAFSLKDSSKYTVFEVAESLRRFGWIVPAYTMPADAEHVAVMRVVIREDFSRGLAERLIADLGKTMADMDAHAGRKQAPEQPKKSVHDIEKEVTTFWRRLVANSKKKSSMVC

SEQ ID NO: 7024 - protein, 249 aa, Glycine max
MGRGRVELKRIENKINRQVTFAKRRNGLLKKAYELSVLCDAEVALIIFSTRGKLYEFCSTNSMLKTLERYQKCSYGAVEVSKPGKELEQSSYREYLKLKARFESLQRTQRNLLGEDLGPLNTKDLEQLERQLDSSLKQVRSTKTQFMLDQLADLQNKEHMLVEANRSLTMKLEEINSRNQYRQTWEAGEQSMSYGTQNAHSQGFFQPLECNPTLQIGSDYRYNPEASEQQLAATTQAQQVNGFIPGWML

SEQ ID NO: 7025 - protein, 480 aa, Zea mays
RKMARKPLDYEELNENVKRVQYAVRGELYLRASELQKEGKKIIFTNVGNPHALGQKPLTFPRQVVALCQAPFLLDDPHVGLMFPADAIARAKHYLAMAPGGLGAYSDSRGIPGIRKEVADFIHKRDGYPSDPELIYLTDGASKGVMQILNTIIRNEMDGILVPVPQYPLYSATISLYGGSLVPYYLEEEANWSLDFVNIRQTVAEARSKGISVRAMVMINPGNPTGQCLSEANIKELLQFCYHENLVLLADEVYQQNIYQDERPFISARKVMFDMGPPISSELQVVSFHTVSKGYWGECGQRGGYFEMTNLPPKTVDEIYKVASIALSPNVPGQIFMGVMVNPPKPGDISYLKFAAESKSIHESLRRRARMMTDGFNSCRNVVCNFTEGAMYSFPQIRLPPRAIEAARRAGKSADVFYCLKLLEATGISTVPGSGFGQKEGVFHLRTTILPAEEDFPAIMSSFKKFNDSFMEQYEGYSRL

SEQ ID NO: 7026 - protein, 427 aa, Fusobacterium nucleatum
MIAISSLSFTEDDRTGFLSNMRELKEISDIMDVIQDSYVENANAQKYKEEKNKNSARKNTGVTKKSLMQGALRGMMESLDDPHSVYFTKEEMRSFQEDIKGKYVGVGMVIQKKVGEPLTVVSPIEDGPAYKVGIKPKDKVIEIDGESTYNLTSEEASKRLKGKANTIVKVKVFREVNKMTKVFELKRETIELKYVKSKMLDDGIGYLRLTQFGDNVYPDMKKALEDLQAKGMKGLIFDLRSNPGGELGQSIKIASMFIEKGKIVSTRQKKGEESVYTREGKYFGNFPMVVLINGGSASASEIVSGALKDHKRATLIGEKTFGKGSVQTLLPLPDGDGIKITIAKYYTPNGISIDGTGIEPDTKIEDKDYYLISDGAITNIDENQQKENKKEIIKEVKGEKVAKEVDTHKDIQLEAAIKAIKGMTNKK

SEQ ID NO: 7027 - protein, 512 aa, Arabidopsis thaliana
MDGSGTGSRSGVESILPNYKLGRTLGIGSFGRVKIAEHALTGHKVAIKILNRRKIKNMEMEEKVRREIKILRLFMHPHIIRLYEVIETPTDIYLVMEYVNSGELFDYIVEKGRLQEDEARNFFQQIISGVEYCHRNMVVHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSPGARDLIPRMLVVDPMKRVTIPEIRQHPWFQAHLPRYLAVPPPDTVQQAKKIDEEILQEVINMGFDRNHLIESLRNRTQNDGTVTYYLILDNRFRASSGYLGAEFQETMEGTPRMHPAESVASPVSHRLPGLMEYQGVGLRSQYPVERKWALGLQSRAHPREIMTEVLKALQDLNVCWKKIGHYNMKCRWVPNSSADGMLSNSMHDNNYFGDESSIIENEAAVKSPNVVKFEIQLYKTRDDKYLLDLQRVQGPQFLFLDLCAAFLAQLRVL

SEQ ID NO: 7028 - protein, 280 aa, Lactococcus lactis
MIEQEKYTLNDGHLIPKIGLGTFQIRGYEGVEQILTAIQSGYRLLDTSTNYDSEGAVGEAIRRSGIPRSNFFVTTKLPGKYHHFEDALKMIEESLLRTGLSYFDLYLIHWPLPKRDNYVEAWKALIAAKKRGLVRSIGVSNFEEDHLDKIIQETGVIPAINQNEIHPYWPQEKLLKINKKYGILTEAWSPLGRGSKELEESLIQNIAQKYGKDTGQIILRWQVERGIIPIVKATSPEHQRRNIDIFDFSLSSEEINKITALKQENGRVDNQDPNEYEEFV

SEQ ID NO: 7029 - protein, 76 aa, Zea mays
QSDETWKMGDIVHTLTNRRWLEKCVTYAESHDQALVGDKTIAFWLMDKDMYDFMALDRPSTPTIDRGIALHKMIRL

SEQ ID NO: 7030 - protein, 348 aa, Brassica rapa
MDQWFYLFPAEDSHLHHRDNALTPPSSSLMPSFSREMEMSAIVSALTHVVSGNVPPHQFVGGGEGTSNSSSSSGQKRRREVEEGGGGGKSVKAANTLTVDQYFSGGNSSSRVREASSNMSGSGPTYEYTTTTTTNTETSSLNGDQQPRRRYRGVRQRPWGKWAAEIRDPFKAARVWLGTFDNAESAARAYDEAALRFRGNKAKLNFPENVKLVRPATTQSVQQTTAVQTPTQFRNSTSTSTLLPLRPAVDSQPLIQPYNLSYSEMARHQQQFQQHNQQTMDLYDQMSFPLRFGYTGDSMMQSTSSSSSHSRPLFSPAAVQPSETGYLQDIQWSPDKTSNHNYNNSSSS

SEQ ID NO: 7031 - protein, 598 aa, Unknown
  Arthrobacter sp. Q36
MTHTYPREAAKPVLGPARYDVWAPNAESVTLLAGGERYAMQRRAETGPEDAGWWTAAGAPTDGNVDYGYLLDGDETPLPDPRTRRQPDGVHALSRTFDPSAYSWQDDAWQGRELQGAVIYELHLGTFTPEGTLEAAAGKLDYLAGLGVDFIELLPVNAFNGTHNWGYDGVQWFAVHEAYGGPEAYQRFVDAAHAAGLGVIQDVVYNHLGPSGNYLPRFGPYLKQGEGNTWGDSVNLDGPGSDHVRRYILDNLAMWLRDYRVDGLRLDAVHALKDERAVHILEDFGALADQISAEVGRPLTLIAESDLNNPRLLYPRDVNGYGLEGQWSDDFHHAVHVNVTGETTGYYSDFDSLAALAKVLRDGFFHDGSYSSFRERHHGRPINFSAVHPAALVVCSQNHDQIGNRATGDRLSQTLPYGSLALAAVLTLTGPFTPMLLMGEEYGASTPWQFFTSHPEPELGKATAEGRIKEFERMGWDPAVVPDPQDPETFRRSKLDWAEAAEGDHARLLELYRSLTALRRSTPDLTKLGFEDTQVAFDEDARWLRFRRGGVQVLLNFSEQPVSLDGAGTALLLATDDAVRLEGERAELGPLSAAVVSD

SEQ ID NO: 7032 - protein, 48 aa, Zea mays
  misc_feature (5)..(6): Xaa can be any naturally occurring amino acid
  misc_feature (43)..(43): Xaa can be any naturally occurring amino acid
QSDEXXKMGDIVHTLTNRRWLEKCVTYAESHDQALVGDKTIAXWLMDN

SEQ ID NO: 7033 - protein, 348 aa, Crocosphaera watsonii
MTSVQIPVIPEQSLDRECTTLSRHVLQQLQSFSPEAQDLSAIMNRIALAGKLISRRLSQAGLMADVLGFTGETNVQGESVKKMDVYANDVFISVFKQSGLVCRLASEEMDKPYYIPENCPIGRYTLLYDPIDGSSNVDINLNVGSIFAIRQQSGEDLDGEATDLLQDGRGQLAAGYIVYGPSTMLVYTIGHGVHSFILDPSLGEFILAQENIQIPDHGPVYSTNEGNFWQWDEAIRDYTRYVHRHEGYTARYSGALVGDIHRILMQGGVFLYPGTVKKPEGKLRLLYETAPLAFLMEQAGGKASDGVKPILDVVPDKLHARSPLVIGSKEDVSLVESFIQDHQRRGNA

SEQ ID NO: 7034 - protein, 665 aa, Arabidopsis thaliana
MANKYFSSVLKSLLLLLHLVFLSKQHVDSASIVKFLPGFEGPLPFELETGYIGIGEEEEVQLFYYFIKSERNPKEDPLILWLTGGPGCSSISGLLFENGPLTMKLDVYNGTLPSLVSTTYSWTKTSSMIFLDQPVGTGFSYSRTQQFNKPSDSGEAKRIHEFLQKWLGKHQEFSSNPFYVAGDSYSGLVVPATVQEISKGNYECCNPPINLQGYVLGNPLTDYAIDSNSRIPFAHGMALISDELYESLKKTCKGEYTNVHPRNTQCLKFIEEFNKCTNRILQQLILDPLCETETPDCYIYRYLLTTYWANDATVREALQINKESIGEWVRCYRTIPYDNDIKSSMPYHVNNSISGYRSLIYSGDHDLEVPYLGTQAWIRSLNYSIIDDWRPWMIKNQIAGYTRTYANKMTFATIKGGGHTIEFKPEEASIISMLILPLSSSFFLVLKGLFPLSSKPGPLAMKLDVYNGTLPSLVPTTYSWTKTSSMIFLDQPVGTGFSYSRTQQYNKPSDSGEAKRIHEFLQKWLSKHQEFSSNPFYVAGDSYSGMVVPATVQEISKGNYQCCSPPINLQGYVLGNPITEHAIDYNYRIPFAHGMALISDELYESLKRVCKGEYVDPRDTECLKLVEEFSKVTYSTEESYFSCCVCVCLSPLVNKQHHFCGYCVF

SEQ ID NO: 7035 - protein, 123 aa, Zea mays
  misc_feature (6)..(6): Xaa can be any naturally occurring amino acid
  misc_feature (43)..(43): Xaa can be any naturally occurring amino acid
QSDETXKMGDIVHTLTNRRWLEKCVTYAESHDQALVGDKTIAXWLMDKDMYDFMALDRPSTPTIDRGIALHKMIRLITMGLGGEGYLNFMGNEFGHPEWIDFPRGPQRLPSGKFIPGNNNSYD

SEQ ID NO: 7036 - protein, 546 aa, Burkholderia fungorum
MAAKEIIFSDVARSRLVEGVNILANAVKVTLGPKGRNVVLERSFGSPVVTKDGVSVAKEIELSDRVQNIGAQLVKEVASRTSDAAGDGTTTATVLAQAIVREGQKYVAAGLNPLDLKRGIDKAVIAAIEELKKISKPTTTSKEIAQVATISANGEESIGQRIAEAIDRVGKEGVITVEDGKSLDDELDVVEGLQFDRGYLSPYFINDQDKQVAVLDNPFVLLHDRKVSNIRDLLPILEQVAKAGRPLLIIAEDVEGEALATLVVNNIRGILKTVAVKAPGFGDRRKALLEDIAILTGGQVIAEETGLSLEKATLAELGQAKRIEVGKENTTVIDGAGDSKNIEARVKQIRTQIEEATSDYDREKLQERVAKLAGGVAVIKVGGATEIEVKEKKDRVDDALHATRAAVEEGIVPGGGVALIRVKQAISGLKGANADQDAGIKIVLRALEEPLRQIVTNAGEEASVVVAKVAQGTGNFGYNAQTGEYGDLVQSGVLDPTKVTRTALQNASSVAGLLLTTDATVHEAPKDTPAAGQPGGPGAGGPGLDF

SEQ ID NO: 7037 - protein, 131 aa, Zea mays
  misc_feature (5)..(6): Xaa can be any naturally occurring amino acid
  misc_feature (39)..(39): Xaa can be any naturally occurring amino acid
QSDEXXKMGDIVHTLTNRRWLEKCVTYAESHDQALVGDXTIAFWLMDKDMYDFMALDRPSTPTIDRGIALHKMIRLITMGLGGEGYLNFMGNEFGHPEWIDFPRGPQRLPSGKFIPGNNNSYDKCRRRFDL

SEQ ID NO: 7038 - protein, 513 aa, Zea mays
  misc_feature (256)..(256): Xaa can be any naturally occurring amino acid
MSYNKAPSITAETINPRVKIIRYAPCGEIVKHAARLEQEIEENPASIPFQEIIYCNLGNPQVLGQPPLTFFREVLSLCDNPALMDRDEARALFSPCSIRRARRILNSIPSKDTGGYTDCRGIKCLRQVVADGITARDGFPSTADDIFLTDGATSAINLMMQILIRSHEDGILSPLPEYPLYSASIILHGGTMVPYNLTEDNGWGLEIFEVKRCLEEARSAGLTVRAMVVINPGNPTGQLRLYQSFSSSTHLIPLVXVLSVTNQEEIVEFCRKEGLVILADEVYQENIYAENKKFHSFKKVARSLAYDENDLTLVSLHSVSMSYGESGRRGGYMEVSGVAANVKDQIYKVASLTLCPNIAGQILVSLAMDPPKLGDESFESFDKEKEQIRSSFCKRAKTLEKAFSGLEGVTCNKLEGALYLFPRLHLPSAAIRAADFEGVSPDIFYAHRLLDATGIAVVPGSGFHQASGTIHIRCTILPDERKIEAMVARLRAFHKAFMNEFRGSQQVMNDLRR

SEQ ID NO: 7039 - protein, 131 aa, Zea mays
  misc_feature (12)..(12): Xaa can be any naturally occurring amino acid
  misc_feature (43)..(43): Xaa can be any naturally occurring amino acid
QSDETWKMGDIXHTLTNRRWLEKCVTYAESHDQALVGDKTIAXWLMDKDMYDFMALDRPSTPTIDRGIALHKMIKLITMGLGGEGYLNFMGNEFGHPEWIDFPRGPQRLPSGKFIPGNNNSYDKCRRRFDL

SEQ ID NO: 7040 - protein, 133 aa, Brassica napus
  misc_feature (131)..(131): Xaa can be any naturally occurring amino acid
MSVTTTVEENHRKDPSSPEKEAEKRKQRWAFWGRKWRRLDYFKLTASLFVHSMALLAPFYFSWSALWVTFLFYTIGGLGITVSYHRNLAHRSFKVPKWLEYLLAYCALLAIQGDPIDWVSTHRYHHQFTDXER

SEQ ID NO: 7041 - protein, 113 aa, Yarrowia lipolytica
MSHKQAGQPNNILFVKNLPYESTSDELYELFGRFGAVRQIRAGSEKDTRGTAFVVYEDIDDATEAVKTLSGFNYKNRYLVALFHSLEQMDKTAENLEARRAKLEELKKEHGLE

SEQ ID NO: 7042 - protein, 925 aa, Pseudomonas aeruginosa
MFKDLGIKGRVLLLTLLPTSLLAMVLGGYFTWVQLSDMRAQLIERGQLIAEQLAPLAATALARKDTAVLNRIANEALDQPDVRAVTFLDARQERLAHAGPSMLTVAPAGDASHLSMSTELDTTHFLLPVLGRHHSLSGATEPDDERVLGWVELELSHHGTLLRGYRSLFTSLLLIAAGLGVTALLALRMSRAINAPLELISQGVAQLKEGRMETRLPPMGSNELDELASGINRMAETLQSAQEEMQHNIDQATEDVRQNLETIEIQNIELDLARKEALEASRIKSEFLANMSHEIRTPLNGILGFTNLLQKSELSPRQQDYLTTIQKSAESLLGIINEILDFSKIEAGKLVLENLPFNLRDLIQDALTMLAPAAHEKQLELVSLVYRDTPIQLQGDPQRLKQILTNLVGNAIKFTQGGTVAVRAMLEDESDDRAQLRISVQDTGIGLSEEDQQALFKAFSQADNSLSRQAGGTGLGLVISKRLIEQMGGEIGVDSTPGEGAEFWISLSLPKSRDDNEEPGASWAAGQRVALLEPQELTRRSLHHQLTDFGLEVSEFADLDSLQESLRNPPPGQLPISLAVLGVSAAIHPPEELSQSFWEFERLGCKTLVLCPTTEQAQYHATLPDEQVEAKPACTRKLQRKLQELLQVRPTRSDKPHAMVSGRPPRLLCVDDNPANLLLVQTLLSDLGAQVTAVDSGYAALEVVQRERFDLVFMDVQMPGMDGRQATEAIRRWEAEREVSPVPVIALTAHALSNEKRALLQAGMDDYLTKPIDEQQLAQVVLKWTGLSLGQSLASMSRAPQLGQLSVLDPEEGLRLAAGKADLAADMLAMLLASLAADRQAIRQARDNDDRTALLERVHRLHGATRYCGVPQLRAACQTSETLLKQNDPAAAAALDELDKAIEALADTASATTHLSSTSLDSSEL

SEQ ID NO: 7043 - protein, 585 aa, Ustilago maydis
MSLSQHIDPEELIEQAADHPILGLLEHPAGKHARAYHSGAHAGRYVTEPIPKYKIPQKGTDAEATYELLSSELSLDGKPTLNLASFVHTWMPKEATKLMSETMMVNLCDQDEYPATMSFHNRAVSMLADLWKAPTEKDENGKRKPAMGVATTGSSEAIMLACLAAKKRWQHRMKAQGKSFKEPGPNMVFGSNAQVAIEKFARYFDVEERLVPVSHESRYCLDINKAIEMVDENTICVVVILGSTYTGHYEDVEGMSKLLDEYESKTGISIPIHVDGASGAMVAPFATPELKWSFEIARVASINTSGHKFGMVYPGLGWVLFRDNEQVPKELIFELHYLGSVEYSFGLNFSRPAHPVIGQLFNFINLGFEGYRRVMQSDLQNARLLSRALENSGLYQVLSEIHKPVSSPSAATGAAALIQQAGSKLTSSTQSHEQLNQHSAEMYRPGLPVVSFRWSEDFRKRNPNLEQRWMQTLLRAKGWIVPNYNLSPDLEHIDILRVVVRENLSETMIEQLVYDIITITQSLEKQANDGGFRHLAELTSSKHDDSTAAKDAEKSTGHHNAAHDKHRGGLPKDSGVQAKGYAKQC

SEQ ID NO: 7044 - protein, 448 aa, Treponema pallidum
MQTVQDVYEFLRKYYVDEVDPHILYKGALEGMINSLQDPYTTFVESDSISGVNLQDTTKGFFGGIGVVISKSRTSTPGKPAYVEVTAAIEDTPSWKGGIRPRDLIVKIGTMSTDTMTMDEVLKKLRGPIGTKVTLVVKRGTKIFRPFTLTRAKIEIPTVKYAKIDPNIAYVRLIEFNPVTATRMVETVTELRRQGCDRLILDLRNNPGGLITAAVDVTSSFIPSGTVVTTKSRVQGHSITFSVNARAQKLPPSMPVIVLINRDSASASEIVSGALKDHKRAYLVGQTTYGKGVVQQVFDLNERESLKMTISRYYTPSDANIDKSGIPPDLEVRETEFTPEEEEALVSLFKSEKVKLFAEQNRTMNSERIKQYARGLAREFKLRSILVEKLIAQEYHRHNASFVYDLEYDEQLRKAVELIRTQDIHALVARTKTVKELQEGIQEKKKVS

SEQ ID NO: 7045 - protein, 464 aa, Zea mays
MARSGREADPGEEERKLVLGKYELGRLLGQGTFAKVYYARDLSAGAGTGHSCSVAIKVIDKARLRRTEGMVEQLRREISIMRMVRHPNVVGIREVLASRSRVFVVMEYARGGELFAKVARGRLDEDHARRYFQQLVAAVGFCHRRGVAHRDLKPENLLLDEAGRLKVTDFGLAALPEQLRHDGLLHTQCGTPAYVAPEVLRKRGYDGARADLWSCGVVLYVLLCGFLPFQHDNYVKLYQKIFKADYQVPPWVSGDARRLIARLLVVDPAKRASIAEIMCTPWFRKGFVPPVLSPPVTPKKQQLDEGAALFDNDDDDNSNSNHSGATSPRSCNAFQLISSMSSGFDLSGLFESEQKTATVFTARAPAATVVEKLESVARALGFEVTRGKGWKVRMEAKAEGTNGRLAATAEVLEVAVDVTVVEFVHDAGDALDFNKFCAVDVRPGLTEIVWAWQGDSPAAAVGTA

SEQ ID NO: 7046 - protein, 443 aa, Zea mays
MHAWLPLPIIRQRGTMSWRRAAASPGGGGKAAAVRCHPVLAEERKASIRGVVGDLLAMAGGGRRSLISLGVGDASSHACFRRGGEFAAEAVAHAALSGAFDCYAPSFGFPDARRAVAAHLSTGAVHRTHEADVFMTAGGTGAITAIATVLGGAPGANVLLPRPGFAPYEAACEVAGAEPRFYDLLPRRGWEADLAGVRALADAATAALVVINPNNPCGAVYSAHHLRQLAETARELGIPIVADEVYAHMVFGGSRFVPMASLAHIAPVVSIGALSKRFMLPGWRLGWLAFCDPNGALKHVRAATEMLLNVTSGPASIVQAAVPKILSAEHHEFHRNVVHLLESAADALYRRVNQIEALRCYSKPEGSMFMMVEINTSILHGVANDMDFARELIKEECVLVLPGSVIGLKNWVRIFFGAPVSLILEACDRIEMFCRRRTLKQNN

SEQ ID NO: 7047 - protein, 365 aa, Anabaena variabilis
MSTNINLFSSYQLGELKLPNRIVMAPLTRQRAGEGNVPHQLNAIYYGQRASAGLIIAEATQVTPQGQGYPHTPGIHSPEQVAGWKLVTDTVHQQGGRIFLQLWHVGRISHPDLQPDGELPVAPSAIAPKGEVLTYEGKKPYVTPRALETSEIPGIVEQYRQGAANALAAGFDGVEIHAANGYLIDQFLRDGTNQRTDEYGGAIENRARLLLEVTEAVTSVWDSQRVGVRLSPSGTFNDIRDSHPLETFGYVAQALNRFNLSYLHIFEAIDADIRHGGTIVPTSHLRDRFTGTLIVNGGYTREKGDTVIANKAADLVAFGTLFISNPDLPERLEVNAPLNQADPTTFYGGGEKGYTDYPFLEVASK

SEQ ID NO: 7048 - protein, 549 aa, Mesorhizobium loti
MAAKDVKFSRDARERMLRGVNILADAVKVTLGPKGRNVVIDKSFGAPRITKDGVTVAKEIELEDKFENMGAQMVREVASKTNDIAGDGTTTATVLAQSIVQEGHKAVAAGMNPMDLKRGIDLAVADVVATLIKNAKKIKTSEEVAQVGTIAGNGDSSVGSMIAEAMQKVGNEGVITVEEAKTAETELEVVEGMQFDRGYLSPYFVTNADKMVADLEDAYILLHEKKLSNLQAMLPILEAVVQTSKPLVIISEDVEGEALATLVVNKLRGGLKIAAVKAPGFGDRRKAMLEDIAILTGGQVISEDLGIKLENVGLNMLGRAKKVSISKENTTIVDGAGKKAEIQGRVAQIKQQIEETTSDYDKEKLQERLAKLAGGVAVIRVGGATEVEVKEKKDRVDDALNATRAAVEEGIVPGGGVALLRASLSINAVGANSDQTAGISIVRRALQAPARQIAANAGAEASIVAGKILENKGATYGYNAQTGEYGDMIAMGIVDPVKVVRTALQDAASVAGLLVTAEAMIAEAPKKESAGGGMPGGMPGGGMGGMGGF

SEQ ID NO: 7049 - protein, 214 aa, Porphyromonas gingivalis
MTTTEVKMFTFNSVAENTYILYDSTGEAALIDCGCMDGSEEQQLLRFVQEQQLTVKLLLNTHLHFDHAWGNGFAAKTFGLPVLTHRAEVEEMPSPSKQLAAFGMFGTMDEPPIQYIAPGDVLQLGESIIKVLFVPGHSPGHLAFYCPQAQAVFTGDALFAGDMGRTDLWGGSYELLKKSIRTELLPLPDDTVVYPGHGPTSTIAYERTNNPFLD

SEQ ID NO: 7050 - protein, 253 aa, Zea mays
  misc_feature (44)..(44): Xaa can be any naturally occurring amino acid
MAAGFEALLDSTALSLALPVPVPTMTLLGLKKLNSEDYLAICLXAALAGTRGRSGLSKAAAAAAGFGRQEGGGSRKQWSCPPPAPAREEEELRFRCAVCGKAFASYQALGGHKSSHRRPPTGEQYAAALAAAQQAAGSAAGHSEETTTTSGGPHRCTICWRGFATGQALGGHKRCHYWDGSSVSVSLSATASATGTGTGSSGVTVRNFDLNLMPVPESDGMRRWVEEEEEVQSPLPIKKRRISNPSLTLATCD

SEQ ID NO: 7051 - protein, 326 aa, Saccharomyces cerevisiae
MSTDSTRYPIQIEKASNDPTLLLNHTCLRVKDPARAVKFYTEHFGMKLLSRKDFEEAKFSLYFLSFPKDDIPKNKNGEPDVFSAHGVLELTHNWGTEKNPDYKINNGNEEPHRGFGHICFSVSDINKTCEELESQGVKFKKRLSEGRQKDIAFALDPDGYWIELITYSREGQEYPKGSVGNKFNHTMIRIKNPTRSLEFYQNVLGMKLLRTSEHESAKFTLYFLGYGVPKTDSVFSCESVLELTHNWGTENDPNFHYHNGNSEPQGYGHICISCDDAGALCKEIEVKYGDKIQWSPKFNQGRMKNIAFLKDPDGYSIEVVPYGLIA

SEQ ID NO: 7052 - protein, 306 aa, Cryptococcus neoformans
MLGRVGGAKEDETWTKTVSMRMFLLLLLEDGGGRRPPRRSGARKVNDVAFANGVPIYTSRRTRSKKYLMVIPSSHCATATQPLSHTTMSLIHALIARGTTVLAEHATGTAELKPAAQITILSKIPPNNSKLTYVWQDRLIHYVSSNGVIYLVMADDSVGRRMPFAFLADLERRFTAQYESDDIVSAGAHSLEEFEPELAKLMHQYTSSPPADPLRQAQSDLNNVKDIMVQNIDSILQRGERLDLLVDKTDTLAGQAYAFRRGARSVRRQQWWKNMRIMALSGVVGLLLLYLFIAQFCGASLGHCRS

SEQ ID NO: 7053 - protein, 284 aa, Escherichia coli
AGKPTDKPNLVCGPVQISWHKFARYWDVELREIPMRPGQLFMDPKRMIEACDENTIGVVPNFGVTYTGNYEFPQPLHDALDKFQADTGIDIDMHIDAASGGFLAPFVAPDIVWDFRLPRVKSISASGHKFGLAPLGCGWVIWRDEEAVPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEM

SEQ ID NO: 7054 - protein, 130 aa, Zea mays
  misc_feature (1)..(2): Xaa can be any naturally occurring amino acid
  misc_feature (6)..(7): Xaa can be any naturally occurring amino acid
  misc_feature (43)..(43): Xaa can be any naturally occurring amino acid
XXDETXXMGDIVHTLTNRRWLEKCVTYAESHDQALVGDKTIAXWLMDKDMYDFMALDRPSTPTIDRGIALHKMIRLITMGLGGEGYLNFMGNEFGHPEWIDSPRGPQRLPSGKFIPGNNNSYDKCRRRFD

SEQ ID NO: 7055 - protein, 532 aa, Petunia integrifolia
MGNCCSRGQPNESNDHTESISTAKNGDGKVMQGGSVTPPKTPPPASPDPSSKPSKTSPIGPVLGRPMEDVRKTYSIGKELGRGQFGVTHLCTHKQSGEQFACKTIAKRKLVNKEDIEDVKREVQIMHHLTGQQNIVELKGAYEDKHSVHLVMELCAGGELFDRIIAKGHYTERAAATLLRTIVQIGHTCHSMGVIHRDLKPENFLLLNKDEDSPLKATDFGLSVFYKQGDVFKDIVGSAYYIAPEVLKRRYGPEVDIWSVGVMLYILLSGVPPFWAETEHGIFNAILRGHIDFSCDPWPAISHGAKDLVRKMLTIDPKQRLTAIQVLNHPWIKEDGDAPDTPLDNAVLSRLKQFRAMNNFKKVALRVIAGCLSEEEIMGLKQMFKSMDTDNSGAITLEELKTGLAKQGTKLSDYEIQQLMEAADADGNGTIDYEEFITATMHMNRMDKEEHLYTAFQYFDKDNSGYITVEELEQALREFGITDGKDIKDIVAEVDSNNDGRINYDEFVAMMKKGTPDTAANLKKRRESFDAK

SEQ ID NO: 7056 - protein, 447 aa, Arabidopsis thaliana
MGLPLMMERSSNNNNVELSRVAVSDTHGEDSPYFAGWKAYDENPYDESHNPSGVIQMGLAENQVSFDLLETYLEKKNPEGSMWGSKGAPGFRENALFQDYHGLKTFRQAMASFMEQIRGGKARFDPDRIVLTAGATAANELLTFILADPNDALLVPTPYYPGFDRDLRWRTGVKIVPIHCDSSNHFQITPEALESAYQTARDANIRVRGVLITNPSNPLGATVQKKVLEDLLDFCVRKNIHLVSDEIYSGSVFHASEFTSVAEIVENIDDVSVKERVHIVYSLSKDLGLPGFRVGTIYSYNDNVVRTARRMSSFTLVSSQTQHMLASMLSDEEFTEKYIRINRERLRRRYDTIVEGLKKAGIECLKGNAGLFCWMNLGFLLEKKTKDGELQLWDVILKELNLNISPGSSCHCSEVGWFRVCFANMSENTLEIALKRIHEFMDRRRRF

SEQ ID NO: 7057 - protein, 48 aa, Zea mays
QSDETWKMGDIVHTLTNRRWLEKCVTYAESHDQALVGDKTIAFWLMDK

SEQ ID NO: 7058 - protein, 208 aa, Oryza sativa
MGEYCDWRRSEAIKRQDREATNPSAIRGRRRRRRRRRRGDREMESAMFGLETPLMTALQHLLDIPDGEGGAAGKQGATGGPTRAYVRDARAMAATPADVKDLPGAYAFVVDMPGLKSSDIKVQVEEERLLVISGERRRGGGEEEKEESCKYLRMERRMGKFMRKFVLPDNADVDKISAVCQDGVLTVTVEKLPPPEPKKPKTIEVKVA

SEQ ID NO: 7059 - protein, 547 aa, Ralstonia solanacearum
MAAKDVVFGDAARAKMVEGVNILANAVKVTLGPKGRNVVLERSFGGPTVTKDGVSVAKEIELKDKLQNMGAQMVKEVASKTSDNAGDGTTTATVLAQSIVREGMKYVAAGMNPMDLKRGIDKAVAAAVEELKKISKPTTTSKEIAQVGAISANSDESIGARIAEAMDKVGKEGVITVEDGKSLEDELDVVEGMQFDRGYLSPYFINNPEKQVVQLDNPFVLLFDKKISNIRDLLPVLEQVAKAGRPLLIVAEDVEGEALATLVVNNIRGILKTAAVKAPGFGDRRKAMLEDIAILTGGQVIAEEVGLTLEKATLNDLGQAKRVEIGKENTTIIDGAGDARNIEARVKQVRAQIEEATSDYDREKLQERVAKLAGGVAVIKVGAATEVEMKEKKARVEDALHATRAAVEEGIVAGGGVALLRARALISGLKGANADQDAGIKIVLRAMEEPLRQIVTNAGDEASVVVANVIAGKGNYGYNASTGEYGDLVEMGVLDPTKVTRTALQNAASVASLMLTTDCAVAELPKDDAAPAMPGGMGGMGGMDGMM

SEQ ID NO: 7060 - protein, 471 aa, Vibrio vulnificus
MAMKLVWLRRDLRSVDNTALNHAIATSQEVVACFVATPLQWRDHHMAPMQADLIARRLAVLAEELNALNIPLLYDEVDDYAQSATRVANWAEQLAVSEVVLNREYEVNERVRDEQLVNQLASSEIGVLDVEDKCVQAPGCVLNKQGDYFKVFTPFKKAWLKSFVPPQIIKTSAAQPVVLPEALQSSLWHEQAPFSYPRQSSEEWSVDSQQIRETLRHFCHEEVDRYHEQRDFPATAGTSVLSPYLAIGAISVRQCIARLYWQQSYLSNGREVWLSELIWREFYHHLIHFEPKLVKGQGFVEWEKHLLWPAKPDWFDRWCRGETGYPIVDAAMRQLNQTGWMHNRLRMIVASFLTKDLHVNWRLGEQYFMQKLVDGDFAANNGGWQWCASTGCDGQPYFRIFNPITQGEKFDPNGEFVKHWLPELVEVPSKFVHQPWNWPGHMQLDYPAPMVDHKQEREITLSLYTQAKDCL

SEQ ID NO: 7061 - protein, 321 aa, Glycine max
PPPISSPTRPRTRGVGSLKQSLRQLETLGAQRAGLEDMLKEMKRKDDILPKLMTSTGSYDDLFKKEIAKYDHICEEIAQNIEAQEQLLLQIQAQNDEFSVIFNLIFITASREKAYKQIEAAIAKFREIKDNINEGLKFYVTLQDAITNVKQQSNDFVMTRNIQCREMIEDVQRQVAGLSFQDNKNTGGFNSNYPSVGSQNQRSPTQTDPARPQAPYYQQPVEQPPVPPYGHHPPPPYGGPAQHHQPPPPYHIPPSSTAPYPPPQVHQQPPANHEYGQPAYPGWRGPYYNAQAQQPGSVPRPPYTIPSPYPPPHQSGYYKQQ

SEQ ID NO: 7062 - protein, 102 aa, Zea mays
  misc_feature (43)..(43): Xaa can be any naturally occurring amino acid
QSDETWKMGDIVHTLTNRRWLEKCVTYAESHDQALVGDKTIAXWLMDKDMYDFMALDRPSTPTIDRGIALHKMIRLITMGLGGEGYLNFMGNEFGHPERIDF

SEQ ID NO: 7063 - protein, 335 aa, Haemophilus somnus
MKTLGQFIVEKQAEYPNAKGELSGILSSLRLVAKIIHRDINKAGLTNNIIGNSGVENVQGETQMKLDLFAHNTMKQALITREEVAGFASEEEENFVAFDTERGRNAKYVILTDPLDGSSNIDVNVAVGTIFSIYRRVSPIGTPVTLEDFLQPGHKQVAAGYIVYGSSTMLVYTTGNGVNGFTYDPSLGVFCLSHENIQIPPNGKIYSINEGQYLKFPMGVKKYIKYCQEKDKSTDRPYTSRYIGSLVSDFHRNMLKGGIYIYPSATTYPKGKLRLLYEGNPMAFLAEQAGGIASDGKDRILDIQPKELHERVPLFVGSREMVRKAEEFMREFSEE

SEQ ID NO: 7064 - protein, 687 aa, Burkholderia fungorum
MRYPNLFKPLTLNKLTLRNRIVSTAHAEVYAEPGGLPGDRYIRYYEEKAKGGVGLAVCGGSSPVSIDSPQGWWKSVNLATDRIIDPLARLAEAMHTHGARIMIQATHMGRRSAFHGEHWPHLMSPSGVREPVHRGNAKIIEVEEIRRIISDFAAAAKRVKDAGMDGVEISAAHQHLIDQFWSPRTNFRTDEWGGSLENRLRFGTEVLKAVREAVGADFCVGLRMCGDEFHEDGLDHEQLKEIAQAMSETGLIDYLGVIGSGADTHNTLANCMPPMALPPEPFVHLAAGIKSVVKLPVMHAQSIRDAGQAERLLASGMVDLVGMTRAQIADPHMVIKIRDGREDEIKQCVGANYCIDRQYNGLDVLCVQNAATSREATMPHVIARTRGPKRKVVVVGAGPAGLEAARVAKSRGHDVVLFEKNDYVGGQIMLAAKAPQREQMAGIVRWFDMETKRLGVDRRLGVAADEKTIMAEKPDIVVLATGGSSFTSQVAAWGVEEGLAVSSWDVLSGKVEPGRNVLVYDGVSTHAGAGVADFMSSRGSNVEIVTPDVKVADDVGGTTFPIFYRRLYAQGVIHTPNYWLDKVYEEDGKKIAVLRNEYTEEQEERAVDQVVIENGSTPNDELYWKLKPESVNRGQVDVHKLFASEPQPSLSEEPGNGRFLLFRVGDCISMHNIHGAIYDALRLCKDF

SEQ ID NO: 7065 - protein, 545 aa, Prunus dulcis
NYAAKDIKFGVEARALMLKGVEELADAVKVTMGPKGRNVVLEQSFGAPKVTKDGVTVAKSIEFRDKVKNIGASLVKQVANATNDAAGDGTTCATVLTRAIFTEGCKSVAAGMNAMDLRRGISMAVDSVVTNLKSRARMISTSEEIAQVGTISANGEREIGELIAKAMEKVGKEGVITIADGKTLYNELEVVEGMKLDRGYISPYFITNPKNQKCELEDPLVLIHEKKISNLNSIVKILELALKKQRPLLIVAEDVESEALATLIINKLRAGIKVCAIKAPGFGENRKANLQDLAILTGGEVITEELGLNLDKVGVETLGTCKRVTISKDDTVILDGAGDKKAIEERCEQLRSSIELSTSDYDKEKLQERLAKISGGVAVLKIGGASEAEVSEKKDRVTDALNATKAAVEEGIVPGGGAALLYASKELDKLATANFDQKIGVQIIQNALKMPVSTIASNAGVEGAVVVGKLLEQDNPDLGYDAAKGEYVDMIKAGIIDPLKVIRTALVDAASVSSLMTTTEAVVVELPKDEKETPGMGGGMGGMDY

SEQ ID NO: 7066 - protein, 215 aa, Escherichia coli
MNYRIIPVTAFSQNCSLIWCEQTRLAALVDPGGDAEKIKQEVDASGLTLMQILLTHGHLDHVGAAAELAQHYGVPVFGPEKEDEFWLQGLPAQSRMFGLEECQPLTPDRWLNEGDTISIGNVTLQVLHCPGHTPGHVVFFDDRAKLLISGDVIFKGGVGRSDFPRGDHNQLISSIKDKLLPLGDDVTFIPGHGPLSTLGYERLHNPFLQDEMPVW

SEQ ID NO: 7067 - protein, 404 aa, Emericella nidulans
MASQVQPGQKPKVQPCRYKTGKTLGAGLYSVVKECVHIDTGQYYAAKVINKRLMVGREHMVRNEIAILKQVSTGHQNILTLVDYFETMNNLYLVTDLALGGELFDRICRKGSYYESDAADLVRAILSAVAYLHDHGIVHRDLKPENLLFRTPEDNADLLIADFGLSRIMDEEQLHVLTTTCGTPGYMAPEIFDKSGHGKPVDIWAIGLITYFMLCGYTPFDRETNLEEVQAIATANFSFTPVEYWRGVSQEARDFIKRCLTVNPKKRMTAHQALQHPWINPPYDTTDDLGSGEDLLPNIKKNFNARRTLHKAIDTVRAINKLRENGGLMMDGIMSVDPKPEHVNGSEVVEDRTTPRERENEDAMEIDSRSNARGQTEQQIREQERKVKETVAGLWSRTAPRSER

SEQ ID NO: 7068 - protein, 148 aa, Triticum aestivum
  misc_feature (131)..(131): Xaa can be any naturally occurring amino acid
DQAMNALEEEFSFLSSSKQIVSDMNEKDKVIVFERGDLVFVFNFHPNKTYKGYKVGCDLPGKYRVALDSDALVFGGHGRVGHDVDHFTSPEGMPGVPETNFNNRPNSFKVLSPPRTCVAYYRVDEDREELXRGGAVASGKIVTEYIDV

SEQ ID NO: 7069 - protein, 547 aa, Bordetella pertussis
MAAKQVLFADEARVRIVRGVNVLANAVKTTLGPKGRNVVLERSFGAPTVTKDGVSVAKEIELKDKFENIGAQLVKDVASKTSDNAGDGTTTATVLAQAVVQEGLKYVAAGFNPIDLKRGIDKAVAAAVEELKKLSKPVTTSKEIAQVGSISANSDASIGQIIADAMDKVGKEGVITVEDGKSLENELDVVEGMQFDRGYLSPYFINSPEKQVAALDDPYVLIYDKKVSNIRDLLPVLEQVAKSSRPLLIIAEDVEGEALATLVVNNIRGILKTTAVKAPGFGDRRKAMLEDIAILTGGTVISEETGMSLEKATLQDLGQAKRIEVAKENTTIIDGAGDGKSIEARVKQIRAQIEEATSDYDREKLQERVAKLAGGVAVIRVGAATEVEMKEKKARVEDALHATRAAVEEGVVPGGGVALLRAKQAITGLKGDTADQNAGIKLILRAVEEPLRTIVTNAGDEASVVVNTVLNGKGNYGYNAATGEYGDLVEQGVLDPTKVTRTALQNAASVASLLLTAEAAVVELMENKPAAAPAMPGGMGGMGGMDF

SEQ ID NO: 7070 - protein, 642 aa, Streptococcus pneumoniae
MDNREALKTFMTGENFYLQHYLGAHREELNGEHGYTFRVWAPNAQAVHLVGDFTNWIENQIPMVRNDFGVWEVFTNMAQEGHIYKYHVTRQNGHQLMKIDPFAVRYEARPGTGAIVTELPEKKWKDGLWLARRKRWGFEERPVNIYEVHAGSWKRNSDGSPYSFAQLKDELIPYLVEMNYTHIEFMPLMSHPLGLSWGYQLMGYFALEHAYGRPEEFQDFVEECHTHNIGVIVDWVPGHFTINDDALAYYDGTPTFEYQDHNKAHNHGWGALNFDLGKNEVQSFLISCIKHWIDVYHLDGIRVDAVSNMLYLDYDDAPWTPNKDGGNLNYEGYYFLQRLNEVIKLEYPDVMMIAEESSSAIKITGMKEIGGLGFDYKWNMGWMNDILRFYEEDPIYRKYDFNLVTFSFMYVFKENYLLPFSHDEVVHGKKSMMHKMWGDRYNQFAGLRNLYTYQICHPGKKLLFMGSEYGQFLEWKSEEQLEWSNLEDPMNAKMKYFASQLNQFYKDHRCLWEIDTSYDGIEIIDADNRDQSVLSFIRKGKKGEMLVCIFNMVPVERKDFTIGLPVAGIYEEVWNTELEEWGGVWKEHNQTVQTQEGLWKDYEQTLTFTLPAMGASVWKIKRRLKSTKTVTNKNQKGVENEK

SEQ ID NO: 7071 - protein, 202 aa, Arabidopsis thaliana
  misc_feature (76)..(76): Xaa can be any naturally occurring amino acid
  misc_feature (83)..(83): Xaa can be any naturally occurring amino acid
  misc_feature (144)..(144): Xaa can be any naturally occurring amino acid
  misc_feature (180)..(180): Xaa can be any naturally occurring amino acid
MDPYKRTTSSEYIAPFYTTNGGAAVYNNMFSLTMGERGPDLIEDHHSIENVAHLTRDRIPERVVHAERRSVLMGWXEVTHDMXNLTRGDSLRAAGVRTSGIGQFSTDGHERARTETMRDMRGFAAKLYTREGNWGLGGNNTGVXFIRDAIQGPDGVHPLNPNPKTDIQEDWKCLAYMVHXAWKIVTWRWPYDEVATYTDTGP

SEQ ID NO: 7072 - protein, 544 aa, Neisseria gonorrhoeae
MAAKDVQFGNEVRQKMVNGVNILANAVRVTLGPKGRNVVVDRAFGGPHITKDGVTVAKEIELKDKFENMGAQMVKEVASKTNDVAGDGTTTATVLAQSIVAEGMKYVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGILKTVAVKAPGFGDRRKAMLQDIAILTGGVVISEEVGLSLEKATLDDLGQAKRIEIGKENTTVIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIGMGVLDPAKVTRSALQHAASIAGLMLTTDCMIAEIPEEKPAVPDMGGMGGMGGMM

SEQ ID NO: 7073 - protein, 580 aa, Rhodospirillum rubrum
MVTKLGRSVPEGLADRFAQKLAHRGPDGKGVFEAPGVLLVQARLAIIDLLTGDQPLHGPDGLVLVANGEVYNYRELRAELGEGVFLTRSDCEPPLHLYARRGLAGFDVLRGMYAIALWDPPRRRLVLCRDPFGIKPLYYVETNDGVAFASEPQALIGAGLLPAREDAAAVDELLQLQFTCGARTIFQGIRRVLPGETLVFEDAQLVERHRRPALPAVRERVSPADPLALLDHVLEDSLDLHQRADVPYGLFLSGGIDSSSVLAMMARLNERPVLAFTAGFPGTEVADERADARAATRAVGARHVEVAVSEGDFLEHLPAIAAAVDDPVADYAIVPTWLLAREAAKSVKVVLCGEGGDELLGGYGRYRSAMRPWPLARPLRRKGLLDGLGLLRGGGGRNWRAGIARAEVEARAQGGSRLIRAQRVDCADWLPHDLLNKLDRCLMAHGLEGRVPFVDVDVARFCLPLADGLKVRDGMGKWILRSWLERTLPEARPFAPKRGFSVPVGEWMSRHGDRLGPLVAASPAVAARCHGEAVRALFTHPRKETALAAWILLYYALWHRRHIVGLAPEGDVFHCLSTAA

SEQ ID NO: 7074 - protein, 650 aa, Dechloromonas aromatica
MCGVIGFIRTDFSRTYAADSRRQLELMADAVVHRGPDDAGYWGDESHGIWLGHRRLSILDLSPAGHQPMSSACGRYIVVFNGEVYNWASIRTELEQSGRAPVWRGHSDTEVLLAGLVAWGLEATLKRARGMFAIAVWDRQQRVLSLARDRIGEKPLYYGRVGDTFVFASELKSLRAIPGADFQTDPGSLALMLRYGYVPAPLCIYRNIFKLPPGTLLRVNARGEFGEPEAWWSFAETAQQRVAGRSPMSDAAALDALDEVLGAAIGEQMVADVPLGALLSGGLDSSMVVALMQARSTKPVRTFTIGFAEGAYDEAAHAKVVAAHLGTEHTELYVSPDQARAIIPSLPDMYDEPFADSSQIPTALVCALTRQHVTVCLSGDAGDELFGGYNRYFWATSLWRRFGKMPLGLRKGAAGIFSSVSAGTWNSAFGALSWAMPGRLRVSNPGDKLHKLAEVMAAESEEALYRELVSQWRGPLPMRSPNEPRTLVPDPARWPRMPSYAERMMAVDTLTYLPDDILVKVDRAAMAASLETRVPFLDERVISFAWGLPFEQKVRNGQGKWLLRQLLYRYVPQAMVDRPKQGFGVPIEHWLRGPLRDWAEDLLSPDQLASDGLLDPTPIRAMWEKHLSGRNVQYALWNVLMYQAWRRRWA

SEQ ID NO: 7075 - protein, 374 aa, Unknown
  Vibrio sp. Ex25
MKQRPNKLFEPAQLKALSLQNRIVMAPMTRARTTQPGNIPNEMMATYYQQRASAGLIISEATQISDDSQGYSFTPGVYTDAQVAGWQGVTQAVKSQGAAMFCQLWHVGRVSHPTFQNGEQPIAPSALAPVETQVWIADEQGNGNMVDCVEPRAMTQADINRVVGDFANAAKRAIESGFDGVEIHGGNGYLIDQFLRTNSNHRTDNYGGPRENRIRFLIEVVDAVIAAVGAHRVGVRLAPFITFKDMDCPDIVPTILEASKQLQERDIAYLHLSEADWADAPTIPEAFRVELRKRFRNAIIVAGRYDPQRANEVLEKGYADLVAFGRPFVANPDLVSRLQHHHPLAELDGSTLFGGNERGYTDYPALQQKCAEQA

SEQ ID NO: 7076 - protein, 1358 aa, Oryza sativa
MGEAAAVVAVNGERYEAVGVDPSMTLLEFLRTRTPFRGPKLGCGEGGCGACAVVVSKYDAAADEVTSFSASSCLTLLGSLHHCAVTTSEGIGNSRDGFHPVQRRLAGFHASQCGFCTPGMCVSIFSALANADRAASAAPPPPPTPPGFSRLTAADAERAVSGNLCRCTGYRPILDACKSFAADVDLEDLGLNSFWKKGERADITKLPAYSCTADVATFPEFLKSEIRSSGGAPAVAVTGDGCWFHPRSIEEFHRLFECNLFDEMSVKIVASNTGSGVYKDQDLHDKYINISQIPELSAINRSSNGIEIGAAVSISKAIEILRSDGGDAVVFRKIAYHLGKVASPFVRNTATIGGNIIMAQRMSFPSDIATVLLAAGSTVTIQQVASKRMCLTLEEFLKQPPCDSRTLLISISIPDWCSYDGITFETFRAAPRPFGNAVSYVNSAFLARSSLDAASGSHLIEDVRLAFGAFGSEHAIRASKVEEFLKGKLVSASVILEAVRLLKGVVSPAEGTTHPEYRVSLAVSYLFRFLSSLANGLDDKPENANNVPNGSCTTNGTTNGSAESTVDSFDLPIKSRQEMVFSDEYKPVGKPIKKVGAELQASGEAVYVDDIPAPKDCLYGAFIYSTHPHAHIKGVNFRSSLASQKVITVITAKDIPTGGENVGSCFPMLGDEALFADPVAEFAGQNIGVVIAETQKYAYMAARQAVIEYNTENLQPPILTVEDAVQHNSYFQVPPFLQPKPIGDFNQAMSEADHKIIDGEVKLGSQYYFYMETQTALAFPDEDNCITVYCSAQMPEVTQDIVARCLGVPFHNVRIITRRVGGGFGGKAMKATHVATACAVAAFKLRRPVRMYLDRKTDMIMAGGRHPMKAKYSVGFKSDGKITALHLDLKINAGISPEFSPAIPYAIVGALKKYSWGALAFDIKVCKTNVSSKSAMRAPGDAQGSFIAEAIVEHVASTLSVATNTIRRKNLHDLESLKVFFGDSAAGEASTSSYSLVIIFDRLASTPEYQRRAAMVEQFNGSSRWKKRGISCVPITYSVTLRPSPGKVSILNDGSIAVEVGGVEIGQGLWTKVKQMTAFALGQLCDDGGEGLLDNVRVIQADTLSMIQGGWTAGSTTSETSCEAVRKSCAALVERLKPIKEKAGTLPWKSFIAQASMASVKLTEHAYWTPDPTFTSYMNYGAATSEVEVDVLTGATTILRSDLVYDCGQSLNPAVDLGQVEGAFVQGVGFFTNEEYATNADGLVIHDGTWTYKIPTVDTIPKQFNVELINTARHHSRVLSSKASGEPPLLLASSVHCAMREAIRAARREFAAVGGGTGGSDQVTSFQMDVPATMPAVKELCGLDVVERYLESFSATTA

SEQ ID NO: 7077 - protein, 462 aa, Glycine max
MESKPHVLMHRYELGRLLGQGTFGKVYYARSTITNQSVAIKVIDKDKVMKTGQAEQIKREISVMRLARHPNIIQLFEVLANKNKIYFVIECAKGGELFNKVAKGKLKEDVAHKYFKQLINAVDYCHSRGVYHRDIKPENILLDENGNLKVSDFGLSALVDSKRQDGLLHTPCGTPAYVAPEVIKRKGYDGTKADIWSCGIVLFVLLAGYLPFHDPNLIEMYRKISKAELKCPNWFPPEVCELLGMMLNPNPETRIPISTIRENSWFKKGQNIKNKRPVVENNTVSSSSTVLLDQNDCDGLAAEANGESVVPLSINAFDIISRSVGFDLSRFFDESFKKKEARFSSRLPANVIISKLEDIANQLRMKIKKKAAGLLKLESLNEGRKGVLSIDAEIFEVTPCFHMVEVKKSNGDTLEYQKILKEDIRPALQDIVWVWQSDQQLQSQQSEQQQQTDDQQQQQPQS

SEQ ID NO: 7078 - protein, 683 aa, Unknown
  Shewanella sp. MR-7
MRKLTLATSIATVFVGFSAWAVPPTIQISELPTLKQEAQHKVASKRVTDLYTRSHYHRFALDDAFSAQIFDRYLQQLDYRRNVLTQADVDSFKPYINQFDDMLSSGELEPAYKMFDLVQKRRYEGFVYALSLLDKEMDFTVPGDAYEYDREDVAWPKDQAEINELWRQRVKYDALNLKLTGKKWPEIVDILQKRYNNAIKRLTQTNSEDVFQAVMNAFSRSIEPHTSYLSPRNAERFQMEMNLSLEGIGAQLQLEDDYTVIKSLIAGGPAASSEKLSPEDKIVGVGQEGGEIVDVIGWRLDDVVDLIKGPKGSKVVLQILPKKGGSNAKPFNLTLVRDKIRLEDRAATSKIIEPKDGEYANRKVGVIQIPGFYMNLSQDVEKELVKLNEAKVEGVVIDLRGNGGGALTEAVLLTGLFIDMGPVVQVRDADGRVSAHRDNDGKTTYAGPLTIMVDRYSASASEIFAAALQDYDRALIVGESSFGKGTVQQHKSLGRIYDMYEKPIGHVQYTIQKFYRINGGSTQLKGVTPNIAYPSALEPGEYGEAEEKNALPWDKVPMAQYGTLNDITPELVASLDKKHLARIQNNVEFNYINQDIADFKKHHKEKTVSLVESERIASREADEKKVLDRTNERRVAHGLAAVKSMEDIKDKDDVEAPDAFLDETAYITLDMADAKKLANAGTK

SEQ ID NO: 7079 - protein, 813 aa, Aspergillus nidulans
MAIPRPSTPPEAPLEVTEISERSQSSRWLSRDDRIRILTLRDAGFTYQQISSQLGFTYRQVQYTCQNEQSTPRKPPGQRPKLSEEDMDNIITFISSSQRTRRLSYKRVIEELNLPCGETALARALKKRGYSRCKALRKPPLSDDTKRVRLAWALEHVNWTIEQWNRILWSDETWVTPGFHTRIWVTRRAGEELDETCIRLSTPKKRGWMFWGSFYGDTKGPCLFWEKEWGSINVESYCERIVPIIDGYLRLNRQQGNYLCLMHDGAPGHASKDTIAELHERSIYPISWPAFSPDLNPIEMVWNWMKDWIQERYPDDRQLSYDALREINPKESYPYSPVLPSDFLWGFATASYQIEGAVDEDGRGPSIWDTFCKKPGKIAGGANGDVACDSYHRTHEDIDLLKQCQAKAYRFSISWSRVIPLGGRNDPINEKGLQFYVKFVDDLLAAGITPLVTLFHWDLPEELDKRYGGLLNKEEFVADYANYARIIFNALSPKVKYWITFNEPWCSSVLGYNVGQFAPGRTSDRSKNPEGDGSTEPWIVGHNILVAHGTAVKIYREEFKARDGGEIGITLNGDWAEPWDPENPADVEAAPRKIEFAISWFADPIYFGRYPESMIKQLGNRLPEWTPEEVALVKGSNDFYGMNHYCANFIRAKTSEPDPTDVAGNLELLLQNKAGEWVGPETQSPWLRPSPTGFRKLLKWLSDRYNRPKIYVTENGTSLKGENDLPLEQLLKDDFRVKYFEDYIHAMAEAYTYDNVNVRAYMAWSLMDNFEWAEGYETRFGVTYVDYENNQKRYPKASAKAMSEIFAKYIQNE

SEQ ID NO: 7080 - protein, 205 aa, Lycium barbarum
GAILDERVFHNDYVNLAHSIGAFLYDDLLAIVSLRYQRIHILQIRDSGDLVDVRAIGEFCREDDELFLNFNSQVLVNHVGNGFHHSMPELETSFMSGIKQRLLSFIFRGIWNEETDQTMRVQCLKKKFYFHFQDYIDLIIWKVQFLDRHHLLIKFGSVDGGVSRNADSHPSFFAVYNMETTEIVAFYQNSADELYFLFELFSDHF

SEQ ID NO: 7081 - protein, 165 aa, Populus alba
LTKKFINLIKHAEDGILDLNKAAETLEVQKRRIYDITNVLEGIGLIEKKLKNRIQWKGLDVSRPGEADDNNVATLQAEVENLTMEERRLDEQTREMQERLRDLSEDENNQKWLFVTEEDIKSLPGFQNETLIAIKAPHGTTLEVPDPDEAVDYPQRRYRILLRST

SEQ ID NO: 7082 - protein, 367 aa, Anabaena variabilis
MLPRKLDPTNSSHKKVHNMAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPVGRYTLLYDPIDGSSNTDTNLSLGSIFSIRQQEGDDSDGQAKDLLTNGRKQIAAGYILYGPSTMLVYTMGKGVHSFTLDPSLGEFILSEENIRIPDHGAVYSVNEGNFWQWEESMREYIRYVHRTEGYTARYSGAMVSDIHRILVQGGVFLYPGTVQNPEGKLRLLYESAPLAFLIQQAGGRATTGLVDILDVVPKKLHQRTPLIIGSKEDVAKVESFIQNGH

SEQ ID NO: 7083 - protein, 369 aa, Burkholderia vietnamiensis
MSALFEPFKLKDVTLRNRIAVPPMCQYVAEEGVVNDWHHVHLAGIARGGAGLVIAEATAVAPEGRITPGCAGLWTDAQAEAFAPSVAAIKAAGAVPGIQIAHAGRKASANRPWEGDDHIAEGDPCGWQTIAPSAIPFGAHLPKMPRAMTHDDIARVQADFVASAQRARDLGFEWLELHFAHGYLGQSFFSVHSNQRDDEYGGSAENRGRFLVDTLKAVRRVWPEHLPLTARLGVIEYDGRDEETLAESIALVQRMKQEGLDMLSVSVGFSTPDAQIPWGPAFLAPIAQRVRRETGLPVSSAWGIDTPQLANRVVAEQQLDLVMVGRAHLADPHWPYYAAKQLGVERPSWTLPAPYAHWLERYRVADKVA

SEQ ID NO: 7084 - protein, 158 aa, Triticum aestivum
MSLIRRSNVFDPFSLDFFDPFDGFPFGSGSSNSGGSLVPRTSSDTAAFAGARIDWKETPEAHVFKADVPGLKKEEVKVEVEDGNILQISGERNKEQEEKTDTWHRVERSSGKFLRRFRLPENAKAEQVKASMENGVLTVTVPKEEAKKPDVKSIQISG

SEQ ID NO: 7085 - protein, 304 aa, Chlamydomonas reinhardtii
MDIAQVDEIIERLLDVRNGRPGKQVQLAENEIRLLCLTAKEIFMSQPNLLELEAPIKICGDIHGQYSDLLRLFEYGGFPPEANYLFLGDYVDRGKQSLETICLLLSFKIKYPENFFLLRGNHECASINRIYGFYDECKRRYNIRLWRTFTDCFNCLPVAALIDEKILCMHGGLSPELKSLEQIKRITRPTDVPDSGLLCDLLWADPDKDIQGWGENDRGVSYTFGPDCVTEFLQKHDLDLVCRAHQVVEEGYEFFAKRQLVTIFSAPNYCGEFENAGAMMSVDETLMCSFQILKPAETKAKGRR

SEQ ID NO: 7086 - protein, 449 aa, Magnetospirillum magnetotacticum
MIRKILIAAGTFALLSTTALTPVSAAERKETYKLLDLFGEVLEKVRSEYVEPVNDEDLIEAALNGMLASLDPHSSYLNPKNSKDMDIQTRGEFGGLGLEVTMENGWVKVVSPIDDTPAYRAGMQPGDFVTHLDGEQVQGLSLSEAVDRMRGTVNTDIKLTVRRAGVEQPFDIKLTRAVIKVQTVKGQTHGDIGYIRISQFSATTHADLVRIMAQLKKDIGKTPTGFVIDLRNNPGGLLDQAVAVSDDFLDKGEIVSTRSRRPEDTQRFNARPGDIADGLPLVVLINDGSASASEIVAGALQDHKRAVLLGTRSFGKGSVQTLMPLHGHGSLRLTTARYYTPSGRSIQAVGIEPDIKAAQSKVEPVAGAVVERRSEASLRKALPNPNGEKAKPAEKEKAEETKAPEQPKGEGGKAEAPAPIKLGDPAQDYQLARALDLLRGLSLYRPAQR

SEQ ID NO: 7087 - protein, 743 aa, Magnaporthe grisea
MASLKDIGDTLSKGKSYVMHSQGDKISDLARNTVTPDEKGRQTTDAGVRITNPDDWLRVTSNDQIGPSLLEDQIAREKIHRFDHERIPERVVHARGTAAHGKFTLHKSIEHLTTAGVLTDTSRETPVFLRFSTVLGSRGSADTVRDVRGFAVKFYTPEGNWDIVGNNIPVFFIQDSMKFPDVIHAGKPEPDNEVPQAQSAHNNFWDFMYQHSEATHMFMWAMSDRTIPRSYRMMQGFGVNTYTLINAKGERHFVKFHFTPELGVHSLVWDEALKLAGQDPDFHRKDLMEAIANGAFPRWKFGVQVLPESREHEFDFDILDATKVWPEDLIPVDYIGTLELNRNIDEFFPETEQVAYCTSHVVPGIGFSDDPLLQGRNFSYFDTQISRLGINWEELPINRPVCPVLSFNRDGQSRHTITKGKVNYWPNRFGVNAPADGVKEGGYVEHATKVQGIKARTKSAKFLDHISQAQLFFNSMSDVEKRHMLAAFSFELDHCEEEVVYNNLVSRLTQIDIGLAQQVAEMVGAQIPDKATKENKGIKAKGLSQFDFLPENPTIASRKVAILIADGYDSVQFRAVKAALSAAQAIPLVIAPRRSPIYAAGETKGSSGAGLKPDHHLEGFRSTMVDAVYVPGGAESIKTLSKNGRALHYVREAFGHLKAIGASGEGVELVKLAVTLPEVTVSSADVMESYGVVTVRNVQADSLKEVVDLAKGGKDFLDQFFHSIAMHRNWAREADGLNSQVAY

SEQ ID NO: 7088 - protein, 243 aa, Lotus corniculatus
MGRGRVELKRIENKINRQVTFAKRRNGLLKKAYELSVLCDAEVALIIFSNRGKLYEFCSSSSMLKTLERYQKCNYGAPEANVSTREALELSSQQEYLKLKARYEALQRSQRNLMGEDLGPLNSKELESLERQLDSSLKQIRSTRTQFMLDQLSDLQRKEHMLSEANRSLRQRQLEGYQLNSLQLNPGVEDMGYGRHPAQTHGDAFYHSIECEPTLQIGYQPDPVSVVTAGPSMNNNYMAGWLP

SEQ ID NO: 7089 - protein, 437 aa, Unknown
  Malus x domestica
MATAVSTIGSVNRAPPNLNGSSSSASVPSSTFLGSSLKKVNSRFTNSKVSSGSLRIVASVDEDKQTDKDRWKGLAFDTSDDQQDITRGKGKVDSLFQAPQGSGTHFAIMSSYEYISTGLRQYNFDNNMDGYYIAPAFMDKLVVHITKNFMTLPNMKVPLILGIWGGKGQGKSFQCELVFAKMRISPIMMSAGELESGNAGEPAKLIRQRYREAADIIRKGKMCALFINDLDAGAGRLGGTTQYTVNNQMVNATLMNIADNPTNVQLPGMYNKEENPRVPIIVTGNDFSTLYAPLIRDGRMEKFYWAPTREDRIGVCIGIFRSDNVAKEDIVKLVDTFPGQSIDFFGALRARVYDDEVRKWITGVGVDSIGKKLVNSKEGPPTFEQPKMTIEKLLEYGNMLVQEQENVKRVQLADKYLSEAALGDANSDAMNTGTFYG

SEQ ID NO: 7090 - protein, 583 aa, Pseudomonas aeruginosa
MAIRRRFGAQFQGNGRTCFGLWAPDAREVRVETADGRDWPLEGSDSGWFEATLPCPPGTRYRYRIDGRPGVPDPASQFQPDGVHGHSQVLDHDAYAWRVDEWRGRPWHEAVIYELHVGLFGSYAEVEGFLPRLVELGVTAVELMPLGEFPGRRNWGYDGVLPFAPASAYGTPEQLKHLIDSAHGMGLMVFVDVIYNHFGPDGNYLAQYAAAFFRDDRQTPWGQAIDFRRGEVREFFYENALMWLLDYRVDGLRFDAVHAIPDSAFLVEMARRLRGAAGPERHVHLVLENDDNRASLLRQGYDAQWNDDGHHALHVLLTGESDGYYQDYPEPLRCLARCLAEGFVYQGEANRHGRPRGEPSADLAPDAFVLFLQNHDQVGNRAFGERLSVLAEPQALRLAIALQLLAPMIPLLFMGEECAAREPFLYFTDHQGELADAVREGRRKEFGEFGRFGEGATLASLPDPNAVEAFERSRPGLADCDPAWRGFYRQLLEIRHEHLIPRLRGARSLGVTTIAGAALSARWRLGDGSDWRIDFNPSPLEAEVEPPAAATQVLFLDNLACAEYRRGRLSPRSIAVSLEPAHE

SEQ ID NO: 7091 - protein, 136 aa, Triticum aestivum
  misc_feature (100)..(100): Xaa can be any naturally occurring amino acid
  misc_feature (124)..(124): Xaa can be any naturally occurring amino acid
KNKPKPPIIVTRDSPNALHSHVLEVAAGADVVDCVAEYARRRGRGVCVLSGGGAVVNVALRQPGASPPGSMVATLRGRFEILSLTGTVLPPPAPPGASGXTVFLSGGQGQSSAGALVGPLVAAXPSPDGASRTRVR

SEQ ID NO: 7092 - protein, 638 aa, Desulfovibrio desulfuricans
MATPVESGTVPCSLEPFDVYLFGRGEHWDIYRVLGAHAHAQDGETGYRFAVWAPNAHAVSLVGPFNDWRSGDFPLFPVGTSGIWAGFVAGMEYGRLYKFAVQGADGTVRLKTDPYALYCEMRPGTASFTWSLDSYAWNDAAWMQRRREAGPPLQQPVSIYELHAGSWMRRHGEGHPFVNWDELAGTLIPYVRDAGFTHIELMPVAEHPLDQSWGYQTGAYYAPTSRFGTPDDLRRFVDLCHQQGIGVILDWVPAHFPKDDWSLGRFDGTALYEHLDPRLGEHPDWGTYVFNYGRHEVRNFLFANALYWFKEFHVDGLRIDAVASMLYLDYSRKEGEWLPNVHGGNENLEAIDFLRELNRVVHEQYPGVMMIAEESTSWPGVSRPLYTGGLGFTFKWNMGWMHDTLNYMRQDPVFRAYQHSSLTFSMLYAFSENFVLPLSHDEVVHGKGALLSKMPGDMWQQQANLRLMYAYMWAHPGKKLLFMGGEIGQWNEWSESREPDWCLREFPAHEGIRNLVRDLNGIYAQEPAMHRHDHDWSGFRWLDFSDYGCSVISFARFAEDSPPVMWVFNFTPVVRRWYRVPCPRAGEWQEVLNTDSGYYGGSNVGNGGGAVACTDNWHGGHFMELTLPPLAAVALKPV

SEQ ID NO: 7093 - protein, 363 aa, Triticum aestivum
MGLAENHLSLDLVREWMEEHAGPAMTPARGDEERDLTISGLATYQPYDGILALKMALAGFMRQIMHESVSFDPSQMVITSGATPAMEILSSCIADPGNAFLVPSPYYPGWDRDIKWRTGIELIPVPCRSTDNFNISITALEIAYNQAKKRGVRVRGVLISNPSNPTGSFVPKQTLRDLLDFATEKNIHLISDEVFAGSTFGSGEFVSVAEVVNELEDFDRGRVHIIYGLSKDLSLAGFRVGVIYSYNESIVEAAAKIARFSSVSTPTQRLLVAMLSDQKFISNYLKVNRERLRKAYNLLVDALKQVGIECFKSSGGFYCWADMSKFIRSYSEKGERRLWDRLLEEAKVNVTPGSSCHCIEPGW

SEQ ID NO: 7094 - protein, 541 aa, Unknown
  Frankia sp. CcI3
MPKIIAYEEEARRGLERGMNQLAGAVKVTLGPKGRNVVLEKKWGVPAITNDGVSIAREIELEDPYEKIGAEMVKEVAKKTDEVAGDGTTTATVLAEALVHEGLRNVAAGANPIALKRGIELAVERVCGELANLSRELETKDQIASTASISAGGDTAIGQIIAEAMDKVGRDGVITVEESNTFGLELELTEGMRFDKGYISPYFITDQERMECVLEDPYILVANIKISLVKDLLPLLEKVMQAGRPLLVIAENVEGEALATLVVNKIRGTFRSVAVKAPGFGERRKAMLGDIAVLTGSQVISEEVGLRLENADLDLLGRARKVVVTKDDTTIIEGAGDPGRIAGRVSQIRSEIEKSDSDYDREKLQERLARLAGGVAVIKAGAATEVELKERKHRIEDAVRNAKAAVEEGIVPGGGVALLLASGAVFDGLEVAEDERTGAEMVRRALTEPLRQIAVNAGLEGGVVVEKVRNLQPGWGLDAATGEHVNMLEAGIIDPTKVTRSALQNAASIAGLFLTTEAVVAEKPEEKETAAAPAGGGGLEY

SEQ ID NO: 7095 - protein, 225 aa, Zea mays
MDGGFPALLDPTALSLALPVTQGPQGLNKLSKDDYLAICLAALAGTRGSGLVVKAAAGFGRKETGGINKQSWCPPQPAPAAHEEALRLRFRCAVCGKAFPSYQALGGHKSSHRKPPTAEQQAVVSAADSEDETTTSSGGGPHRCTICRRGFATGQALGGHKRCHYWDGASASVSLSASGTGSSGVTLRNFDLNLMPVAENAGMKRWVEEEEVQSPLPIKKRRILD

SEQ ID NO: 7096 - protein, 525 aa, Ralstonia eutropha
MLGYRPANLHQGTMQGADTPAHARPPYRIDHQFDRGLVWFRRDLRSTDHAALHYALKHCREVWCVFVFDRDILDPLLARGLKGDRRVDFIRASLIELDATLRAAGGGLIVMNDSAASAIPALARELGVQAVFANHDYEPDAVARDAAVRDSLAGDARVLFTFKDQVIFERDEILTSQGKPFAVFTPYKNAWLKTIQPFDLRPYPIEPYLHALAPLPSKRLVPLPSLEDLGFAPSNLAEVAMPTGSSGGQALFEEFTSRMGDYGRRRDYPALRGPSYLSVHLRFGTVSIRTLARAAHGAVLRGGADSAGAATWLSELVWRDFYFMILHHHPRVAAGEAFHPAYDIIRWRDGETGDRYFESWRDAATGYPLVDAAMLQIRQSGYMHNRLRMVTASFLVKDLGVDWRRGEHYFADQLNDFDFAANNGGWQWAASTGCDAQPWFRIFNPVTQSEKFDPQGRFIRKYLPQLAALPDKYVHAPWTAPQDVLLAAGVRLGENYPRPLVQHDVARKETLERYAVVKEWRRPEG

SEQ ID NO: 7097 - protein, 444 aa, Campylobacter jejuni
MMELILKTKRFFAGLAGFATTFILCLFLTSHLQAKVDQKEEQVQKRLEALDKLTKTLAIVEQYYVDDQNISDLVDKSLSGLLSNLDAHSSFLNEKDFNDMKIQTNGEFGGLGITVGMKDGALTVVSPIEGTPADKAGIKSGDIILKINDEATLGINLNDAVDKMRGKPKTQITLTIFRKGATKPFDVTLTREIIKIESVYAKMIENENILYLRVTNFDKNVVDVASKELKKYPNVKGVILDLRNNPGGLLNQAIGLVNLFVDKGVIVSQKGRIASENQEYKADPKNKISNASLVVLVNGGSASASEIVSGALQDLKRGVIVGENTFGKGSVQQIIPINKTEALRLTIARYYLPSGRTIQAVGVKPDIEVFPGKVNTQEDGFSIKESDLKQHLESELEKIDKNKKEDKQENKDNKNLISQKQINDDAQLKSAIDTIKILNIKQGQ

SEQ ID NO: 7098 - protein, 162 aa, Triticum aestivum
MAGMVFGLENPMMTALQHLLDIPDGEAGGAGPAAGEKQGPTRAYVRDARAMAATPADVKELPGAYAFVVDMPGLGSGDIKVQVEDERVLVISGERRREEKEDAKYLRMERRMGKLMRKYVLPENADMEKISAVCRDGVLTVTVEKLPPPEPKKPKTIQVQVA

SEQ ID NO: 7099 - protein, 375 aa, Pisum sativum
MGSNRTIVWFRRDLRIEDNPALAAAARDGSVFPVFIWCPKEEGQFYPGRVSRWWLKQSLAHLDQSLKSLGAKLVLIKTDSTLNALLECVNAIQATKVVFNHLYDPVSLVRDHNIKEKLVELGISVKSYNGDLLYEPWELYDEKGHAFTTFDPFWERCLHKQMEPVSLIPPWQLIPAKGKVERCSIEDLGLENELEKPSNALLGRAWSPGWGNANKALTEFMDKQLLNYSKNRQKVGGDSTSLLSPYLHFGELSVRKVFQMARVKQISWGNEGNSVGKESVTLFLRAIGLREYSRYLCFNFPFTHERALLGHLSFFPWNADPSNFKTWRQGRTGYPLVDAGMRELWATGWMHNRIRVIVSSFAVKMLLLPWKWGMK

SEQ ID NO: 7100 - protein, 250 aa, Solanum tuberosum
MGRGRVQLKRIENKINRQVTFSKRRSGLLKKAHEISVLCDAEVGLIVFSTKGKLFEYANDSCMERLLERYERYSFAERQLVPTDHTSPGSWTLEHAKLKARLEVLQRNQKHYVGEDLESLNMKELQNLEHQLDSALKHIRSRKNQLMHESISVLQKQDRALQEQNNQLSKKVKEREKEVAQQNQWDQQNHEINSSTFVLPQQLDSPHLGEAYQNTNVVDNGEVEGGNSSQQQGAANNTVMPQWMLRHLNG

SEQ ID NO: 7101 - protein, 1081 aa, Candida albicans
MNPTKKPRLSPMQPSVFEILNDPELYSQHCHSLRETLLDHFNHQATLIDTYEHELEKSKNANKAFQQALSEIGTVVISVAMGDLSKKVEIHTVENDPEILKVKITINTMMDQLQTFANEVTKVATEVANGELGGQAKNDGSVGIWRSLTDNVNIMALNLTNQVREIADVTRAVAKGDLSRKINVHAQGEILQLQRTINTMVDQLRTFAFEVSKVARDVGVLGILGGQALIENVEGIWEELTDNVNAMALNLTTQVRNIANVTTAVAKGDLSKKVTADCKGEILDLKLTINQMVDRLQNFALAVTTLSREVGTLGILGGQANVQDVEGAWKQVTENVNLMATNLTNQVRSIATVTTAVAHGDLSQKIDVHAQGEILQLKNTINKMVDSLQLFASEVSKVAQDVGINGKLGIQAQVSDVDGLWKEITSNVNTMASNLTSQVRAFAQITAAATDGDFTRFITVEASGEMDALKTKINQMVFNLRESLQRNTAAREAAELANSAKSEFLANMSHEIRTPLNGIIGMTQLSLDTELTQYQREMLSIVHNLANSLLTIIDDILDISKIEANRMTVEQIDFSLRGTVFGALKTLAVKAIEKNLDLTYQCDSSFPDNLIGDSFRLRQVILNLAGNAIKFTKEGKVSVSVKKSDKMVLDSKLLLEVCVSDTGIGIEKDKLGLIFDTFCQADGSTTRKFGGTGLGLSISKQLIHLMGGEIWVTSEYGSGSNFYFTVCVSPSNIRYTRQTEQLLPFSSHYVLFVSTEHTQEELDVLRDGIIELGLIPIIVRNIEDATLTEPVKYDIIMIDSIEIAKKLRLLSEVKYIPLVLVHHSIPQLNMRVCIDLGISSYANTPCSITDLASAIIPALESRSISQNSDESVRYKILLAEDNLVNQKLAVRILEKQGHSVEVVENGLEAYEAIKRNKYDVVLMDVQMPVMGGFEATEKIRQWEKKSNPIDSLTFRTPIIALTAHAMLGDREKSLAKGMDDYVSKPLKPKLLMQTINKCIHNINQLKELSRNSRGSDFAKKMTRNTPGSTTRQGSDEGSVEDMIGDTPRQGSVEGGGTSSRPVQRRSATEGSITTISEQIDR

SEQ ID NO: 7102 - protein, 655 aa, Ustilago maydis
MTPKRKGADARTSRMHDEDDKVLDPKLAEHADEDECETSKPRLAKRQKRSTHSLRSAVVAGGAKVDKQYGSSAYAKSGQGWHRSDFNPNARGRTDSKTPLNQLEEALNAHAPNKANDANDGKNVVYWMRMHDLRIHDNRALAHASSLAAARRKNGKGGHLIALFVITPADYSAHDRGARRIDFVLRTLASLKSQFDKLDIPFVVYTYSGEDRAQVGEKVFSLCEQCDASQLTANIEYEVDELWRDLAMLEAKDKKGVSFSLLHDCYVVPPGRIKTNDGRPYSVFSPWNRRWTESISKDMSLIEASEDPEANPKSIRSHPKLGALFELSKLGTGYGIPEELSGFECKDREYMAKLWPATDQAAHQVLDNFIKGKGGETALDRAANEPSTAEVGANAKDSRLARYAEGRNLLSENGTSRISPYLAAGVVSARECLRRTKQLTKGKLHVGRDSGVAMWNTEISFRDFYAHVLAAWPKVCMGHAFITKYEDVVWETDSSTLDAWKQGRTGYPIVDAAQRQCIQQGYIHNRGRMISAMFLTKHLLHDWRHGERHFSLNFIDQDFASNNGGWQWSASTGTDPQPYFRIFNPLSQSEKCDPHGDYIRHFVPELKNVKGNAIHDPFHRLSKAEFEKLGYPKPIVEHAQARQRALKRYKNPGDQ

SEQ ID NO: 7103 - protein, 206 aa, Unknown
  Malus x domestica
HGSDVAVKILMEQDFHAERFKEFLSEVTIMKRLRHPNIVLFMGAVTKPPNLSIVTEYLSRGSLYRLLHKAGAREALDERRRLSMAYDVAKGMNYLHRRKPPIVHRDLKSPNLLVDKKYTVKVCDFGLSRLKANTFLSSKSAAGTPEWMAPEVLRDEPSNEKSDIYSFGVILWELATMQQPWGNLNPAQVVAAVGFKNKRLEIPRDL

SEQ ID NO: 7104 - protein, 588 aa, Zea mays
  misc_feature (173)..(173): Xaa can be any naturally occurring amino acid
  misc_feature (299)..(299): Xaa can be any naturally occurring amino acid
  misc_feature (559)..(559): Xaa can be any naturally occurring amino acid
  misc_feature (572)..(572): Xaa can be any naturally occurring amino acid
MCGILAVLGCSDWSQAKRARILACSRRLKHRGPDWSGLYQHEGNFLAQQRLAVVSPLSGDQPLFNEDRTVVVVANGEIYNHKNVRKQFTGTHNFSTGSDCEVIMPLYEKYGENFVDMLDGVFAFVLYDTRDRTYVAARDAIGVNPLYIGWGSDGSVWIASEMKALNEDCVRFXSSPPGHLYSSAGGGFRRWYTPHWFQEQVPRTPYQPLVLREAFEKAVIKRLMTDVPFGVLLSGGLDSSLVASVTKRHLVETEAAEKFGTELHSFVVGLEGSPDLKAAREVADYLGTIHHEFHFTVQXGIDAIEEVIYHDETYDVTTIRASTPMFLMARKIKSLGVKMVLSGEGSDELLGGYLYFHFAPNKEEFHRETCRKVKALHQYDCLRANKATSAWGLEVRVPFLDKEFINVAMGMDPEWKMYDKNLGRIEKWVMRKAFDDDEHPYLPKHILYRQKEQFSDGVGYNWIDGLKSFTEQQVTDEMMNNAAQMFPYNTPVNKEAYYYRMIFERLFPQDSARETVPWGPSIACSTPAAIEWVEQWKASNDPSGRFISSHDSAATDHTXAVSRRWPTAAATXANGTVNGKDVAVAIAV

SEQ ID NO: 7105 - protein, 161 aa, Arabidopsis thaliana
MSLIPSIFGGRRSNVFDPFSQDVWDPFEGFFTPSSALANASTARDVAAFTNARVDWKETPEAHVFKADLPGLKKEEVKVEVEDKNVLQISGERSKENEEKNDKWHRVERASGKFMRRFRLPENAKMEEVKATMENGVLTVVVPKAPEKKPQVKSIDISGAN

SEQ ID NO: 7106 - protein, 219 aa, Zea mays
MALDAALDVCSKTPSPSPPTVDSSARGGRRSKRRAGSPASDGGGGVDGNDQPEQEEYLAQCLLMLSHGLPGDGAAPPSAAAKAKAIQQQHQHGRYECSVCGKVYTSYQALGGHKTSHRKPPVVAPAPAPAPGGEADASLSGGTAHAAAEKEKTHRCSVCKRTFQSGQALGGHKRLHYEAKAKDADAVAATAVLQNLDLNLPAEGAPPEPKRARTMLLLA

SEQ ID NO: 7107 - protein, 248 aa, Lotus corniculatus
GRGKMEIKRIENTTNRQVTFCKRRNGLLKKAYELSVLCDAEVALIVFSSRGRLYEYANNSVKATIDRYKKACSDSSGAGSASEANAQFYQQEADKLRVQISNLQNNNRQMMSESLGSMNAKELKNLETKLEKGISRIRSKKNELLFAEIEYMQKREIDLHNNNQLLRAKIAESERNHPNLSILAGSTSNYESMQSQQQQQQQQFDSRGYFQVTGLQPTTHTQYSRQDQISLQPSSQYARQDHMSLQLV

SEQ ID NO: 7108 - protein, 229 aa, Lotus corniculatus
GRGKMEIKRIENTTNRQVTFCKRRNGLLKKAYELSVLCDAEVALIVFSNRGRLYEYANNSVKASIERYKKACSDSSGGGSTSGANAQFYQQEAAKLRVQISNLQNHNRQMLGEALSNMNARDLKNLETKLEKGISRIRSKKNEMLFAEIEYMQKREIDLHNSNQLLRAKIAESDERKNHNFNMLPGTTNFESLQQSQQPFDSRGSFQVTGLQPNNNQCARQDQISLQFV

SEQ ID NO: 7109 - protein, 228 aa, Lotus corniculatus
GRGKMEIKRIENTTNRQVTFCKRRNGLLKKAYELSVLCDAEVALIVSSSRGRLYEYANNSVRGTIDRYKKACAASSNTESVSEANTQFYQQEASKLRRQIRDIQNLNRHILGEALGNLSLKELKNLEGRLEKGLSRVRSRKHETLFADVEFMKKREIELQNHNNYLRAKIAEHERAQQQQQQQQQQQQNLMLSESLPSQSYDRNLFPANLLGSDNQYSRQDQTALQLV

SEQ ID NO: 7110 - protein, 223 aa, Lotus corniculatus
MGRGKIEIKRIENTTNRQVTFCKRRNGLLKKAYELSVLCDAEVALIVFSSRGRLYEYSNNNIRSTIERYKKACSDHSSTSTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGQELNAIQALASRNFFNPPMIEDGTSYPQQPDKKILHLG

SEQ ID NO: 7111 - protein, 597 aa, Pisum sativum
MGMNRTIVWFRRDLRIEDNPALAAAARDGSVFPVFIWCPKEEGQFYPGRVSRWWMKQSLVHLDQSLKSLGAGLVIIKTDSTLKALLECVNAVQATKVVFNHLYDPVSLVRDHNIKEKLVEQGVSVQSYNGDLLYEPWEIFDESGHAFTTFDPFWNTCLHMQMKTYSPIPPCQLILAQGKVEKHSIEQLGLEDELEKSSNSSLGRSWSPGWSKSDKALAEFIENYLLHYSGNRLNLGGDSTSLLSPYIHFGELSVRKVFQLARTKQILWTHEGNIIGEESATLFLRAIGFREYSRYLCFSFPFTLERPLLGNLKFFPWNNDPSNFKAWRQGRTGYPLVDAGMRELWATGWIHNKMRVIVSSFAVKMLLIPWKWGMKYFWDTLLDADLESDILGWQYISGSLPDGHKLERLDDPEVLGRKYDPAGEYIRQWLPELARMPAEWIHHPWDAPLTVLTASGVELGQNYPKPIIDIDLAREQLTQAIFKMWETEAATKASSSQDRQVVDENEKLLIPKVFLKDKVPRGATSANDQTVPILQNLKSDDPPNKRQKCTAEEDRKPDKSRNRSDHTEVSCIDQEDCSTAESSSKRQCSSTSSFSVP

SEQ ID NO: 7112 - protein, 1430 aa, Cryptococcus neoformans
MVPPARAHTHNTTNTKQAQLSSAYHELANELGTDNISVVGNYTLGRVIGQGTYGSVHLATHRLTGTRAAVKKVPKSFTPHLTRELHHHRRLHHPHIVHLHEIIATESHIWLVTELCSGGELFDYLVERGRILEGEARRLFGELTLAVGWLHMHGVVHRDLKLENVLLDGELRIKLGDLGFAREWQKGRLMDTYCGTTGYASPEMLACQKYLGVETDIWSLGIILYTLLCGGLPFDDDDERVMKELIQKGEYEEPDWLSQEARDLIRGMLQHDPSKRLSIREILTHPWFKMTIVDKVYPNGDVPSIPPSPNPTSPTAAGDDFFAESALRQQQQQQSRLTPHVAGRSPLSTHLPTTPRQNSGSSEAENGDSRTERKASNMQRLNSAEFSTTEKELEQLHLCTSRPAATATGSGAISPRSISSPSMRGKTLRTLPEGQVDVDETPAGLPPPLSLIDEHPHLPVALHSRTPSRTKRRSVSSTLSLERRLSHHSSHNSYITFPPEDYLSKLDPSLLPNPDSSSSSTTTPPARSFTTPSETRLLRQLDDLGLDVGQLKHSVETDACDASAGLWWLLRQKQEERGETDEVVRRREKEVVRREEKVAEYAKEERRKAREAERERERIPTSPMGILGTRPGKRDSIEKSSEGLRFKEEQPPSIPTTPSYTSVIDLGPPVLPVDVDVDVERTAVGRDAPREAAGEEMKSWKRVESPQSVAISSQSSLDPAPTLPPPAAAGGGGAAGAKTQKEDGRDQAGLDPVAVATPMSNANSSTGASTVAKPEPNVNASANANTSANPRLKAKSPSMNMLQRATSVLGGVGKKGDDKDKDKNGMNEKREESTNDSLHPKRGGSSSPNKLKKPMPAGMKGLTSTLSRSESESEGLLAGGGGGGGGGDSPAVSASGSKTVTPGSSPRRKGLTPQGTPRGGLRDAGAKDSSGERASGNGNGNAGGGNEKGKGGKKDSLWTTFRHLFYEDRRRRKRESVTPSASSPLLLPPSDIKLPAGAVVLSRGANSRTSQFKRSNVGYAPSTGSRRTSLDGNRPVYSRRSSSVHTTSRRSSVGSLHFQDHQAMISDLSRRASQRSHGSQTPTSDREYLDYPSAAAPISRPGSSHSIRGGVGGGSRRSSFSVRSPSLHPETFSASAGGPTSTRFKSSVPPPASPLLGYRRRPAGGNDSSRVRHIKVIPESQIMRSSSVASSIRSNASSRASSMDRDRDRDRESEYESGRDDVSLRSGKRQKRRSGSQRSLAQQIHRTRSPLALSLENTYGSNSVANVGLGIGGASRIPKKPLRDVFQKKGKRKDGGDDDWVSEDEDGFACGLGQGRGIAKSFSNANANGTVWMNVNAKTNPARSAAAFPTSKMVAQPTAQGGTSRRRERGRRSSLEEERGRPQEGKGKAKGETVAQGLMGIESLSGRSRRNLPDRSTAPGIIEEEEEDEE

SEQ ID NO: 7113 - protein, 869 aa, Arabidopsis thaliana
MVSLSNQTRFSFHPNNLVVSEKRRLGISGVNFPRKIKLKITCFAAERPRQEKQKKKSQSQSTSDAEAGVDPVGFLTRLGIADRIFAQFLRERHKALKDLKDEIFKRHFDFRDFASGFELLGMHRHMEHRVDFMDWGPGSRYGAIIGDFNGWSPTENAAREGLFGHDDYGYWFIILEDKLREGEEPDELYFQQYNYVDDYDKGDSGVSAEEIFQKANDEYWEPGEDRFIKNRFEVPAKLYEQMFGPNSPQTLEELGDIPDAETRYKQWKEEHKDDPPSNLPPCDIIDKGQGKPYDIFNVVTSPEWTKKFYEKEPPIPYWLETRKGRKAWLQKYIPAVPHGSKYRLYFNTPDGPLERVPAWATYVQPEDEGKQAYAIHWEPSPEAAYKWKYSKPKVPESLRIYECHVGISGSEPKVSTFEEFTKKVTNFFAASSRYGTPDDFKRLVDEAHGLGLLVFLDIVHSYAAADQMVGLSLFDGSNDCYFHYGKRGHHKHWGTRMFKYGDLDVLHFLISNLNWWITEYQVDGYQFHSLASMIYTHNGFASFNNDLDDYCNQYVDRDALMYLILANEILHVQHPNIITIAEDATYYPGLCEPVSQGGLGFDYYVNLSASEMWVSLLDNVPDNEWSMSKIVSTLVANKEYADKMLSYAENHNQSISGGRSFAEILFGGVDNGSPGGKELLDRGISLHKMIRLITFTSGGRAYLNFMGNEFGHPERVEFPTQSNNFSFSLANRRWDLLESGVHHHLFSFDKELMDLDKSKGILSRGLPSIHHVNDANMVISFSRGPFLFIFNFHPSNSYEKYDVGVEEAGEYTMILNSDEVKYGGQGIVTEDHYLQRSISKRIDGQRNCLEVFLPSRTAQVYKLTRILRI

SEQ ID NO: 7114 - protein, 1165 aa, Arabidopsis halleri
  misc_feature (585)..(585): Xaa can be any naturally occurring amino acid
MVSGGGSKTSGAEAASSGHRVNRSRHTSAEQAQSSASKAQRSQNQQPQNHGAGTESTSKAIQQYTVDARLHAVFEQSGESGKSFDYSQSLKTAPYDPSVPEQQITAYLSRIQRGGYTQPFGCLIAVEESTFTIIGYSENAREMLGLMSQSVPSIEEISEVLTIGTDLRSLFKSSSIVLLERAFVAREITLLNPIWIHSKNTGKPFYAILHRVDVGILIDLEPARTEDPALSIAGAVQSQKLAVRAISHLQSLPGGDIKLLCDTVVDSVRDLTGYDRVMVYKFHEDEHGEVVAESKRDDLEPYIGLHYPATDIPQASRFLFKQNRVRMIVDCYASPVRVVQDDRLTQSICLVGSTLRAPHGCHAQYMTNMGSIASLAMAIIINGNEEDGNGVNTGGRNSMRLWGLVVCHHTSARCIPFPLRCACEFLMQAFGLQLNMELQLALQVSEKRVLRMQTLLCDMLLRDSPTGIVTQRPSIMDLVKCNGAAFLYQGKYYSLGVAPTEAQINDIVEWLLANHSDSTGLSTDSLGDAGYPRAAALGDAVCGMAVACITKRDFLFWFRSHTEKEIKWGGAKHHPEDKDDGQRMXPRASFQAFLEVVKSRCQPWETAEMDAIHSLQLILRDSFKESEAMDSKASAPGGVQPHGDDMAEQGLQEIGTVAREMIRLIETATVPIFAVDIDGCINGWNAKIAELTGLSVEEAMGKSLVRDLIYKEYEETADRLLSCALKGDEGKNVEVKLKTFAPELQGKAVFVVVNACSSKDYLNNIVGVCFVGQDVTGHKIVMDKFINIQGDYKAIIHSPNPLIPPIFAADENTCCIEWNTAMEKLTGWPRSEVIGKLLVREVFGSCCRLKGPDALTKFMIVLHNAIGGQETDKFPFPFFDREGKFIQALLTLNKRVSVDGKIIGAFCFLQIPSPELQQALEVQRRQESEYFSRRKELAYIFQFIKNPLSGLRFTNSLLEATDLNEDQKQLLETSVSCEKQISKIVGEMDVISIGDGSFLLERTEFFIGSVINAVVSQVIFVVRERNIQLIRNIPAEIKSMAVYGDQIRLQQVLAEFLLSIVRYAPLEGSVELHLCPVLKQMADGFSAIRLEFRMACAGEGVPPEKVQDMFHSSRWTSPEGLGLSVCRKILKLMNGGVQYIREFERSYFLIVIELPVPLMMMMPSS

SEQ ID NO: 7115 - protein, 189 aa, Arabidopsis thaliana
MVHSKKFRGVRQRQWGSWVSEIRHPLLKRRVWLGTFDTAETAARAYDQAAVLMNGQSAKTNFPVIKSNGSNSLEINSALRSPKSLSELLNAKLRKNCKDQTPYLTCLRLDNDSSHIGVWQKRAGSKTSPNWVKLVELGDKVNARPGGDIETNKMKVRNEDVQEDDQMAMQMIEELLNWTCPGSGSIAQV

SEQ ID NO: 7116 - protein, 190 aa, Cryptococcus neoformans
MPNGLPEHNGAPPPPMNNSSIINGNSEWKLCIRDQKEARLIFPRFPEEFKYMTLDISDHPDQNLITIFPTCRDFVEEALSTGGTVLAHCNGGIALSPAIVVGYLMWKFNWTAEHALAHVQNKRYCVSTMSFQNQFKEYEPIYMAQKMVETAAKRETTTSKRQVEEEDEEGDGYRRKQRYVQGEASDMMLD

SEQ ID NO: 7117 - protein, 1045 aa, Cleome hassleriana
GESGKSFDYSRSLKTTTYGSSVPEKQITAYLSKIQRGGYIQPFGCMIAVDESTFKIISYSENAREMLGLMPQSVPSIEKPEILAIGTDVRSLFTPSSTVLLERAFVAREITLLNPVWIHSKNTGKPFYAILHRIDVGIVIDLEPARTEDPALSIAGAVQSQKLAVRAISQLQSLPGGDIKLLCDTVVESVRDLTGYDRVMVYKFHEDEHGEVVAESKRADLEPYIGLHYPATDIPQASRFLFKQNRVRMIVDCHATPVCVIQDERLTQPLCLVGSTLRAPHGCHAQYMANMGSLASLAMAVIINGNEEEAGSVAGGRNSMRLWGLVVCHHTSARCIPFPLRYACEFLMQAFGLQLNMELQLALQMSEKRVLRTQTLLCDMLLRDSPTGIVTQKPSIMDLVKCDGAAFLYQGRYYPLGVAPSEAQIKDIVEWLLANHGDSTGLSTDSLADAGYPGAATLGDAVCGMAVAYITRKDFLFWFRSHTAKEIKWGGAKHHPEDKDDSQRMHPRSSFKAFLEVVKSRSLPWENAEMDAIHSLQLILRDSFKESETVNTRVAVRADQPGGDMAVQGLDELSAVAREMVRLIETATVPILAVDVEGRINGWNGKIAELTGLSVEEAMGKSLVRDLIYKEYEETVEKLLSHALRGEEDKNVEIKMKTFSRELEGQAVFVVVNACSSKDYLNNIVGVCFVGQDVTGQKIVMDKFIHIQGDYKAIVHSPNPLIPPIFAADENTCCLEWNTAMEKLTGWSRAEVIGKMLVGEVFGSCCRLKGPDTLTKFMIVLHNAIGGEETDKFSFPFFDRNGKFVQALLTANKRVSIDGKITGAFCFMQIPSPELQQALAVQRQQETECISRAKELAYICQVIKNPLSGLRFTNLLLEATGLSEDQKQLLETSVSCEKQISRIIGDMNLETIEDGLVEVEKEEFIMGSVINAVVSQVMMLVRERGLQLIRDIPEEIKTMAVYGDQMRIQQVLAEFLLSIIKYAPSQGWVEIHLNPILKHLPDGSSSLRSEFRMACGGEGLPPELVRDMFHGSRWTTPEGLGLSVC

SEQ ID NO: 7118 - protein, 481 aa, Methylobacillus flagellatus
MTKSLVWFRRDLRDYDHAALYHALKDSEQVVCAFVFDTDILDGLPRDDRRVEFIWESVRELKLALQERGGDLLVRHGKATEEIPALASVLGVECVYCNRDYEPAAVKRDDTVSQQLGTQGIAFKSFKDQVIFERDEIMTKSGTPFSVFTPYKNACLRKLDDFHLKAYPVDRYIHHLAQSAPQPMPSLESLAFARSNLKQLRLPTGMSGGMALFEDFSERMPRYRDARDFPALKGPSYLSVHLRFGTVSIRHLARTAWQQGGAGAETWLNELLWRDFYFQVLYHHPQVAEGHSFKPEFEHIPFPNGESLFKAWCEGRTGYPLVDAAMRQINQTGYMHNRLRMVAAGFLVKDLLIDWRWGERYFAEKLIDFDLAANNGGWQWAASTGCDAQPWFRIFNPVTQSEKFDPEGKFIRKYVPELQPCDDKEIHAPWLIPPLRQQALGLVIGKDYPAPVVDHAMRREQVLSLYRQASSRKKWPASSVL

SEQ ID NO: 7119 - protein, 350 aa, Haloarcula marismortui
MLQRAEPQDFERVLSSMCTVPHPSAREAAERFLATNPGDPGTYETIAGLEREAVEYLGDITGLSDPAGYVASGGTEANLQAIRIARNRADTDDPNVVAPVHAHFSFTKAADVLGVELRTAPAADYRVNMAAMAELVDEDTVCVVGVAGSTEYGYVDPIPAIADLAETVDALCHVDAAWGGFYLPFTDHDWHFGHADIDTMTIDPHKVGQAAVPAGGLLARDRTLLDELAVETPYLESTDQLTLTGTRSGAGVASAVAAMESLWPAGYRQQYETSMANADWLADQLSARGHDVVGPELPLVAADLSMPMTDELRDRGWRVSKTGAGEMRVVCMPHVTRSMLRSFVADLDWY

SEQ ID NO: 7120 - protein, 604 aa, Neurospora crassa
MSLSRHVDPEEIIHHLKDIKLQEKGSGSQRQNHLTPYNSSYASQEDIPKYKIPENGTPGDTVYAMLRDELDLDGRPNLNMASFVNTYIEKDAQKLFVENLGKNLSDNDEYPAMISFSDRCVSILAHLWGVQKGEKAIGTATVGSSEAVHLGGLAMKRRWQEKRRAEGKDAYKPNIIMGANAQVALEKFARYFDVEARILPVSAQSNYCLDPALVKENLDENTIGVFVILGSTYTGHYEPVEEIHKILDDFESQTGIDIPIHVDAASGGFVAPFTYAKTGGHKWNFELPRVKSINVSGHKYGLVTPGVGWIVWRDESFLPKHLIFELHYLGGTEYSYTLNFSRPGAQVIVQYYNLIHLGFQGYRAVVENCLSNARLLSKALEATGWYTCVSDIHRPPQKQAGSVKSGSSGYDGENDQSCCSESQNDDQKAESEESKTHASSSSLSSSKDTPETDRNREETSADYTPGLPVVSFRFTDEFQQEYPHVKQETVSLLMRARQWIIPNYALPPNEDQTEILRVVIRESFSFDLIDRLVTDLVSVTETLMENDEVDLSLLQQHQGGRRRPLTKDEKRIEKEEREREERKGEERGEEKGKRMGEGIHRSVC

SEQ ID NO: 7121 - protein, 684 aa, Ustilago maydis
MSKHVRVLYWFRTDLRLHDSPALQAALDLKPAALFPVWCWDPNYVYKHRVGVNRFRFLLESMIALSKNITSTQSNSQLLVVRGEPTELLPELWKRWSITHLVFEKDPSAYGRRRDQLILEAAEKSNVKVVAVQGHHLYDPEQVVNKNKGKPTMSMSTLQKIVADMGDVPKPIDAPEDLPLPTLKDSKSKSLQDTLPELARSLEGLPYYTGKGREGPESIDLNSTELGGQRDKKVSCYDTVQGEASELFSAPTLASLGMDASKVKDTIKGGEPIALEKLANICKDAKYVATFAKPKTSPGQSAEDPSTTLLSPYLKFGCLSVRKLWWDAEEAKNRYKGGSKTGPPENLNGQLLFRDMYACAEYAIGDAFGRVRGNEVCRYMDWYLPTHYDENGEVVLPRPAGDAVSEARLSAYKLGQTGFPWIDALMRQLRLEGWMHHLGRHSVAAFLTRGQCWISWERGAEIFDEYLIDWDPCSNPGNWMWLSCSAFFTQYFRLYGLATFPAKYDKTGALVRKYCPELAKFPDKYIYEPFNAPKEVQQKAGCIIGKDYPLPMLDEKEAKAENMARMKICYQANLYGTSKEVLEGKADEMLRKKHGFKDAPKEFDWNNRPGAKIPKWARAPHGEEHTTKGAPGHEDGPPLTKEEGESGDDSDDVVYKQEDEQKEERTSKKRKAAAKVEGTSKKKE

SEQ ID NO: 7122 - protein, 477 aa, Listeria monocytogenes
MTESKFPKDFLWGGAVAANQCEGAYLEDGKGLSLVDILPTVEDGRWEALFNPAKALATDYGFYPSHESIDFYHRYKEDIKLMAEMGFKCFRMSISWPRIFPNGDETTPNEKGLAFYDAVFDECHKYGIEPVVTINHFDTPLEVFKKYGGWKNRKCIDFYLNFCEAIFTRYKDKVKYWMTFNEINMILHLPYIGGGLDVTKEDNPEEVKYQAAHHQLVASALATKLGHEINPENQIGCMLAAGNTYPMTCNPKDVWKSIEADREGYFFIDVQARGYYPSYTKRFFKEHNINIKMEDGDLDALRDHTVDYVAFSYYSSRLTSADPEKNKETEGNVFATLKNPYLKASEWGWQIDPLGLRITMNTIYDRYQKPLFIVENGLGAVDTVAEDGSITDDYRIDYMREHVREMGEAIEDGVELLGYTPWGCIDLVSAGSGEMKKRYGFIYVDRDNKGNGTLNRSKKKSFDWYKKVIETNGKDID

SEQ ID NO: 7123 - protein, 202 aa, Leptospira interrogans
MVRRYGCTVYSHPGGIGKIPHATHPVQKGDKILSSAKEYLEILDTPGHTFCHVCILLVENQKPTAIFTGDTLFNAGVGNCLRGGDPTILAKTILEQFYPLEEEILLYPGHDYLETNLKFTLSLNPSNQDAIDALEECSRLPKNIEFLTTNLGKERRINTFLQCDHPSSELLKNVSIKISPKRLLDQNPTELFILIRSLRDKW

SEQ ID NO: 7124 - protein, 506 aa, Bartonella henselae
MVIDKSFGAPRITKDGVSVAKEIELEDKFENMGAQMLREVASKTNDIAGDGTTTATVLGQAIVQEGVKAVAAGMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKSEINARVNQIKVQIEETTSDYDREKLQERLAKLAGGVAVIRVGGATEVEVKEKKDRVDDALNATRAAVEEGIVAGGGTALLRAANALTVKGSNPDQEAGINIVRRALQAPARQIATNAGEEAAIIVGKVLENNADTFGYNTATGEFGDLIALGIVDPVKVVRSALQNAASIASLLITTEAMVAEVPKKDTPVPPMPGGGMGGMG

SEQ ID NO: 7125 - protein, 753 aa, Escherichia coli
MSQQNEKNPHQHQSPLHDSSEAKPGMDSLAPEDGSHRPAAEPTPPGAQPTASGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKVADQGEEGIVEADSADGSFMDELLTLMAAHRVWSRIPKIDKIPA

SEQ ID NO: 7126 - protein, 124 aa, Glycine max
MGSEGPRAITIHVTGFKKFQGVPENPTEAIVNNLKEYVERRGLPAGVTLGSCTVLDVAGDGALPQLYQTMESAISKTDSVSNANVVWLHLGVNSGAVRFAIEHQAANEATFRCPDELGWQPQQL

SEQ ID NO: 7127 - protein, 418 aa, Zea mays
MAPTAHHQAARDDELEKSRRKPGGGGKAAAVRCHPVLAEERKASIRGVVGDLLAMAGGGRRSLISLGVGDASSHACFRRGGEFAAEAVAHARLVRRLRLLCAVLRLPRRPPDLELEPRGFLRSHAYHPSRHGCSLSLLHACCCAVCRAEPTDQTNSAVAAHLSTGAVHRTHEADVFMTAGGTGAITAIATVLGGAPGANVLLPRPGFAPYEAACERRGWEADLAGVRALADAATAALVVINPNNPCGAVYSAHHLRQLAETARELGIPIVADEVYAHMVFGGSRFVPMASLAHIAPVVSIGALSKRFMLPGWRLGWLAFCDPNGALKHVRAATEMLLNVTSGPASIVQAAVPKILSAEHHEFHRNVVHLLESAADALYRRVNQIEALRCYSKPEGSMFMMVEINTSILHGVANDMDFA

SEQ ID NO: 7128 - protein, 466 aa, Lactococcus lactis
MLYGKENRDEAEFLEPIFGSESEQVDLPKYKLAQQSIEPRVAYQLVQDEMLDEGNARLNLATFCQTYMEPEAVKLMSQTLEKNAIDKSEYPRTTEIENRCVNMIADLWNASEKEKFMGTSTIGSSEACMLGGMAMKFSWRKRAEKLGLDINAKKPNLVISSGYQVCWEKFCIYWDIEMREVPMDKEHMSINLDKVMDYVDEYTIGVVGIMGITYTGRYDDIKALDNLIEEYNKQTDYKVYIHVDAASGGLYAPFVEPELEWDFRLKNVISINTSGHKYGLVYPGVGWVLWRDKKYLPEELIFKVSYLGGELPTMAINFSHSASQLIGQYYNFVRYGFDGYKAIHERTHKVAMFLAKEIEKTGMFEIMNDGSQLPIVCYKLKEDSNRGWNLYDLADRLLMKGWQVPAYPLPKNLENEIIQRLVIRADFGMNMAFNYVQDMQEAIEALNKAHILYHEEPENKTYGFTH

SEQ ID NO: 7129 - protein, 99 aa, Chenopodium rubrum
LGTPNVGEKKECPHSLLPMRKAFDGTFIAAGGYDREDGNKAVMKSYTDLVAYGRLFLANPDLPRRFELDAPLNKYHRDTFYISDPIVGYTDYPFLEDAM

SEQ ID NO: 7130 - protein, 373 aa, Glycine max
MSAVESAEHNNIRGVPTHGGRYVQYNIYGNLFEVSRKYVPPIRPVGRGAYGIVCAAVNAETGEEVAIKKIGNAFDNRIDAKRTLREIKLLRHMDHANIMSIKDIIRPPQKENFNDVYLVSELMDTDLHQIIRSNQQLTDDHCRYFLYQLLRGLKYVHSANVLHRDLKPSNLLLNANCDLKIADFGLARTTSETDFMTEYVVTRWYRAPELLLNCSEYTAAIDIWSVGCILGEIITRQPLFPGKDYVHQLRLITELIGSPDDASLGFLRSDNARRYVKQLPQYPKQNFSARFPTMSPGAVDLLEKMLIFDPNRRITVDEALSHPYMSPLHDINEEPVCTRPFSFDFEQPSFTEEDIKELIWRESVKFNPATIYV

SEQ ID NO: 7131 - protein, 283 aa, Oenococcus oeni
MSILDETFQLNNGNQIPKVAFGTWRLKDGDEAYQAVAAALKIGYRHIDTAFHYFNEPSVGQAIKDSGIKREDIFLTTKLPAEIKNHDDILKNFQESLDRLQTDYVDLYLIHAPWPWADINLDYRYDGANREAWQAMEEIYKSGRAKAIGVSNFDVHDLKNIQQIWSVKPAVNQIEFYVGWTQPKIAAYTKSLDIQLEAYSPLATGGLATQPDIQKIAEKYQVSVPRVALKYVLQKNVLPLPRATKAEHVKSNAELDFEISAADMEVLDKLPDTGQARHNVTMG

SEQ ID NO: 7132 - protein, 372 aa, Oenococcus oeni
MTNYQFLQTFEFKNGIKIKNRIVIPPMTECSSFEDGNVTKNELDYFALRTGGAGIFITPASNVSSLGKGFEGQLSCASDDMLPSLTQVANTIKVNGTKAILQLHHAGRISDSKILRGQQAVGPSAVASLRPGSEIPRELTNEEILQIISDFGQATRRAIEAGFDGIELHGAKTYLIQQFFSPHSNRRSDDWGGSLKKRMKFPLAVVEQVHKIVERYADRPFIIGYRISPEEIETPGIRLADTLALIDVLKKQPIDYLHISTRDVWQTSKNDSDDQIPVVDQIKEHTKNEVPLIAVGNIAKPEEAEKVIEDGFNFVALGREMLREPQWVEKVQNGQEAGINYSLNETDLKQLRITPPLWKFLTKKIHSKLTAD

SEQ ID NO: 7133 - protein, 347 aa, Psophocarpus tetragonolobus
GGELFDRIVQKGHYSERQAATLIKTIVEVVEACHSLGVMHRDLKPENFLFDTLHEDAKLKATDFGLSVFYKPGESFCDVVGSPYYVAPEVLRKLYGPESDVWSAGVILYILLSGVPPFWAETEPGIFRQILLGKIDFQSEPWHSISDSAKDLIRRMLDQNPKTRLTAHEVLRHPWIVDDNLAPDKPLDSAVLSRLKQFSAMNKLKKMALRVIAERLSEEEIGGLKELFKMIDTDNSGTITFDELKDGLKRVGSELMESEIKDLMDAADIDKSGTIDYGEFIAATVHLNKLEREENLVSAFSYFDKDGSGYITLDEIQQACKDFGLDDVHIDDMIKEIDQDNDGQIDY

SEQ ID NO: 7134 - protein, 359 aa, Ralstonia solanacearum
MNALFAPVRVGRHTLQNRLAMAPMTRSRAEPDGTPGELAADYYAQRASVGLIVTEGTQPSDDGQGYLTTPGIYTDAHVAGWKAVTSAVHAKGGHLFIQLMHAGRMSHPDNTPHHRPGVAPSAIAPGAPMFTATGMQDIPAPRALTTEEVRRTVDDFRLAARRAIEAGTDGVEIHGANAYLIQQFFAPSANTRTDAYGGSIENRARFAIEVAAAIADEIGADRTGIRLSPGTTMWGIDEGAEGPDLYRYLVAELDKLGLAYLHVMHQGDEPLLADLRRRWKQPLIVNRPGRPREQVGADVASGLADLEAYGQMVLANPDFVARLKAHAPMNEAQRNTFFGGSAPGYTDYPTLGETAGASA

SEQ ID NO: 7135 - protein, 489 aa, Bacillus cereus
MPQDRKAEVQKHAYERKEIMPDNSQSLPRHMQKELPHEFSVNPLFAREGESVVPRFHISDEGMLPETAYQIVHDEITLDGNARLNLATFVSTWMEPAAEQLYAKSFDKNMIDKDEYPQTAEIEERCVRILANLWHSPSPLTTMGVSTTGSSEACMLGGLALKRRWQNARKSEGKPLDRPNIVFSSAVQVVWEKFANYWEVEPRYVKVSPEHPQLDPQGVLAAVDENTIGVVPILGETYTGLYEPVAEIAKALDDLQARTGLDIPMHVDAASGGFIAPFLQPDLVWDFQLPRVKSINVSGHKYGLVYPGLGWIIWREAEDLPEDLIFRVSYLGGNMPTFALNFSRPGAQVLLQYYNYLRLGKSGYYDIQRASQKVALFLSKAIQKMEPFELLSDGSDIPVFAWRLKEGYTSNWNLYDLSRQLRVFGWQVPAYPLPPDMESVTIMRVVVRNGFSMDLAHLFLRNLKQTVAFLDSLDGPMPHDTKCNNGFHH

SEQ ID NO: 7136 - protein, 1306 aa, Arabidopsis thaliana
MEVCNCIEPQWPADELLMKYQYISDFFIAIAYFSIPLELIYFVKKSAVFPYRWVLVQFGAFIVLCGATHLINLWTFTTHSRTVALVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCMPGVENYQIALRIHEKFTKQRHQRPLLVALSGNTDKSTKEKCMSFGLDGVLLKPVSLDNIRDVLSDLLEPRVLYEGIDCRSVLDDILKQKGNNKIETLNRIMASALRRLVEQQQWRYLVSQSTRSPKLIHGFFSFSSKTNPNPNKQQQILIDYISKSLQSNDTWETLSTKFSSIDLSDSLIETILLRFKNPETAKQALSFFHWSSHTRNLRHGIKSYALTIHILVKARLLIDARALIESSLLNSPPDSDLVDSLLDTYEISSSTPLVFDLLVQCYAKIRYLELGFDVFKRLCDCGFTLSVITLNTLIHYSSKSKIDDLVWRIYECAIDKRIYPNEITIRIMIQVLCKEGRLKEVVDLLDRICGKRCLPSVIVNTSLVFRVLEEMRIEESMSLLKRLLMKNMVVDTIGYSIVVYAKAKEGDLVSARKVFDEMLQRGFSANSFVYTVFVRVCCEKGDVKEAERLLSEMEESGVSPYDETFNCLIGGFARFGWEEKGLEYCEVMVTRGLMPSCSAFNEMVKSVSKIENVNRANEILTKSIDKGFVPDEHTYSHLIRGFIEGNDIDQALKLFYEMEYRKMSPGFEVFRSLIVGLCTCGKVEAGEKYLKIMKKRLIEPNADIYDALIKAFQKIGDKTNADRVYNEMISVR

SEQ ID NO: 7137 - protein, 464 aa, Bartonella quintana
MAGDGTTTATVLGKGIVQEGVKAVAAGMNPMDFKRGIDAAVEEVVGNLFKKAKKIQNSGEIGQVGKISANGGGEIGKMIADAMEKVGNEGVIIVEEAKTAETELEVVEGMQFDRGYLSPYFVTNADKMVADLDDPYILIHEKKLSNLQSLLPVLEAVVQSGKLLLIIAEDVEGEALATLVVNKLRGGLKIAAVKAPGFGDRRKAMLEDIAILTSGQVISEDVGIKLENVTLDMLGRAKKVNISKENTTIIDGAGKKAEINARVNQIKVQIEETTSDYDREKLQERLAKLAGGVAVIRVGGATEVEVKEKKDRVDDALNATRAAVEEGIVAGGGTALLRAANALAIKGSNPDQEAGINIVRRALQAPARQIATNAGEEAAIIVGKVLENNADTFGYNTATGQFGDLIALGIVDPVKVVRSALQNAASIASLLITTEAMVAEVPKKDTPMPPMPGGGMGGMEYAEF

SEQ ID NO: 7138 - protein, 256 aa, Rhodobacter capsulatus
MTLELTPIPCLTDNYAWLWHDTATDTVVVVDVPEAAPVLKVLTDRRWQLHHILITHHHADHIAGVEALAQATGAKVAGAAADAHRLPPLDHPVAPGDVLHLGMEAAQVIAADGHTLGHIAWYLPGAGLLFSGDSLMSWGCGRLFEGTPAQMFDTLTRLAALPPETRVCSGHEYTAANGRFALSLEPGNGRLHDRMDRVTALRLAGEPSLPVTLGEERATNPFLRADDAALRAALGLPGDAAPLAVFTAARARKDRF

SEQ ID NO: 7139 - protein, 544 aa, Francisella tularensis
MAAKQVLFSDEARAKMLDGVNTLANAVKVTLGPKGRNVVLDKSFGTPTITKDGVSVAKEIELEDKFENMGAQIVKEVASKTADVAGDGTTTATVLAQALLTEGLKAVAAGMNPMDLKRGIDKATARLVEELKALSKPCSDPKSIEQVGTISANSDATVGKLIADAMAKVGKEGVITVEEGKGFEDELDVVEGMQFDRGYLSPYFATNQENMTTDLENPYILIVDKKISNIRDLLPILEGVSKSGRALLIIAEDVESEALATLVVNNMRGVVKVCAVKAPGFGDRRKAMLEDIATLTGATFVSEDLSMKLEETNMEHLGTASRVQVTKDNTTIIDGAGEKEAIAKRINVIKANIAEANSDYDREKLQERLAKLSGGVAVIKVGAVTEAEMKEKKDRVDDALHATRAAVEEGIVAGGGVALIRAQKALDGLTGENDDQNYGIALLRKAIEAPLRQIVSNAGGESSVVVNQVKANQGNYGYNAANDTYGDMVEMGILDPTKVTRSALQHAASIAGLMITTEAMIGEIKEAAPAMPMGGGMGGMPGMM

SEQ ID NO: 7140 - protein, 474 aa, Bartonella clarridgeiae
MRLREVASKTNDIAGDGTTTATVLGQAIVQEGVKAVAAGMNPISSRWELNAAVEEVVENLFKKAKKIQTSAEIAQVGTISANGASEIGKMIADAMEKVGNEGVITVEEAKTAETELEVVEGMQFDRGYLSPYLVTNAEKMVTDLDDPYILIHEKKLSNLQSLLPVLEAVVQSGKPLLIIAEDVEGEALATLVVNKLRGGLKIAAVKAPGFGDRRKAMLEDIAILTAGQVISEDVGIKLENVTLDMLGRAKKVNISKENTTIIDGAGHKAEITARVSQIKAQIEETTSDYDREKLQERLAKLAGGVAVIRVGGATEVEVKEKKDRVDDALNATRAAVEEGIVAGGGTALLRAANALTIKGKNPDQEAGIHIVRRALQAPARQIATNAGEEAAIIVGKVLENSSDTFGYNTATGQFGDLIALGIVDPVKVVRSALQNAASIASLLITTEAMVAELPKKETPMPPMGGGGMGGMGGM

SEQ ID NO: 7141 - protein, 155 aa, Triticum aestivum
  misc_feature (2)..(4): Xaa can be any naturally occurring amino acid
  misc_feature (72)..(72): Xaa can be any naturally occurring amino acid
  misc_feature (123)..(123): Xaa can be any naturally occurring amino acid
VXXXVPYDPLALRKAFEKAVVKRLMTDVPFGVLLSGGLDSSLVAAVTVRHLAGTKAAKRWGTKLHSFCVGLXGMELGTMHHEFTFTVQDGIDAIEDVIYHTETYDVTTIRASTPMFLMSRTTXQVISGEGSDEIFGGYLYFHKAPNKEELHREPR

SEQ ID NO: 7142 - protein, 483 aa, Bartonella doshiae
MVIDKSFGAPRITKDGVSVAKEIELEDKFENMGAQMLREVASKTNDIAGDGTTTATVLGQAIVQEGVKAVAAGMNPMDLKRGIDAAVEEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKAEINARVNQIKAQIEEQHSDYDREKLQERLAKLAGGVAVIRVGGATAVEVQVKKDRVDDACHATRAAVEEGIVAGGGTALLRAANALTVKGSNPDQEAGINIVRRALQAPARQIASNAGEEAAIIVGKVLENNADTFGYNTATGQFGDLISLGIVDPVKVVRSAKPNCADIHHTGGRSSMH

SEQ ID NO: 7143 - protein, 503 aa, Bartonella grahamii
MVIDKSFGAPRITKDGVSVAKEIELEDKFENMGAQMLREVASKTNDIAGDGTTTATVLGQAIVQEGVKAVVADMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKSEITARVNQIKAQIEETTSDYDREKLQERLAKLAGGVAVIRVGGATEVEVKEKKDRVDDALNATRAAVEEGIVAGGGTALLRAANALTVKGSNPDQEAGIHIVRRALQAPARQIATNAGEEAAIIVGKVLENNADTYGYNTATGEFGDLIALGIVDPVKVVRSALQNAASIASLLITTEAMVAEVPKKDTPMPPMPVAEWC

SEQ ID NO: 7144 - protein, 736 aa, Lycopersicon esculentum
MDCNCFDPLLPADELLMKYQYISDFFIAVAYFSIPIELVYFVQKSAVFPYRWVLVQFGAFIVLCGATHLINLWTSTPHTRTVAMVMTTAKFSTAAVSCATAVMLVHIIPDLLSVKTRELFLKNKAAELDREMGLIRTQEETGRYVRMLTHEIRSTLDRHTILKTTLVELGRALQLEECALWMPTRTGVELQLSYTLHHQNPVGFTVPIQLPVINQVFSANCAVKISPNSAVARLRPTRKYIPGEVVAVRVPLLHLSNFQTNDWPELSPKSYALMVLMLPSNSARQWHVHELELVDVVADQVAVALSHAAILEESMRARDLLIEQNVALDLARREAETAVRARNDFLGVMNHEMRTPMHAVVALSSLLQESELIPEQRLMVETILKSSNLLATLINDVLDLSRLEDGSLQLDVGTFNLHALFREVLNLIKPVAAVKKLFVTLSLSSDFPEVAIGDEKRLMQILLNVVGNAVKFSEEGSVSVSAVNAKSESLIDPRAPEFFPVQSENHFYLRVQVKDTGSGINPQDFPKLFCKFAQNQEPATKNSAGTGLGLAICKRFVNLMEGHIWIESEGVGKGSTAIFIVKLGIPGRLNESKLPFTAGLPANHMQMTFQGLKVLVMDDNGFSRMVTKSLLVHLGCDVTTIGSGDECLRILTREHKVLIMDASITGMNCYDVAVSVHEKFGKRLERPLIVALTGNTDQVTKENCLRVGMDGVILKPVSIDKMRSVLSGLLEHGTVL

SEQ ID NO: 7145 - protein, 483 aa, Bartonella elizabethae
MKLEDNFENMGAQMLREVASKTNDIAGDGTTTATVLGQAIVQEGVKAVAAGMNPMDLKRGIDAAVDEVVANLFKKAKKIQTSAEIAQVGTISANGAEEIGKMIANAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKAEITARVNQIKAQIEETTSDYDREKLQERLAKLAGGVAVIRVGGATEVEVKEKKDRVDDALNATRAAVEEGIVAGGGTALLRAASALSVKGSNPDQEAGINIVRRALQAPARQIATNAGEEAAIIVGKVLENNTDTFGYNTATGEFGDLIALGIVDPVKVVRSALQNAASIASLLITTEAMVAEMPKKEAAAPPMPAGGMGGM

SEQ ID NO: 7146 - protein, 635 aa, Lycopersicon esculentum
MESCDCIEALLPTGDLLVKYQYLSDFFIAVAYFSIPLELIYFVHKSACFPYRWVLMQFGAFIVLCGATHFISLWTFFMHSKTVAVVMTISKMLTAAVSCITALMLVHIIPDLLSVKTRELFLKTRAEELDKEMGLIIRQEETGRHVRMLTHEIRSTLDRHTILKTTLVELGRTLDLAECALWMPCQGGLTLQLSHNLNNLIPLGSTVPINLPIINEIFSSPEAIQIPHTNPLARMRNTVGRYIPPEVVAVRVPLLHLSNFTNDWAELSTRSYAVMVLVLPMNGLRKWREHELELVQVVADQVAVALSHAAILEDSMRAHDQLMEQNIALDVARQEAEMAIRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQTLLNVAGNAVKFTKEGHISIEASVAKPEYARDCHPPEMFPMPSDGQFYLRVQVRDTGCGISPQDIPLVFTKFAESRPTSNRSTGGEGLGLAICRRFIQLMKGNIWIESEGPGKGTTVTFVVKLGICHHPNALPLLPMPPRGRLNKGSDDLFRYRQFRGDDGGMSVNAQRYQRSL

SEQ ID NO: 7147 - protein, 206 aa, Arabidopsis thaliana
METVGRPRGRPRGSKNKPKAPIFVTIDPPMSPYILEVPSGNDVVEALNRFCRGKAIGFCVLSGSGSVADVTLRQPSPAAPGSTITFHGKFDLLSVSATFLPPLPPTSLSPPVSNFFTVSLAGPQGKVIGGFVAGPLVAAGTVYFVATSFKNPSYHRLPATEEEQRNSAEGEEEGQSPPVSGGGGESMYVGGSDVIWDPNAKAPSPY

SEQ ID NO: 7148 - protein, 1037 aa, Saccharomyces cerevisiae
MTVANTETHSAAKPSSTIGPWKLGETLGFGSTGKVQLAQHERTGHRTAVKVISKSIFNNNGNHSNDDSVLPYNIEREIVIMKLLSHPNVLSLYDVWETNNNLYLILEYAEKGELFNLLVDHGPLPEREAINCFRQIIIGISYCHALGIVHRDLKPENLLLDSFYNIKIADFGMAALQTDADLLETSCGSPHYAAPEIVSGLPYEGFASDVWSCGVILFALLTGRLPFDEENGNVRDLLLKVQKGQFEMPNDTEISRDAQDLIGKILVVDPRQRIKIRDILSHPLLKKYQTIKDSKSIKDLPRENTYLYPLADSNNHTSASIDDSILQNLVVLWHGRHADDIVSKLKENGTNKEKILYALLYRFKLDSVRGSNKKNRNKIKKTKKNKRSSTLSSSSSLLLNNRSIQSTPRRRTSKRHSREFSSSRKRSSFLLSSNPTDSSPIPLRSSKRITHINVASANTQATPSGVPNPHKRNSKKRSSKRLSYMPNTKRSSLTSKSLSNFTNLIDDDDWEYIEKDAKRTSSNFATLIDEIFEPEKFELAKREKAELQRKVQEAKRQSVNAQKINEDEFGSEVSDGMKELKKINDKVSSPLINYEFSQQELLQDIDTLLTNRYQLSSYTRPISRLDPGLTPVTETLPNNLKEKTALLQDTEKKIIETIRRSKFLGSLLNVRGGLSPGKSELAPIEESPIVSTTPLIYNDRMEPRRISDVEVPHFTRKSKHFTTANNRRSVLSLYAKDSIKDLNEFLIKEDPDLPPQGSTDNESRSEDPEIAESITDSRNIQYDEDDSKDGDNVNNDNILSDFPQGVGISQEYDMKDKNPNQSPISKSAEPTLVVKLPSLSSFQGKNASGLGLYQREPSKVTLPSLTSNNSSVGENIEDGAEKGTESEKIAASLSDDDLKEDNDKKDNDTVNAPTTVKKPPNSVLLKKFSKGKILELEIHAKIPEKRLYEGLHKLLEGWKQYGLKNLVFNITNMIITGKLVNDSILFLRSTLFEIMVLPNGDGRSLIKFNKKTGSTKTLTKLATEIQIILQKEGVLDK

SEQ ID NO: 7149 - protein, 204 aa, Pichia pastoris
MASRGTSRQQYDLTMKLLLVGDSGVGKSCLLLRFVDDSFNPSFITTIGIDFKIRTVEINGKKVKLQIWDTAGQERFRTITTAYYRGAMGIILVYDVTDERSFNSVHNWYQTLNQHANEDAQLFLVGNKCDDEESRQVTKEQGEQLASELGVPFLEASAKSNKNVDAIFLELAKRFEEKMRNTQQGPGSAGIDVNSSNDTKSSCC

SEQ ID NO: 7150 - protein, 593 aa, Unknown
  Frankia sp. CcI3
MSTLRLWAPEAKTVSLVVAGSAGDSTHEMTAGKRGWWWVNVPSAKHGTDYAFLLDDGSEELPDPRSAWQPGPLGVHGRSRLVDHSTFPWTDGTWRGIALAGSVLYELHVGTFTPEGTFDAAIGKLDHLVELGIDAIELLPVNAFPGRHGWGYDGVGLFAVHEPYGGPDGLKRFVDAAHARGLGVIMDVVYNHLGPDGNYLGRFGPYFTDRYSTPWGPAVNLDAPGSDEVRTFIIDSALSWLRDYHCDGLRLDAVHAFQDSRALHLLEEIAEAVHRLGAQLRRPLFAVAESDLNDPKLVAAPEAGGYGLDGQWCDDIHHALWATLSGERQGYYGDFGSISTLAHALTSGFVHDGGYSTFRGRSHGRPIPPTTPAYRFVTFLQNHDQIGNRAAGDRASATLSDGLLRIGAALLLTSAVTPMLFMGEEWGARTPWQYFTDHTAPGLGDAVREGRRAEFAAHGWEPQDVPDPQDPATFQQSKLDWSEPGREGHSDLLDWHRRLIALRRRLPALTDPAWSSVACTFDEEARWLVVRRGDVAIVVNLAAERQAVPLDGVPFDAPAASAHGFTYMPGRVELDGESVVIIRLLPPVEPTAG

SEQ ID NO: 7151 - protein, 150 aa, Unknown
  Nostoc sp. PCC 7120
MTLIRWNPWQDLNTLQRQLNHLFEEDMLPSTLLERTLTRVPAAELHETAEVIYLKLELPGIDAKDVDLQVTDKAVYISGERKSETKTEDKGVFKSEFQYGKFQRVIPLPARIQNTNVTAEYKDGILNLTLPKAEVEKNKVVKINIESAAG

SEQ ID NO: 7152 - protein, 548 aa, Rickettsia conorii
MATKLIKHGSKAREQMLEGIDILADAVKVTLGPKGRNVLIEQSFGSPKITKDGVTVAKSIELKDKIRNAGAQLLKSAATKAAEVAGDGTTTATVLARALAREGNKLVAAGYNPMDLKRGMDLAVNAVVEEIKKSSKKINSQEEIAQVGTISSNGDKEIGEKIAKAMEEVGKEGVITVEEAKNFSFDVEVVKGMMFDRGYLSPYFVTNSEKMVAELENPFILLFEKKLSNLQPMLPILEAVVQSQRPLLIIAEDVEGEALATLVVNRLRGGLKVAAVKAPGFGDRRKAMMEDIAILTKGELITEDLGMKLENVSIKSLGTAKRVTISKENTVIVDGNGDKKNIEDRVLQIKSQIAETTSDYDKEKLQERLAKLSGGVAVLKVGGATEVEVKERKDRVEDALAATRAAVEEGVVAGGGVTLLHASQPLTKLKVENKDQQAGIEIVIEALKDPLKQIVENAGENGGVVVGKLLEHKDKNYGFNAQDMQYVDMIKAGIIDPAKVVRTALQDAASVASLIITTETLIVDEPSSDKAEPMPMRGGMGGMGGMDF

SEQ ID NO: 7153 - protein, 493 aa, Staphylococcus xylosus
MKRKLTGLFGAPVSDRENSMTAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGHMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAEAMGIDINEVDLDVAD

SEQ ID NO: 7154 - protein, 142 aa, Glycine max
  misc_feature (105)..(105): Xaa can be any naturally occurring amino acid
  misc_feature (135)..(135): Xaa can be any naturally occurring amino acid
LFRKEIAKYDPICAEIADNIVAQEQLLLQIQEQNAQFAAVFNLDDYKVARERCYKQIAAAVAKYQAIKKNMNDGLNFYVSLQDATGKIQQQCSDFIMTRNIQCRXMIEDVQRKLAGFNLSSSSHNTNTPRSSSVXPDQHSPP

SEQ ID NO: 7155 - protein, 245 aa, Glycine max
MRASNSSSSISIAKRYFFFFFLFIFFALRSSSGDCSEYHHHHSPMATIGGLHDSQGSQNSVETEALARFAVDEHNKKQNSLLEFARVVRAQEQVVAGTLHHLTLEAIEAGEKKLYEAKVWVKPWLNFKELQEFKPAGDVPSFTSADLGVKKDGHQPGWQSVPTHDPQVQDAANHAIKTIQQRSNSLVPYELHEVADAKAEVIDDFAKFNLLLKVKRGQKEEKFKVEVHKNNQGGFHLNQMEQDHS

SEQ ID NO: 7156 - protein, 493 aa, Glycine max
MVFPKPSSESDLFLCSNFASHYARDSLPRFSMPENSMPKEAAYQNIHDELQLDAIPKLNLASFVTTSMEEECNKLIMESINKNYVDMDEYPATTDLHNRCVNMIARMFHAEIGENENATGAGTVGSSEAIMLAGLAFKKKWQNKRKAEGKPYDKPNLVTGSNVQVCWEKFARYFEVELREVEVREGYYVMDPAKAVELVDENTICVAAILGSTYNGEFEDVKLLNDLLLEKNKQTGWDTPIHVDAASGGFIAPFLYPELEWDFRLPLVKSINVSGHKYGLVYAGIGWVIWRTKDDLPEDLVFHINYLGADQPTFTLNFSKGSSQIIAQYYQLIRLGHEGYRSIMENCRDNAMVLKESLEKSGHFNILSKDNGVPVVAFSLKDRSQYDEYKISEMLRRHGWIVPAYPMPPAAQHINVLRVVIRAEFSRTLAERLVFDIYNVLHELEKLHPPKVTNFIKEENKALVETGVKKTALDAHREIIAQESNKRQKIMAA

SEQ ID NO: 7157 - protein, 546 aa, Bradyrhizobium japonicum
MSAKEVKFGVNARDRMLRGVDILANAVQVTLGPKGRNVVLDKSFGAPRITKDGVAVAKEIELDDKFENMGAQMVREVASKAADAAGDGTTTATVLAAAIVREGAKSVAAGMNPMDLKRGIDLAVEAVVADLQKNSKKVTSNDEIAQVGAISANGDQEIGKFLADAVKKVGNEGVITVEEAKSLETELDVVEGMQFDRGYISPYFVTNADKMRVEMDDAYILINEKKLSSLNELLPLLEAVVQTGKPLVIVAEDVEGEALATLVVNRLRGGLKVAAVKAPGFGDRRKAMLQDIAILTGGQAISEDLGIKLENVTLNMLGRAKKVMIDKENTTIVNGAGKKADIEARVAQIKAQIEETTSDYDREKLQERLAKLAGGVAVIRVGGATEVEVKERKDRVDDAMHATRAAVEEGIVPGGGVALLRASEQLKGLRTENDDQKTGVEIVRKALSWPARQIAINAGEDGSIVVGKVLDNEQYSFGFDAQTGEYSNLVSKGIIDPAKVVRIAVQNASSVAGLLITTEAMVAELPKKATAGPAMPAAPGMGGMDF

SEQ ID NO: 7158 - protein, 285 aa, Solibacter usitatus
MKTENVAEIARRQGLNWFTAVVLALLHIGAVAALFMFSWKALAVSVVLYYFATGLGISMGYHRLHTHRSYKVPRWLEYFFAICGTLTLEGGPIFWVATHRVHHQFSDLPGDPHSPRDGAFWSHMGWILWGETNHNNTRMMSKYAPDVAKHKFYTWLNNWHWVPITVLAAILVAWGGLPMFLWAICLRVVFGLHVTWAVNSATHMFGKRRFQTRDDSRNTWWVALFSFGEGWHNNHHAHPTSARHGLAWYEFDPSWLLIKVLKAIGVAKSIKVAHVDSGLAEREAA

SEQ ID NO: 7159 - protein, 848 aa, Pseudomonas synxantha
  misc_feature (233)..(233): Xaa can be any naturally occurring amino acid
  misc_feature (240)..(240): Xaa can be any naturally occurring amino acid
MLNPPPTGNSSRLLQRTGNDATRYLLPVFGRHRNFAGDVIPDEADRLLGWVEVELSHNGMLLRGYRSMFASLLLIAIGLMFTAALALRISRTINSPIGQIKQAVAQLKDGNLETRLPPLGSQELDQLASGINRMAETLQNAQEEMQHSIDQATEEVRQNLETIEIQNIELDLARKEALEASRIKSEFLANMSHEIRTPLNGILGFTHLLQKSELSPRQLDYLGTIEKSADNLXGIINEIXDFSKIEAGKLVLDSVPFNLRDLLQDTLTIFAPAAHAKQLELVSLVYRDTPLALVGDPLRLKQILTNLISNAIKFTREGTSSPGDGRDEQEDSVQLRISVQDTGIGLSNQDVRALFQAFSQADNSLSRQPGGTGLGLVISKRLIEQMGGEIGVDSTPGEGSEFWISLNLPKTRDDVEDLPAPPLLGRRVAVLENHELARQALQHQLEDCGLEVTPFNTLESLTNGITSAHQTEQAISLAVLGVTANDIPPERLNQHLWDLEHLGCKVLVLCPTTEQMLFNQSVPNPNSQLQAKPACTRKLRRSLADLISPRPSRSEPGEPLSSRAPRVLCVDDNPANLLLVQTLLEDMGAKVQAVESGYAAIDAVKQETFDLVLMDVQMPGMDGRQSTEAIRQWESERHGTPLPVVALTAHAMANEKRALLQSGMDDYLTKPISERQLAQVVLKWTGLALRNQGPERVNDGLAQGVQLLVLDHEEGLRLAANKADLAADMLAMLLASLEADRLAITVAREANDNHALIERVHRLHGATRYCGVPQLRAACQRAETLLKQDDAKAMAALDELDMAIARLASVSQSQRLTQFYGQHQSKCGGKPPPTFSQHFHRVNCREPS

SEQ ID NO: 7160 - protein, 413 aa, Cucumis sativus
MAATVSTIGAVNRTTLNNSNYGGLVPNSAFLGSRLKVSSRFTTSKMVTGNFKIVAEQDEEKQTEKDKWRGLAFDTSDDQQDITRGKGLADPLFQAPMGTGTHNAVLSSYEYISAGLRDYSYDNNVDGFYIAPAFMDKLTVHIVKNFLTLPNIKVPLILGVWGGKGQGKSFQCELVFAKMGINPIMMSAGELESGNAGEPAKLIRQRYREAADIIKKGKMCCLFINDLDAGAGRLGGTTQYTVNNQMVNATLMNIADNPTNVQLPGMYNKEENPRVPIIVTGNDFSTLYAPLIRDGRMDKFYWAPTREDRIGICTGIFRTDGVPFEDIVKLVDTFPGQSIDFFGALRARVYDDEVRKWAVGVGVERIGRNLVNSKESPPTFDQPKMTIEKLLEYGNMLVMEQENVKRVKLVTSI

SEQ ID NO: 7161 - protein, 550 aa, Bradyrhizobium japonicum
MSAKEVKFGVDARDRMLRGVDILHNAVKVTLGPKGRNVVLDKSFGAPRITKDGVTVAKEIELEDKFENMGAQMVREVASKSADAAGDGTTTATVLAAAIVREGAKSVAAGMNPMDLKRGIDMAVEAVVADLVKNSKKVTSNEEIAQVGTISANGDAEIGKFISDAMKKVGNEGVITVEEAKSLETELEVVEGMQFDRGYISPYFVTNADKMRVEMDDAYVLINEKKLSQLNELLPLLEAVVQSGKPLVIIAEDVEGEALATLVVNRLRGGLKVAAVKAPGFGDRRKAMLQDIAILTGGQAISEDLGIKLENVTLNMLGRAKKVMIDKENTTIVSGAGKKADIEARVAQIKAQIEETTSDYDREKLQERLAKLAGGVAVIRVGGATEVEVKERKDRVDDAMHATRAAVEEGILPGGGVALLRASEHLKGIRTKNDDQKTGVEIVRKALSYPARQIAINAGEDGSVIVGKILEKDQYSYGYDSQTGEYGNLVSKGIIDPTKVVRVAIQNAASVAALLITTEAMVAEVPKKNTGAGGMPPGGGGMGGMGGMDF

SEQ ID NO: 7162 - protein, 160 aa, Oryza sativa
MSLIRRSNVFDPFSLDLWDPFDGFPFGSGSRSSGTIFPSFPRGTSSETAAFAGARIDWKETPEHVFKADVPGLKKEEVKVEVEDGNVSRSAGEASKEQEEKTDKWHRVEASSGKFLRRFRLPENTKPEQIKASMENGVLTVTVPKEEPKKPDVKSIQVTG

SEQ ID NO: 7163 - protein, 486 aa, Schizosaccharomyces pombe
MTATKEESQKLLTSLRSQRDNKVCFDCGAKNPTWSSTTFGIYLCLDCSAAHRNMGVHISFVRFLRSTVLDSWTYAQLRVMRVGGNENARNYFKRHGGVSLLNSKDCRLKYSSKTAKQYLEKLKSLAVEDEANYPDILDMDFLSNTHEGSSAADTTNEDDDFFSAWDKASVKKSDDNLDDKTDLASTSSSVVVESGEKDEPVVVTEEKTMVSPPSRPDSTSTTKSKTSSISSARARPIRASSRPTASKLGASRPQKLGIKKANADIDFDEFEKAVLSSESAPTKKPAAVASKESTVDTLVDNGVEEVKESTSTTVQGKPVKPVLKSAASAKSTKSDDSNLNANFARLGFGQFAAASNARAKAAAKARELKKNEVNAPTYARDHFASQKSISSDQYFGRGSFDPEAAAEAQERLSSFRDATAISSKSYFGEEEDENEEGESSHRPDSAYLRDIAETATEDIEAIKVAIHQGAEKLSDFIQKVGARYNF

SEQ ID NO: 7164 - protein, 228 aa, Glycine max
  misc_feature (218)..(218): Xaa can be any naturally occurring amino acid
EFVEQHLLHYSKNRLKVGGDSTSLLSPLRRPPPPSVRKVFQLARTKQILWANEGNSAGEESATVFLRAIGLREYSRYLCFNFPSTIEKPLLGNLAFFPWKTDPANFKAWRQGRTGYPLVDAGMRELWATGWIHNKIRVIVSSFAVKMLLIPWRWGMKYFWDTLLDADLESDILGWQYISGCLPDGHKLERLDDPAIHGAKFDPEGEYVRQWLPELARXMPAEWIHHPW

SEQ ID NO: 7165 - protein, 463 aa, Bartonella vinsonii
MAGDGTTTATVLGQAIVQEGVKAVAAGMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGKKAEINARVNQIKVQIEETTSDYDREKLQERLAKLAGGVAVIRVGGATEVEVKEKKDRVDDALNATRAAVEEGIVAGGGTALLRAANALTVKGKNPDQEAGINIVRRALQAPARQIATNAGEEAAIIVGQGVENNADTYGYNTATGEFGDLIALGIVDPVKVVRSALQNAASIASLLITTEAMVAEMPKKDTPMPPMPGGGMGGMGGMD

SEQ ID NO: 7166 - protein, 209 aa, Streptomyces coelicolor
MAPRIERLVTSGQFSLDGGTWDVDNNVWLVADDHEVVVIDAAHDADAIAAAVGDRRLTAIVCTHAHNDHVDAAPRLAERTGATIWLHRDDLPLWQQTHPDRAPDAWLTDGLVIEAAGADLTVLHTPGHAPGAVCLYDPGLGTVFTGDTLFQGGPGATGRSYSHFPTIIDSIRDKLLVLPPETEVRTGHGDSTTIGAEAPHLEEWIKRGH

SEQ ID NO: 7167 - protein, 299 aa, Arabidopsis thaliana
MGDTTKDDGSSQSKAVRGEKRAFFFRKWTRIDLARASAVGAVHLLCLLAPFNYKWEALRFGVILAIVTSLSITFSYHRNLTHKSFKLPKWLEYPFAYSALFALQGHPIDWVSTHRFHHQFTDSDRDPHSPIEGFWFSHVFWIFDTSYIREKCGGRDNVMDLKQQWFYRFLRNTIGLHILTFWTLVYLWGGLPYLTWSVGVGGAIGYHATWLINSACHIWGSRAWNTKDTSRNIWWLGPFTMGESWHNNHHAFEASARHGLEWYQVDLTWYLIWFFQVLGLATDVKLPTDAQKRKMALAR

SEQ ID NO: 7168 - protein, 427 aa, Arabidopsis thaliana
  misc_feature (200)..(200): Xaa can be any naturally occurring amino acid
MASQGCVDWQFSGSDAAEKAAQASLGTYSSEIFSLCDPQGKPILPPLSEEAETSHTAEKAVVKAVLCGTGNAYAPSIGLPVAKRAVAEYLNRDLDNKLTGDDVYMTVGCKQAIELAVSILAKPKANILLPRPGFPWDMVHSIYKHLEVRRYEFIPERDFEIDFNSVREMVDENTFAIFIINPHNPNGNYYTEAHLKQVFXLATLARELGIMVVSDEVYRWSVFGSNPFVPMGKFSSIVPVITLGSISKGWIVPGWRTGWLALHDLNGVFRSTKVLKAAKEFLEITSKPPTVIQAAIPTILEKTPQDFFEKRGIFLKDKVDFGYSKLKNIPTLTCYMKPESCTFLWTKLDPLHFVDIEDDHDFCRKLAKEENLVVLPGIAFGQNNWLRHSIDMETPRLEDAFERLKSFCERHSVIVEASSLKDVNGVN

SEQ ID NO: 7169 - protein, 351 aa, Photorhabdus luminescens
MPTLFDPIRIGDLDLPNRIIMAPLTRNRAEGEGRVPNALMAEYYAQRASAGLIISEATSVTPQGVGYENTPGIWSDEQVAGWRLVTDAVHAAGGRIFIQLWHVGRISDPVFLNGERPVAPSAIAADGHVSLLRPKRPFVVPQALESEEIPGIVEAFRRGAENAKTAGFDGVEIHGANGYLLDQFLQDNANLRTDQYGGSVENRARLLLEVTDACISVWGSSRVGMHLAPRGGHYSMADSNPVATFGYVARELGKRGIAFIFSRDAVVDGDLSKVIKEAFGSTYIANEELTKESAEQVLADGRADAVAFGQLFISNPDLPHRFLVKAPFNEQQPETFMVPGAIGYTDYPALT

SEQ ID NO: 7170 - protein, 338 aa, Vibrio parahaemolyticus
MSGMRTLGEFIVEKQADFPHASGDLSSLLASIRLAAKIVNREINAAGLGDITGAVGTENVQGEAQQKLDVYANDKFKAALEARDQVCGVASEEEDEAVAFNKELNQNAKYVVLMDPLDGSSNIDVNVSVGTIFSIYRRVSPIGTPATEEDFLQPGHKQVAAGYVIYGSSTMLVYTTGNGVNGFTYDPSIGSFCLSHENMMIPEDGKIYSINEGNYIRFPQGVKKYIKYCQENVPEDGRPYTSRYIGSLVADFHRNLLKGGIYLYPSTQSHPQGKLRLLYECNPMAFLIEQAGGIASDGVNRIMDIKPTELHQRVPFFVGSKNMVRKVEEFLELHRDEE

SEQ ID NO: 7171 - protein, 510 aa, Saccharomyces cerevisiae
MPTSGTTIELIDDQFPKDDSASSGIVDEVDLTEANILATGLNKKAPRIVNGFGSLMGSKEMVSVEFDKKGNEKKSNLDRLLEKDNQEKEEAKTKIHISEQPWTLNNWHQHLNWLNMVLVCGMPMIGWYFALSGKVPLHLNVFLFSVFYYAVGGVSITAGYHRLWSHRSYSAHWPLRLFYAIFGCASVEGSAKWWGHSHRIHHRYTDTLRDPYDARRGLWYSHMGWMLLKPNPKYKARADITDMTDDWTIRFQHRHYILLMLLTAFVIPTLICGYFFNDYMGGLIYAGFIRVFVIQQATFCINSLAHYIGTQPFDDRRTPRDNWITAIVTFGEGYHNFHHEFPTDYRNAIKWYQYDPTKVIIYLTSLVGLAYDLKKFSQNAIEEALIQQEQKKINKKKAKINWGPVLTDLPMWDKQTFLAKSKENKGLVIISGIVHDVSGYISEHPGGETLIKTALGKDATKAFSGGVYRHSNAAQNVLADMRVAVIKESKNSAIRMASKRGEIYETGKFF

SEQ ID NO: 7172 - protein, 183 aa, Brassica napus
  misc_feature (37)..(37): Xaa can be any naturally occurring amino acid
  misc_feature (47)..(47): Xaa can be any naturally occurring amino acid
  misc_feature (158)..(158): Xaa can be any naturally occurring amino acid
SVDLLFYRKYAIPQPQGYHTITFFCEVLFLCSHTALXLDRDETHALXFSADSYLRVHWKILDQIPGKATGAYSHSQGIKGLRDAIAAGIEARDGFPADPNDIFMTDGASPGVHMMMQLLISSEKDGILCPIPQYPLYSASIALHGGSLVPYYLDEASXGWGLEISELKKQLEDAKSKGITVRA

SEQ ID NO: 7173 - protein, 364 aa, Enterobacter cloacae
SAEKLFTPLKVGAVTAPNRVFMAPLTRLRSIEPGDIPTPLMGEYYRQRASAGLIISEATQISAQAKGYAGAPGLHSPEQIAAWKKITAGVHAEDGRIAVQLYHTGRISHSSIQPGGQAPVSASALNANTRTSLRDENGNAIRVDTTTPRALELDEIPGIVNDFRQAVANAREAGFDLVELHSAHGYLLHQFLSPSSNQRTDQYGGSVENRARLVLEVVDAVCNEWSADRIGIRVSPIGTFQNVDNGPNEEADALYLIEELAKRGIAYLHMSETDLAGGKPYSEAFRQKVRERFHGVIIGAGAYTAEKAEDLIGKGLIDAVAFGRDYIANPDLVARLQKKAELNPQRPESFYGGGAEGYTDYPSL

SEQ ID NO: 7174 - protein, 394 aa, Burkholderia fungorum
MLDFLAHGLLHFSWWQLVLYTAIVTHITIIGVTVYLHRCQAHRALELHPVVSHFFRFWLWMTTGMLTGQWAAIHRKHHAKCETEEDPHSPQTRGIWKVLLEGAELYRTEAKNEETMRKFSHGTPNDWMERNVYTKYPILGVSLMMVLNVALFGVVGLTIWAVQMVWIPFWAAGVVNGLAHFWGYRNFNSADASTNIFPWGIIIGGEELHNNHHTYATSAKLSNKWYEFDIGWMYIRIMSAFRLAKVKKVAPTPRLTTGKLVLDQDTLQAVLANRYEVMARYGKALKRAYRQELAHLKEVGAREKYQLMRGARSWFHKEEAGLDEPQKRQLPQIFASSQKLKTYIDMRNELAAMWERSNASRDQLLVQLQDWCHRAEQSGIKTLQDFAMRLRRYA

SEQ ID NO: 7175 - protein, 233 aa, Zea mays
MCGILAVLGCGDESQGKRVHVLELSRRLKHRGPDWSGLHQVADNYLCHQRLAIIDPASGDQPLYNEDKSIAVAVNGEVYNHEELRARLSGHRFRTGSDCEVIAHLYEEYGESFIDMLDGVFSFVLLDARDNSFIAARDAIGVTPLYIGWGIDGSVWISSEMKGLNDDCEHFEIFPPGNLYSSKEKSFKRWYNPPWFSEVIPSVPYDPLRLRSAFEKAVIKRLMTDVPFGVSLS

SEQ ID NO: 7176 - protein, 472 aa, Cytophaga hutchinsonii
MKIEQLYTGCLAEAAYYIESEGEAIIIDPLRDIQTYVQKIERNNVTLKYIFETHFHADFVSGHLDLAEATGATIVYGPKAETTFNSHIAYDGEKISIGKITLQVLHTPGHTQESSCYLLYDEDGNKHALFTGDTLFIGDVGRPDLAIKSDLTKEDLAGMLYDSLEEKIKPLPDAITIYPAHGAGSACGKNLSKETFDTLGSQKQKNYALKAADKETFIKQVLDDLQPAPSYFNMNALLNKEGPGSVSELIKQGSIAFDVQSFENLQRQTYAVLLDTRDAKEFKKGFIPGSINIGLNGQLAPWAGTLLTNSDKPILIITDPGKEEETIIRLARVGVDQVIGYLKDGYNSWQKANKPEENIETISAAELVEKLDENINILDVRKADEYEKGHLNAAQHLPLDYINDWITTLDKNKTYYVHCAGGYRSVITESILKSRNISNVIDVSGGYGAIKAAMEPTKKRWLNAFFSFMKVK

SEQ ID NO: 7177 - protein, 542 aa, Physcomitrella patens
MEAGGRPMGPATAEYYLPNYKLGKTLGIGSFGKVKVAEHSPTGHKVAIKILNRRKVKMMDMEEKVRREIKILRLFMHPHIIRLYEVIETPADIFVVMEYVKSGELFDYIVEKGRLGEHEARRFFQQIVSGVEYCHRNMVVHRDLKPENLLLDSKSNVKIADFGLSNVMRDGHFLKTSCGSPNYAAPEVISGKLYAGPEVDVWSCGVILYALLCGSLPFDDENIPNLFKKIKGGIYTLPSHLSPGARDLIPRMLLVDPMKRVTIPEIRQHPWFLNHLPRYLAVPPPDTTQQAKRIDEEILERVVALNFDRDLLIDSLLNRVQNKATVAYYLMLDNRRRLSNGYLCSEFNEGKEHLMSPMDAFNGTPRSGYPRTLTHMSSMDRRSASPSGLQHRVVAERKWVLGLQLRSHPKEIMNDVLKTLRDLGINWKKTGAYNLKCRWVAPGQNSNDTTAENHSLPDSPMAGSMPRASSCRWSSEQHGVSGSVAAGNRDNESGVESNVLKFELQLFKLREEKYLLDLQRVVGPTYLFLDLCAAFLAELRVL

SEQ ID NO: 7178 - protein, 484 aa, Listeria monocytogenes
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRKVVEDFTNYAALLFKRFNGRVKYWVTLNEQNVFISHGYKLAYHPPGVSDDKRMFAANHNANLANASAIAKFRELGTSGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 7179 - protein, 546 aa, Tatlockia micdadei
MAKELRFGDDARQQMLAGVNALADAVKATMGPSGRNVVLERSFGAPTVTKDGVSVAKEIEFENRFKNMGAQMVKEVAAKTSDTAGDGTTTATVLARAIVVEGHKAVAAGMNPMDLKRGIDKAVAAVTKKLQEMSKPCKDGKAIAQVGTISANSDQAIGSIIAEAMEKVGKEGVITVEDGNSLENELAVVEGMQFDRGYISPYFINNQQNMSAELEHPFILLVDKKISTIRDMLSVLEAVAKSGPSLLIIAEDVEGEALATLVVNNMRGIVKVCAVKAPGFGDRRKAMLQDIAILTAGEVISEEVGTSLESATLDSLGTAKRVVVTKENTTIIDGEGKAADINARITQIRAQMEETTSDYDREKLQERVAKLAGGVAVIKLVLLPNRMKRKARVEDALHATRAAVEEGIVAGGGVALIRAQKALDGLKGENADQDMGINILRRAIESPLRQIVANAGYEPSVIVNKVAESKDNFGFNAATGEYGDMVEMGILDPTKVTRTALQNAASVASLMLTTECMVADLPKKEEPMGAGEMGGMGGMGGMGGMM

SEQ ID NO: 7180 - protein, 555 aa, Orientia tsutsugamushi
MSKQIVHGDQCRKKIIEGINVVANAVGITLGPKGRCVAIEQSYGPPKITKDGVSVAKAIQLKDKSLNVGAQFVISVASKTADVAGDGTTTATVIADAAVRELNKAEVAGIDIQEVRKGAEKAVEAVIADVRKNSSPVKNEEEIAQVATVSSNGDREIGEKIANAMKQVGQEGVITVEDSKNFNFEVEVVKGMRFDRGYISQYFATNREKMITEFENPYILLLDQKVSTVQPLVPVLEAVAHTGKPLVLIADDVDGEALTALILNNLKGSIKVVAVKAPGFGDRKKEMLEDIAILTNGEVITEQLGIKLEKVNDTSKLGTANRVIVTKDHTTIVHDKNNSDIEKKVNSRCEQIREAIKDTTSDYEKEKLQERLAKLRNGVAVLKVGGATEVEQKERKDRVEDALHATRAAVEEGIVPGGGVALFYASRVLDSLKFDNEDQRVGINIIKKVLEAPVRQIVKNAGGKEDVVVNELSKSTDKNRGFDARTMQYVDMIKAGIVDPTKVVRTALQDAFSVASLVIATSAMITDHEEDNNTGNRSGGGVGGGHHGGMGGMDF

SEQ ID NO: 7181 - protein, 928 aa, Pectobacterium carotovorum
MTKYSLRARMLILILAPTLMIGLLLSSFFVIHRYNQLQTQLADSGTRIIEPLATISAYAITHRQMDTIPTLINTLHRRHSAIIRTISVFDARNQLLATTNVRNNVTLQPLSSDALSYNKLHLHHTNDALILHMPIVNDSEFMPGGVQPGTATPLGYLVIELDTSTIRLQQYQEIFIAALLLLLSLGAAVIFAYRLMRDVTTPIRNMVDTVDRIRRGQLDSRVEGYMLGELDMLKNGINSMAMSLTAYHEEMQQNIDQATYDLRETLEQMEIQNVELDLAKKRAQEAARIKSEFLANMSHELRTPLNGVIGFTRQTLKTSLNTTQTDYLLTIERSANNLLNIINDVLDFSKLEAGKLVLEDIPFSLHSTLDDVVMLLAHTAHEKGLELTLSIQNDVPEQYVGDPLRIQQIITNLLGNAIKFTEQGNIDIRVEKRRQEHHQVQLEVQICDTGIGIAELQQSQLFQAFRQADTSISRRHGGTGLGLVITQRLVKEMGGDISFQSQLNKGSTFWFHITLPLNPHTVPIEPVYTMLQGKHLAYVEYHPIAAQATLDILSQTPLMVSYSPTFEQLPEGEFDILLLAIPAQYRNTLLDYTPRLRDICRRAPCVILALPSLAQMDAEQLKAFGVHACLSKPLAASRLLPLLQNSTLFQLSFLPSDTTSHQGTVRHPARLPLSVMAVDDNPANLKLIGTLLEEQVDTIILCESGTEAIAQAKMHQIDIILMDIQMPGMDGICASELIRQIPHHATTPIIAVTAQTMTGEREHLLSSGMDDYLAKPIDEQMLKSVLTRHARKDPLKRDRADMVGLLSEHDDSQLSLDWALAQQQAANKPELARDLLQMLLDFLPEVQRKIENVLNGQTDDDIIELVHKLHGSCSYSGVPRLKRICRYLEQQLRKGVHANDLEPEWLELLDEIDNVNNAAQPHINPRLP

SEQ ID NO: 7182 - protein, 408 aa, Bartonella henselae
MAAKEVKFGREARERLLRGVDILANAVKVTLGPKGRNVVIDKSFGAPRITKDGVSVAKEIELEDKFENMGAQMLREVASKTNDIAGDGTTTATVLGQAIVQEGVKAVAAGMNPMDLKRGIDAAVDEVVANLFKKAKKIQTSAEIAQVGTISANGAAEIGKMIADAMEKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKIAAVKAPGFGDRRKAMLEDIAILTSGQVISEDVGIKLENVTLDMLGRAKKVNISKENTTIIDGAGQKSEINARVNQIKVQIEETTSDYDREKLQERLAKLAGGVAVIRVGGATEVEVKEKKDRVDDALNATRAAVE

SEQ ID NO: 7183 - protein, 758 aa, Streptomyces avermitilis
MSEANPLKRAARKITNSLQDNGATPEEGIPGRPGPESPSVAEPTEPRDPLPPKPDQSGPDTVSPTGQPTGADQARMAQSGSYLTTAQSTRLYDTDHSLKAGPRGPVLLQDHHLREKVMHFDHERIPERVVHARGAAAHGVFQSYGTAASVTKAAFLSEDKETPVFVRFSTVLGSRGSSDTVRDTRGFATKFYTSEGVFDLVGNNIPVFFIQDAIKFPDVIHAGKPHPDREIPQAQSAHDTFWDFVTLHTEATHHTLWNMSDRGIPRSYRMMEGFGVHTFRLVNAEGATTLVKFHWKPKLGVHSLVWEEAQITNGVDPDFHRRDLADAIEAGAHPQWELGIQTFPDTPDQTFEGIDLLDPTNLVPEELAPVQPVGLLTLMRNPSNFFAETEQVAFHVGHLVPGVDVTDDPLLAGRLFSYLDTQITRLGGPNFPQLPINRPHAPVNDMLRDGMHQTAVHRGVAPYRPNSLDGGCPFLAGADTGAFVETPVRVPEAAKVREAPESFADHFSQPRRFWLSMSPIEREHIIAAYTFELGKCYEQAVKERALQVLANIDPNLCAEVATGLGLPAPQPTVPLAEVEASPALSQVGGTWPTDGRVIGIVIGPDGDLRGVSAVREAVLDASMVPLVVAPAGGVFGSGEGMVTVQRTYATARSVEFDAILLAGTPGVGGDAYGARDAKAFPAPAQQATGDPRVGLLVSEAFRHGKAVGAWAGGEAFLEASGVPLDAPGVVVGDSGTGALAQLTGLLGKHRAWDRFRAV

SEQ ID NO: 7184 - protein, 481 aa, Ralstonia metallidurans
MNKLTTAFGAPVVDNQNVQTAGPRGPALLQDVWFLEKLAHFDREVIPERRMHAKGAGAYGTFTVTHDITKYTRANLFSQVGKKTDLFLRFSSVAGERGAADAERDIRGFAIKFYTEEGNWDLVGNNTPVFFLRDPLKFPDLNHAVKRDPRTGMRSAESNWDFWTGLPEALHQVTIVMSDRGIPRTWRHMHGFGSHTYSFINANMERFWVKFHFVTQQGIQNLTDEEAAEITGQDREYHQRDLFESIERGDFPRWKLCVQIMPEAEASKVPYHPFDLTKIWPKKDYPLIEVGVLELNRNPDNFFAEVEQASFAPSTIVPGVGFSPDKMLQGRLFSYGDAARYRVGVNHHQIPVNSPKAAKYVNSYHRDGTMRVDGNRGAAIGYEPNTKGEWAEQPDFREPPLTLEGTADHWNHREDGDYFSQVGALFRLMSPTQQQALFDNTARSIKGVSKHIQQTHIKHCTAADPAYGAGVAAAIEMIEAK

SEQ ID NO: 7185 - protein, 453 aa, Oryza sativa
MGGEEGMAAGRKKRVGRYEVGRTIGQGTFAKVKFAVDADTGAAVAMKVLDKDTILNHRMLHQIKREISIMKIVRHPNIVRLNEVLAGKTKIYIILELITGGELFDKIARQGKLRENEARKYFQQLIDAINYCHSKGVYHRDLKPENLLLDSRGNLKVSDFGLSTLAQKGVGLLHTTCGTPNYVAPEVLSNNGYDGSAADVWSCGVILYVLMAGYLPFEEDDLPTLYDKITAGQFSCPYWFSPGATSLIHRILDPNPKTRITIEQIREDTWFKKTYVAIKRGEDENVDLDDVQAVFDNIEDKYVSEQVTHNDGGPLVMNAFEMITLSQGLDLSALFDRQQEFVKRQTRFVSRKPAKTIVATIEVVAETMGLKVHSQNYKLRLEGVSSNRMSPFAVVLQVFEVAPSLFMVDVRKVAGDTLEYHRFYKNLCNKMESIIWRPIEVSAKSALLRTATC

SEQ ID NO: 7186 - protein, 450 aa, Oryza sativa
MSVSGGRTRVGRYELGRTLGEGTFAKVKFARNADSGENVAIKILDKDKVLKHKMIAQIKREISTMKLIRHPNVIRMHEVMASKTKIYIVMELVTGGELFDKIASRGRLKEDDARKYFQQLINAVDYCHSRGVYHRDLKPENLLLDASGTLKVSDFGLSALSQQVREDGLLHTTCGTPNYVAPEVINNKGYDGAKADLWSCGVILFVLMAGYLPFEDSNLMSLYKKIFKADFSCPSWFSTSAKKLIKKILDPNPSTRITIAELINNEWFKKGYQPPRFETADVNLDDINSIFNESGDQTQLVVERREERPSVMNAFELISTSQGLNLGTLFEKQSQGSVKRETRFASRLPANEILSKIEAAAGPMGFNVQKRNYKLKLQGENPGRKGQLAIATEVFEVTPSLYMVELRKSNGDTLEFHKFYHNISNGLKDVMWKPESSIIAGDEIQHRRSP

SEQ ID NO: 7187 - protein, 328 aa, Escherichia coli
MDKKQVTDLRSELLDSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSAGGSGNCTVL

SEQ ID NO: 7188 - protein, 693 aa, Caulobacter crescentus
MAQRIASHEERRQTALLLALSFAVAAAIVFSENLTRTTLGVAAFWPANAFLAAGLLTLTSVRRLVLIAVFVFFHVAVCLQAGDGPLKALVFATVDGLEAGAVWAAFRRFWNGAPRVRTLRALAQLPAITTPIAAGSALICATVLHFGYGAPFAESLVDWLLRSALGLAVALPATLVLIDAEHRRSFQRPWSEKLLLMFSVVTVALLCAHPAAGAPPVLMFPVTLAAAYRLGARGAALAAFLTIGIIMPMVISVGSSSFNSTQDTVIQARTIQVFMGVLFYTCLAAGLAFGQQNRLKRLLLRREQLTRAARGRALAATEAKTEFLATMSHEIRTPLNSVLGFAQLLAAREDLPPDARRQVNLIDSAGAALLTVVDDILDFSRVEAGQIELLPGPTSAAALLRDTVAIMAPEARAKGLSMDVEIIDPIGVLHDLDADRLRQVLINLLNNAVKFTEEGRIDARLIIEPGDIEDRLRFEVLDTGVGIELDKQGLLFQRFSQTDSSPSRLHGGPGLGLAIAKALIDVMGGKIGVDSVPGRGSCFWVELSAPVAEPAPAPEPAKPPAPGAARILIVDDHPINLEIGAALLTLVGYEVDLAENGKQAVEKAEAGAYDLILMDIHMPLMDGLQATRAIKALRTSTGKAPIIAMSADALPRQVERCYAAGMVDHVAKPIQREVLYAKIERWLHPLRDGDKPA

SEQ ID NO: 7189 - protein, 545 aa, Physcomitrella patens
MDSGGRPVAPVAVEYYLPNYKMGKTLGIGSFGKVKVAEHTPTGHKVAIKILNRRKVKSMDMEEKVRREIKILRLFMHPHIIRLYEVIETPTDIFVVMEYVKSGELFDYIVEKQRLGEDEARRFFQQIVSGVEYCHRNMVVHRDLKPENLLLDSKWNVKIADFGLSNIMRDGHFLKTSCGSPNYAAPEVISGKLYAGPEVDVWSCGVILYALLCGSLPFDDENIPNLFRKIKGGIYTLPSHLSPGARDLIPRMLLVDPMKRVTIPEIRQHPWFLNHLPRYLAVPPPDTLQQAKRIDEEILERVVALNFDRVHLIESLLNRVQNKATVAYYLMLDNRRRLSNGYLGSEFDEGKEQSLSPMSPYGAHGGTPRSTYPRSLIRTPSMDRRGSSSSVLQHRVVAERKWALGVQLRSHPKEIMSDVLDTLRKCDINWKKTGAYNLKCRWVAPNQHLNDRASEHRGIPDSPMAGTTPRVSSGRWSSEQQGISGSVASGNKDDESGVESNVLKFELQLFKMREEKYLLDLQRVEGPTYLFLDLFSAFLIELRVA

SEQ ID NO: 7190 - protein, 848 aa, Zea mays
  misc_feature (351)..(351): Xaa can be any naturally occurring amino acid
MASAAGSSNVMLAIHEKKTTATDLYRPLRLYIASTYSEREAAAADDDLSVVRDALLAYARALALVEPRFPISPDRAHVHSLTFTWHDAFKGNKKCALASIHLEKASVLFNLGAVYSQIAVAADRSTDVGIKTACGAFQSAAGAFAWLRESGVAAKAVAAGTTTVDITPECAGMLEKLMLAQAQECFFEKVIGGGKPPALCSKVARQVGIFYEEAYAALSAPPLSQHFDKTWVSHVQLKAAQFYADACYRYSLDLHQKEEIAEEIARLKIGMSALADAKKAAKGVAAQLMDSVNKLESNMKTNLERAMKENDRVYLMRVPAAGSLGALSAASLVKPTSLSEVLDASKERLFXSSLVPDGSMKALSKYTEMVDNIIRTQAEKLQQASEITRVRLKEMDLPDSILSLEGNITLPLDLKEDVEAVQISGGPAGLESELQQLRDLSRVNQELLVQTEELLQKEANEDAQFRTQFGSRWTRPQSSTLTKNIQDRLNLFASNLKKAADSDSLIERGVKENYPLMSILDKRPIESALPSISRPIMSLDGNEDAIVGALKQSLRQLESLGAHRAGLEDMLKEMKRKDDILPKLMAGVGSHDDLFKKEIAKYDPICADIADNIVAQEQLLLQIQAQNEQFASVFNIEDYKAARERCYKQIAAAVAKYREFKKNINEGLNFYVTLQEAIGKIKQQCSDFIMTRNIQCREMIEDVQRKLAGFSFSSSSHSSMQRNASVPPDQSSPSPPPHAQAPYASPPGVDSRLGYSQTEPRPAYSQPYPPSYGAPPQQPSYGAPHPGQYQPPAHQPPPGHDYGQPAYPGWRGPYYNAPQPQQSAPYPQPPYNAPGAYPPHQSNYYRPQ

SEQ ID NO: 7191 - protein, 672 aa, Cytophaga hutchinsonii
MKEKKGIALIEDDPWLEPYEAEIQDRIIRYKRAVKEIKEHYGDLLTFATGHKYYGINFDEDERGWYYREWAPEAYEVYLTGDFNDWDRRSHPLTRNEFGVWQIFLPYDLYQKRFVHKSKIKVQIVGANGTHDRIPAYITRVVQDTETTDFSGQLWFPQKPFEWTDRDFNLRKIKNPIIYEAHVGMAQEKEGVGTYREFADKIVPRIRQMGYNSIQLMAVMEHPYYGSFGYHVSNFFAPSSRFGTPEDLKYLVDRAHKFGLAVIMDVVHSHAVKNLSEGLNEFDGSDHQYFHPGDRGYHTGWDSKLFDYGKLEVKRFLLSNLRYWLEEYHFDGFRFDGVTSMLYFDHGMKTFDSYDTYFKGGVDFDAVTYLQLANEVTHRYLKDSITIAEDVSGMPGLSRSIRDGGVGFDYRLAMGIPDFWIKYLKHLQDEQWNIYEMWSTLTNRRYKEKTIAYAESHDQAMVGDKTIAFWLMDKEMYFHMQVDDPNPVIDRGIAIHKLLRLFTFALGGEGYLNFMGNEFGHPEWIDFPREGNGWSYQYARRQWSLVDNPKLKYQYLGAFDEAMMRLVRKTRLLAAEPAQQLNMDDHNKVIIFERNNMIFVFNFSVSNSVFDYKFKSFAPGTFEIVLNSDDTRFGGHGRVDDTLEYHTNTEGQLSIYTPNRSVLVFQRKEASE

SEQ ID NO: 7192 - protein, 294 aa, Debaryomyces hansenii
MAVTLKNNTDTVTLNNGDKIPAVGLGTWQATEKDAAYKSVKAALQNGYRHIDTAAIYGNEEEVGRGIKDSGVPREEIYVTTKLWNADHKKAEEALNTSLKKLGLDYIDLYLIHWPYSVQPDTKQPYSDWDYLDTYKELQKLKATGNVKAIGVSNFTVKQLERLLADKDITIKPAVNQIEAHPLLTQPELTEYLKKNDIVIEAYSPLGSSNSPLFKNETVVAIAEKYQVEPAQVLVSWAIQRDTVVLPKSVTESRIISNLKTFKLSDEDFNTLNNLSQKDGVVRTCNPEFNDFDD

SEQ ID NO: 7193 - protein, 124 aa, Brassica napus
MAPSVAVENLNPKVLKCEYAVRGEIVIHAQRLQQQLQTQPGSLPFDEILFCNIGNPQSLGQQPVTFFREVLALCDHPCLLEKEETKSLFSADAISRAKQILATIPGRATGAYSHSQGIKGLRDA

SEQ ID NO: 7194 - protein, 295 aa, Debaryomyces hansenii
MTTRTANNTDYYTLNNGEKIPAVGFGTWKATKKEGAHTAVKIALQTGYRHVDTAVMYDNEEEVGRGIKESGIPREEIFVTTKLWNTDHKQVSKAFDSSLQRLGLDYVDLYIMHWPLPLDPKTEKPYEDWNYIDTYKEMQKLVESKKVKSIGISNCNIEQTKKILDDKDITIKPVVNQVEAHPLLPQLELFDFLKQNDIALEAYSPLGSDNSPLFKDDTIIGISQKYNVHLAQVLVSWAVQRGSIVLPKSVTESRIISNLKTFKLREDDFATLNNLSKEVGPVRTNDPDWFDFGKD

SEQ ID NO: 7195 - protein, 478 aa, Brassica napus
MALEYDLLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGEGDGILVPVPQYPLYSATISLLGGSLVPYYLDESENWGLDVNNLRQSVAQARSQGISVRAMVIINPGNPTGQCLSEANLKEILKFCYNEKLGLLGDEVYQQNIYQDERPFISSKKVLMDMGSPFSKGVQLVSFHTVSKGYWGECGQRGGYFEMTNFPPRVVERVRKVASIALSPNVSAQIFMGLMVSPPKPGDISYDQFARESKGILESLRRRAKIMTDGFNSCKNVVCNFTEGAMYSFPQIRLPPGALQAAKQAGKVPDVFYCLKLLEATGISTVPGSGFGQKEGVFHLRTTILPAEEEMPEIMDSFKKFNDEFMAQYENGFGYSRM

SEQ ID NO: 7196 - protein, 482 aa, Listeria monocytogenes
MSNTKFPDGFMWGGATAANQFEGGYNSGGKGLACADLFTGGTHTEPRRITAQLEESTFYPSHEAVDFYHHYKEDIKLMAEAGFKVFRMSINWTRIFPTGKEAEPNEEGLQFYEDVFKELKKYQIEPLVTIAHFDIPLALTNEVNGWASRDLIDYYLHYCEVIFKRYKHLVKHWLTFNEINTATMEIGNYLSLGIRHAEGDFLHQKDDPTVRYQALHHQFVASAKAVKLGHSINPEFMIGCMIAYMPRYPRTCEPTDVLLAKQTEAMHSHFCGDVHVKGYYPFYAKTFFKDNGIELEFDPEDEQVLREGTVDFYTFSYYLTLCASNDPAYKNSGKSVIGGAENPYLKTNDWGMQTDPVGLRIALNDLYTRYNIPLMVVENGLGAFDKLEDDGTINDPYRIDYFKEHILQMHKAIQDGVDLIGFTIWGCIDLVSASTGEMAKRYGIIYVEKYDDGTGDYSRKKKASYYWYKDVISSNGEIGLRE

SEQ ID NO: 7197 - protein, 191 aa, Haloarcula marismortui
MIRNLARGQQAFTSNVFLVTGDRTVLVDVGNEFDVVSTVEEHVDDIDAVAVTHTHYDHVENLDSVVDAFDVPVYGYDTDQDGVEYAIADDETIQLGDHDYRALHTPGHKNDHLCFYSDDAGVLFAGDLVFANGSFGRTDLNEGNRDLLVDSIERVLSVTDEDLQEMHTGHGPSITDAPYQDIELALQAAKF

SEQ ID NO: 7198 - protein, 143 aa, Zea mays
FVIIGIVLFLHCQGDADYLRYHGMQEFDQAMQHLEQKYEFMTSDHQYISRKHEEDKVIVFEKGDLVFVFNFHCNNSYFDYRIGCRKPGVYKVVLDSDAGLFGGFSRIHHAAEHFTADCSHDNRPYSFSVYTPSRTCVVYAPVE

SEQ ID NO: 7199 - protein, 721 aa, Emericella nidulans
MRALGLVGLVGVANAVCPYMTGELGRRDTNPDATEATEEFLSEYYLDDTDSYLTTDVGGPIEDQQSLKAGARGSTLLEDFIFRQKIQRFDHERVPERAVHARGAGAHGVFTSYGDFSNITAASFLSAEGKETPVFVRFSTVAGSRGSSDLARDVHGFATRFYTDEGNFDIVGNNIPVFFIQDAIQFPDLIHAVKPKGDREIPQAATAHDAAWDFFSQQPSTLHTLLWAMAGHGIPRSFRHVDGFGVHTFRLVTEDGSTKLVKFHWKTLQGLASMVWEEAQQISGKNPDYMRQDLFESIEAGRYPEWELNVQIMDEEDQLRFGFDLFDPTKIVPEEYVPLTPLGKMTLNRNPRNYFAETEQVMFQPGHVVRGVDFTEDPLLQGRLFSYLDTQLNRNGGPNFEQLPINQPRVAIHNNNRDGAGQMFIPLNPDAYSPNTLKGSTLKQANQTAGRGFFTAPDRTANGNLVRAKSSTFDDAWSQPRLFWNSLLPAEKQFVVNAIRFENANVKSDVVKNNVIVQLNRISNDLATRVAKAIGVDAPEPDNTYYHDNTTSNIGAFGHRLQSLAGLKIAVLASVDAEESFSAATALKAELSNDNLDVIVVAERFSNGVNQTYSASDAIQFDAVVVAPGAEKLFGAKSAANSSSTLYPAGRPLEILVDAFRFGKPVAALGSGSTAFDNAGINTAVEGVYVADAVDESFANNLEEGLTVFKFLDRFALDSDE

SEQ ID NO: 7200 - protein, 540 aa, Oryza sativa
MLMATVSPARREPTPQAVRASPMPSAAAALVRRGGGGSGGTVLGKYELGRVLGQGSFAKVYQARHLETDECVAIKVLDKEKAVKGGMVHLVKREINVLRRVRHPNIVQLFEVMASKTKIYFVMEYVRGGELFSRVSKGRLREDTARRYFQQLVSAVDFCHARGVFHRDLKPENLLVDENGDLKVSDFGLAAGPDQFDPDGLLHTFCGTPAYVAPEVLRRRGYDGAKADIWSCGVILFALMAGYLPFHDHNIMVLYRKIYNGEFRCPRWFSKDFTRLITRLLDANPKTRITVPEIIESDWFKKGYKPVKFYIEDDKLYNLSDDVLNLEPADPVPPPLGLAPPVPPPPQGDDPDGSGSESDSSVVSCPATLSTGESQRVRGSLPRPASLNAFDIISFSKGFNLSGLFEERGNEIRFVSGEPMSDIVKKLEEIAKVKSFTVRRKDWRVSIEGTREGVKGPLTIGAEIFELTPSLVVVEVKRKAGDNEEYEDFCNMELKPGMQHLVHQMLPAPNGTPVSEKVERSSSLQAPLTLKLIGTEGSMS

SEQ ID NO: 7201 - protein, 487 aa, Streptomyces coelicolor
MPENNQKPLTTVAGAPVPDNQNSLTSGPRGPMLLQDVWFLEKLAHFDREVIPERRMHAKGSGAFGTFTVTHDITRYTSAKIFSEIGKKTPLFTRFSTVAGERGAADAERDIRGFAVKFYTDEGNWDLVGNNTPVFFFRDPLKFPDLNHAVKRDPRTNLRNAENNWDFWTNLPEALHQVTIVMSDRGIPASYRHMHGFGSHTYSLINAEGERFWVKFHHRTQQGIKNLTDAEAEALVGKDRESHQRDLFDAIEDGDFPKWKLFIQVMPEADAENYRFHPFDLTKVWSKKDYPLIEVGEWELNRNPDNYFADVEQAAFSPANVVPGISFSPDRMLQGRLFSYGDAQRYRLGVNHHQIPVNAPKNPVNSYHRDGAMRVDGNQGATPGVEPNSYGRWQEQPAYRDPAQAVGAVADRFNYREDDDNYFEQPGNLFRQMSPEQQQVLFENTARAIDGASAQTIERHIGNCTQADPAYGAGVRKAIEALAAGNL

SEQ ID NO: 7202 - protein, 467 aa, Unknown
  Synechocystis sp. PCC 6803
MVHKKIDLNQLSEAESLLTPTYAARGLANSVSKYEMPETEMLPAIAYNLIHDELGLDGNSRLNLATFVTTWMEPEARQLMADTFDKNMIDKDEYPQTAEIELRCVNILSRLWNAPASAEATGCSTIGSSEAAMLGGMAMKWKWRQRRQAAGKPGDRPNLVMGINVQVCWEKFCRYWEVEPRFVPMEGDRYHISPEEAVKLIDENTIGVIGILGSTFDGSYEPIEALNDALETLNQRTGWQVPLHIDAASGGFIAPFLDPDLRWDFRLPWVKSINTSGHKYGLVYPGVGWIIWRDKEELPEELIFHCNYLGGDLPNFALNFSRPGNQVVAQYYNFLRLGKEGYRKIQQTCRDTALYLSGKIAQLGPFELLTDGGDIPVFAWRLKDEVLANTCYTLYDMADKLRERGWLVPAYRMPKNREDLVVQRIVVKEGFSRDMADLLLADMERAIAYFASQPDHKPKQEGSHFSH

SEQ ID NO: 7203 - protein, 644 aa, Streptomyces coelicolor
MCGIAGTYHWPDGKAVTDRLTDVLAHRGPDGAGRYSHPAGEGEVHLGHRRLAVVDLSTTGAQPMVSEGLALSYNGELYNAPELRTELESAGVRFRGTSDTEVVLEAWRRWGTDCLPQLRGMFAFAVFDERTGELVLARDQLGIKPLFLLRRGAGLVFASELKALATATGGKLEVDHAALVASLLYYWVPDSRCALREAEKLPPGSWLRCRPDGRVERGRFWNLRDVAAEGRERARSGERPDLAAVVEESTRRHLLSDVPVATFLSGGLDSSYLTALAARDRPGISAYTIGFRAEDARFEAMPDDLRYARQVAERFGVDLHEIEIAPNVLDLLPRMTYHLDEPIGDPAAINTFLICSAAREAGVKVMLSGMGADELFAGYRKHLANVLALRYQRVPRPLRRGVSAAVGRLPVASSRRGYRSVRFAKRFLSFADLPQETAFRRSYTMYDRQELLDLIDPDLAGTVEDVLTEHADVYEDNDLDDFVNRMCLADARMFLPGLNLAYTDRSSMAASTEVRVPYVDVEVVKAAFAVPGDRKIVGRQGKAVLKEAATSVLPREIVYRPKGLFSAPLRAWMSRDLAPLVREVVNDGELVRSGFLRRDALRRLVAEDAAGQRDFSKHLWHVLTLEYWYRGATSGSGDHSSSTA

SEQ ID NO: 7204 - protein, 443 aa, Oryza sativa
MPPSTGSVPPAASTPAAGDEATAAGRVLLGRYELGGLLGRGASAKVYLARDLLTGRDVAIKSFPNPRHGGGLRGGEEDVLLRPAPIEREAAILPRLRHRHVMRLREILATRKKVHFVLDLAAGGELFSLLDASGRMTEDLARHYFRQLISAVRYCHSRGVYHRDIKPENLLLDDAGDLKVADFGLGAVADGALHHTLCGTPAYVAPEILSRKGYNPAKVDIWSCGVVLFVLAAGYLPFNDASLVNMYRKIYAGKFRCPAWFSPELRCLVRRILDPNPATRIDTEEIITHPWFRQDASHFAMAQLMQHGHDEEAKFKTEFKEDDMARDMTAFDILACSPGSDLSGLFGAEPGKERVFVGEPAAAVLSRVEEAGKKEGYMVTREGKKGTGPVYVKGENGGIVAKVCVFKIADAVSVVEVVKGYGAEAARFWKARLEPAMKPPAAI

SEQ ID NO: 7205 - protein, 279 aa, Bacillus thuringiensis
MKNLQSKAVLNNGVEMPWFGLGVFKVEEGPELVEAIKTAIKAGYRSIDTAAIYGNEKAVGEGIRAGIEATGISREDLFITSKVWNADQGYETTIAAYEESLKKLGLDYLDLYLVHWPSEGKYKDTWRALETLYKEKRVRAIGVSNFQIHHLQDVMKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 7206 - protein, 305 aa, Corynebacterium efficiens
MSIVGTGNFFGSPEEERDRLVQALQGGKRQTTKPAEIPTVRLNDGNKIPQLGFGVFKVDPAETERVVSEALEAGYRHIDTAAFYNNEEGVGRAIAASGIPREELFVTTKLWPTRFDDAEAGFNESLEKLGMEYVDLFLLHWPAPRNNNFVQAWKVLEQLGERARSIGVCNFLPEHLRQLIDETTIVPAVNQFELHPALQQRDIQEASKAAGIAIESWGPLGQGKYDLSKEAPIAAAARSHGKTLAQVVIRWHLQHGFIVFPKTVNPERMRENLDVLDFELTAEEMVAIDNLERGARGGSHPNDIN

SEQ ID NO: 7207 - protein, 493 aa, Zea mays
MVLSHGVGGSDESVHSTFASRYVRTSLPRYRMPEQSIPKEAAYQIINDELMLDGNPRLNLASFVTTWMEPECDKLIQASVNKNYVDMDEYPVTTELQNRCVNMIAHLFNAPLGDAETAVGVGTVGSSEAIMLAGLAFKRRWQNKMKAAGKPCDKPNIVTGANVQVCWEKFARYFEVELKEVKLSDGYYVMDPQKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRTKEDLPEELIFHINYLGADQPTFTLNFSKGSSQVIAQYYQLIRLGFEGYKNIMENCQENATVLKQGLEKTGKFNIVSKDNGVPLVAFSLKDSSRHNEFEISDFLRRFGWIVPAYTMPPDAQHVTVLRVVIREDFSRTLAERLVLDIEKVLHELDALPARVPSGDLAALAAAESSEREMEKQRQVISLWKRAVLAKKKTNGVC

SEQ ID NO: 7208 - protein, 364 aa, Unknown
  Malus x domestica
QMGLAENQPCFDLIQEWMVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESSNNFKVTKEALEEAYKKAQESNIKVKGLLINNPSNPLGTILDKETLKDILRFINDKNIHLVCDEIYAATALCQPSFISISEVMNEVVGCNDDLVHIVYSLSKDLGFPGFRVGIIYSYNDVVVNIARKMSSFGLVSTQTQRLIASMLSDTIFVENFIAKSAMKLSQRHDLFTKGLGQVEITTLKSNAGLFIWMDLRRFLENSTFDDELKLWHIIINKVKLNVSPGCSFHCSEPGWFRVC

SEQ ID NO: 7209 - protein, 275 aa, Xylella fastidiosa
MRDPFDMEAERQAWSHSMRLTPLPAFDNNYIWTLIAPDGRAIIVDPGQALPILEAHSKGLIPTAILLTHHHADHIGGVPELLERWPTLPVYAPHDTRIALNYHRIGEGDSLNILGLRFQIIHTPGHTHSHLTFIGNDLLFCGDTLFSLGCGQIFEGTPTQMLASLQRLAALPIQTRVCCGHEYTLSNAAFALHVDPTNTALQKRRQQANAMRLAGLPTLPISLESELNTNPFLRTAAPTIHAATATHLQRTPIDEVEVFATLRHWKNNFPIKNIP

SEQ ID NO: 7210 - protein, 446 aa, Unknown
  Malus x domestica
MAIDIEQRQQPSPGLSKIAVSDTHGEDSPYFAGWKAYDENPYHESSNPSGVIQMGLAENQVSFDLLEKHLEENSEASNWGSKGSKGASGFRENALFQDYHGLLSFRKAMANFMEQIRGGRAKFDPVRVVLTAGATAANELLTFIIADPGDALLVPTPYYPGFDRDLRWRTGVNIVPIHCESSNNFQITPQALEAAYKEAEAKNMRVRGVLITNPSNPLGATIQRAVLEEILDFVTQKNIHLVSDEIYSGSAFSSSEFISVAEIIEDRQYKDAERVHIVYSLSKDLGLPGFRVGTVYSYNDKVVTTARRMSSFTLISSQTQHLLASMLSDKEFTGNYIKTNRKRLRTRYDMIIEGLKKSGIECLKGNAGLFCWMNLSPFLDEPTRECELTLWDSMLHEVKLNISPGSSCHCSEPGWFRVCFANMSEQTLGIALTRIHNFMEKRERAC

SEQ ID NO: 7211 - protein, 341 aa, Beta vulgaris
MDHAADATRTDLMTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 7212 - protein, 755 aa, Prochlorococcus marinus
MSTSINIDWLANEGQKLAECRHDNPLGVLGPQQIENKWALRVWMPEADAVNLLLKDGKKKLTNPNHPWIFETSLEENPGSSYQISVERAGISHTQNDPWAFRHEWMGEIDRHLFAEGNHHHIWRRMGAHQTKLDLVEGVMFCLWAPNARSVSVIGDMNSWDGRHHPMQKRLGGIWELFIPHIKKGDLYKYEIRSQEGHCYEKADPYGFQHEVRPAQSSIVSTLDSYKWKDQKWMTQRDKTDQLNKPISVYEMHLGSWMHSSNKTPYIEKDGSTREPVPAADLKPETRFLTYPELTEKLIPYVKARGFTHIELMPISEHPFDGSWGYQVTGWYAPTSRYGTPDEFRAFVDTCHSEGIGVILDWVPGHFPKDEHGLAFFDGKHLYEHADPRIGEHKEWGTLIFNYSRNEVRNFLVANLVYWFEQFHIDGIRVDAVASMLYKDYLRPEGEWIPNEDGGNENFEAVNFLQQANHVLFQHFPGALSIAEESTTWSGVTKPTDMGGLGFNLKWNMGWMHDMLDYFEIDPWFRQFHQNNVTFSICYNYTENFMLSLSHDEVVHGKSHLLHKMPGDDWKKYANTRALLAYMWTHPGKKTLFMGMEFGQRQEWNVWDDLQWELLEHDPHKGIQLLIDDLNCLYKSQPALWKDDFNEYGFQWIDCKDNTNSVISFMRRESSTGEWLVVVANFTPETHANYKVGVPVSGYYAEIFNTDAKKYGGSNTGNLGGKYSTEWNIHEYENALELSLPPLSVLILKYRKNKK

SEQ ID NO: 7213 - protein, 488 aa, Listeria monocytogenes
MTDRKNLTTNQGVPVGDNQNSMTAGRKGPTLIEDYVLIEKLAHFDRERVPERVVHARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREIRGSSVHAFKWINEEGKTVYVKLRWIPKAGIVNLSTEQASQIQAKEFNHASRDLYEAIENGDYPEWDLYVQVLDPKDLDNFDFNPLDATKDWFEDVFPYEHVGTMTLDRNPDNIFAETESVGFNPGVLVRGMLPSEDRLLQGRLFSYSDTQRHRVGQNYLQLPINSPKAPVANNQRDGHMPFKQQTSSINYEPNSYDTEPKENPAFIEPEQEIRGDISGRLIAEKPNNFGHAKEVWDRYSDAERAALVKNIVDDWSQVRDDIKIRNLRNFYQVDPEFASRVAAGTGVNLEAHVADLK

SEQ ID NO: 7214 - protein, 593 aa, Pinus sylvestris
MCGILAVFGCLDASQAKRVRVLELSRRLRHRGPDWSGLYQSGHSFLAHQRLAIVDPASGDQPLYNEDRQIVVTVNGEIYNHEKLREQLKSHKFRTGSDCEIVAHLYEDYGEEFVNMLDGMFSFVLLDTRDQSFIAARDAFGITPLYIGWGFDGSVWFASEMKALHDDCESFESFPPGHIYSSKQGGLRRWYNPPWYSENVIPSSPYDPLVLRRAFEKAVIKRLMTDVPFGVLLSGGLDSSLVAAVASRYLAATKAGKQWGDKLHSFCVGLKGSPDLKAAKEVAEYLGTVHHEFHFTVQDGIDAIEDVIYHVETYDVTTIRASTPMFLMSRKIKSLGVKMVLSGEGSDEIFGGYLYFHKAPNKEEFHQETCRKIKALHMYDCLRANKSTSAWGVEARVPFLDKEFVNVAMDIDPERKMVKPDIGRIEKWVLRRAFDDEQNPYLPKHILYRQKGQFSDGVGYSWIDGLKSHAAEHVTDTMLRNAKYIFPHNTPTTKEAYYYRMIFERFYPQNAARLTVPGGPSVACSTAKAVEWDAAWAHNLDPSGRAALGVHASAYQECNAGANDGTGNGNVNTFSKMPGREASVDAREVLIKG

SEQ ID NO: 7215 - protein, 509 aa, Zea mays
MVLSHGVGGSDESVHSTFASRYVRTSLPRYRMPEQSIPKEAAYQIINDELMLDGNPRLNLASFVTTWMEPECDKLIQASVNKNYVDMDEYPVTTELQNRCVNMIAHLFNAPLGDAETAVGVGTVGSSEAIMLAGLAFKRRWQNKMKAAGKPCDKPNIVTGANVQVCWEKFARYFEVELKEVKLSDGYYVMDPQKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRTKADLPEELIFHINYLGADQPHFTLNFSKVTSRQANLVMAHKTISGSSQVIAQYYQLIRLGFEGYKNIMENCQENATVLKQGLEKTGKFNIVSKDNGVPLVAFSLKDSSRHSEFEISDFLRRFGWIVPAYTMPPDAQHVTVLRVVIREDFSRTLAERLVLDIEKVLHELDALPARVPSGDLAALAAAESSEREMEKQRQVISLWKRAVLAKKKTNGVC

SEQ ID NO: 7216 - protein, 238 aa, Arabidopsis thaliana
MALETLTSPRLSSPMPTLFQDSALGFHGSKGKRSKRSRSEFDRQSLTEDEYIALCLMLLARDGDRNRDLDLPSSSSSPPLLPPLPTPIYKCSVCDKAFSSYQALGGHKASHRKSFSLTQSAGGDELSTSSAITTSGISGGGGGSVKSHVCSICHKSFATGQALGGHKRCHYEGKNGGGVSSSVSNSEDVGSTSHVSSGHRGFDLNIPPIPEFSMVNGDEEVMSPMPAKKLRFDFPGKP

SEQ ID NO: 7217 - protein, 507 aa, Xanthomonas campestris
MRPGSLMVLALLAPTLIAPPVFAQSVLTRDNGAKVGDNQNSQTAGATGPTLLQDVQLIQKLQRFDRERIPERVVHARGTGVKGEFTATADLSNLTKAKVFSAGEKTPVFVRFSSVVHGNHSPETLRDPHGFATKFYTSEGNWDLVGNNFPTFFIRDAIKFPDMVHAFKPDPRTNLDDDSRRFDFFSHVPESTRTLTLLYSNEGTPAGYRFMDGNGVHAYKLVNAQGEVHYVKFHWKTLQGIKNLDPKQVAAVQAKDYSHLTNDLVGAIKKGDYPKWDLYVQVLKPDDLAKFDFDPLDATKIWPDVPEQKVGQMVLNKNVDNFFQETEQVAMAPANLVPGIEPSEDRLLQGRIFSYADTQLYRIGTNGLSLPVNRPRVAVNNGNQDGEANTGHTTSGVNYEPSRLEPRPQDTAARYSELPLSGTTQQAKITLEQNFKQAGELYRSYSKKDRADLVQSFGESLATTDTESKHLVLSFLYKADPEYGAGVTRVAKGDLARVKQLASTLQD

SEQ ID NO: 7218 - protein, 733 aa, Gloeobacter violaceus
MNPTVELRDIEALVTNLHADPFAILGPHRAEDGGAWVVRTYQPGASRVVLLGESGELAMENRRHPDLFECAVPTAPGAYRLRVEDAWGERLIEDAYRFRGSLLSDLDGHLFAEGNHHRIYEKLGAHPAVFEGVAGVYFAVWAPSARNVSVLGDFNRWDGRFHQMRRVERSTGIWELFIPELGEGTVYKFEIKNGFGHIYEKSDPYAFQQELRPKSGSVVADLDRYSWNDGEWLKRRALSNPLKQPLAIYEVHLGSWMRVPEEGDRFLSYTELADKLIPYVKDLGFTHIELLPILEHPFDGSWGYQVLGYYAPTSRFGNPTEFMAFVDRCHQSGIGVILDWVPAHFPKDGHGLALFDGTHLYEHADSRQGEHKEWGTLVFNYGRNEVRNFLIANALFWFERYHIDGIRVDAVAAMLYLDYSRHDGEWVANRYGGRENLEAIGFLRQLNELIFLYYPGALSIAEESTAWPLVTRPPYLGGLGFNLKWHMGWMHDTLAYFRTDPLFRRYRHNDITFSITYTFYENFVLALSHDEVVHMKGSIIGKMPGDGWQKFANLRALFTFMYGHPGKKTLFMGMEFAHGREWNAYQSLDWHLLDYPQHRQMQQFVRALNRLYTGQPALYEEDCNPAGFFWVDCHDVLNSVFTFVRRGKDPSEQLLFVCNFTPTYHPHYRVGVLETGFWQEIFNSDSGIYGGSNKGNLGGLWSENWAIHGQPYSLGLQLPPLGCLVFKRRKEQD

SEQ ID NO: 7219 - protein, 547 aa, Legionella pneumophila
MAKELRFGDDARLQMLAGVNALADAVQVTMGPRGRNVVLEKSYGAPTVTKDGVSVAKEIEFEHRFMNMGAQMVKEVASKTSDTAGDGTTTATVLARSILVEGHKAVAAGMNPMDLKRGIDKAVLAVTKKLQAMSKPCKDSKAIAQVGTISANSDEAIGAIIAEAMEKVGKEGVITVEDGNGLENELSVVEGMQLIAVHSPYFINNQQNMSCELEHPFILLVDKKVSSIREMLSVLEGVAKSGRPLLIIAEDVEGEALATLVVNNMRGIVKVCAVKAPGFGDRRKAMLQDIAILTKGQVISEEIGKSLEGATLEDLGSAKRIVVTKENTTIIDGEGKATEINARITQIRAQMEETTSDYDREKLQERVAKLAGGVAVIKVGAATEVEMKEKKARVEDALHATRAAVEEGIVAGGGVALIRAQKALDSLKGDNDDQNMGINILRRAIESPMRQIVTNAGYEASVVVNKVAEHKDNYGFNAATGEYGDMVEMGILDPTKVTRMALQNAASVASLMLTTECMVADLPKKEEGVGAGDMGGMGGMGGMGGMM

SEQ ID NO: 7220 - protein, 526 aa, Xanthomonas campestris
MTAIQRGFTAASRIIQPAPRCGASSLFSECFMRVAVLSVALSLALFASPGWAQQASPAAAPATADDPEANEAAVSKVPLDEIRRFVAVYNAVKQAYVDPVEDKKLMHAAVRGLLSDLDPHSTYFDKEDAEAFDEQATGAYDGIGVELLQQQDNTLKVIAPIDDTPAARAGVKAGDVIVAIDGKPIDASKAMEPLRGESGSKVTLTIVRDKVAKPFDITLQRETIRVASVRSKLLEPGYGYIRISTFQADTGADFQKNLKQLQAGGKLRGLVLDLRSNPGGLLTSAVQVADDLLDKGNIVSTRGRISISDAKFDATPGDLLGGAPVVVLVDAGSASASEVLAGALRDNQRARIIGSRTFGKGSVQTVLPLDNGDSVKLTTARYYTPSGKSIQASGIVPEVMLTPEPQPGDADVPASLTDFSEATLPGHLRGDAEGEEGYSAGDVLPGDGPINEALAELKQPGSVAKAQAARKAKAQAQKPKAIKPTPEPKPAAPRPPASEQTTPSEPTDKAKPAAPAPAAVPAEPVK

SEQ ID NO: 7221 - protein, 369 aa, Avena sativa
MDGAPVAEFRPTMTHGGRFLLYNIFGNQFEITSKYQPPIMPIGRGAYGIVCSVMNFETREMVAIKKIANAFDNNMDAKRTLREIKLLRHLDHENIVGLRDVIPPSIPQSFNDVYIATELMDTDLHHIIRSNQELSEEHCQYFLYQLLRGLKYIHSANVIHRDLKPSNLLLNANCDLKICDFGLARPSSESDMMTEYVVTRWYRAPELLLNSTDYSAAIDVWSVGCIFMELINRAPLFPGRDHMHQMRLITEVIGTPTDDDLGFIRNEDARRYMRHLPQFPRRPFPGQFPKVQPAALDLIERMLTFNPLQRITVEEALEHPYLERLHDVADEPICTDPFSFDFEQHPLTEDQMKQLIFNEALELNPNFRY

SEQ ID NO: 7222 - protein, 362 aa, Oryza sativa
MDRAALTVGPGMDMPIMHDGDRYELVRDIGSGNFGVARLMRSRADGQLVAVKYIERGDKIDENVQREIINHRSLRHPNIIRFKEVILTPTHLAIVMEYASGGELFERICNAGRFSEDEARFFFQQLISGVSYCHSMQVCHRDLKLENTLLDGSTAPRLKICDFGYSKSSVLHSQPKSTVGTPAYIAPEVLLKKEYDGKIADVWSCGVTLYVMLVGAYPFEDPDEPKNFRKTIQRILGVQYSIPDYVHISPECRDLIARIFVANPATRISIPEIRNHPWFLKNLPADLMDDSKMSSQYEEPEQPMQSMDEIMQILAEATIPAAGSGGINQFLNDGLDLDDDMEDLDSDPDLDVESSGEIVYAM

SEQ ID NO: 7223 - protein, 255 aa, Glycine max
MGRGRVELKRIENKINRQVTFAKRRNGLLKKAYELSVLCDAEVALIIFSNRGKLYEFCSSSSMLKTLERYQKCSYGAVEVSKPAKELEQSSYREYLKLKARFESLQRTQRNLLGEDLGPLNIKELEHLERQLDSSLKQVRSTKTQFMLDQLSDLQTKEQMLVEANRSLTVKLEEINSRNHYRQSWEAGDQSMPYGGGGPENSHSHSHSQGFFQPLECNPTLHIGPDYRYNAVASDQITATTQPQQVSGFIPGWML

SEQ ID NO: 7224 - protein, 505 aa, Staphylococcus warneri
MSKQDGKLTGLFGAPVSDRENSMTAGPRGPLLMQDIYFLEQMSHFDREVIPERRMHAKGSGAFGTFTVTNDITQYTSAKMFSEVGKQTEMFARFSTVSGERGAADAERDIRGFALKFYTEDGNWDLVGNNTPVFFFRDPKLFVSLNRAVKRDPRTNMRSAQNNWDFWTGLPEALHQVTILMSDRGIPKDLRHMHGFGSHTYSMYNDKGERVWVKYHFRTQQGIENLTDEEAANVIATDRDSSQRDLFNAIENGDYPKWKMYIQVMTEEQARNHKDNPFDLTKVWYHGDYPLIEVGEFELNRNPNNYFQDVEQAAFAPTNIVPGLDYSPDKMLQGRLFPYGDAQRYRLGVNHWQIPVNQPKGVGIENLCPFSRDGQMRILDDNQGGGPHYYPNNQGVYDSQPEFKKPPFPADGDGYEYNQRQDDDNYFEQPGKLFRLQSDEAKERIFTNTANAMDGVTEDVKRRHIRHCYKADPDYGKGVAKALGIDINSIDLEGEQDETYENFKN

SEQ ID NO: 7225 - protein, 637 aa, Unknown
  Petunia x hybrida
MMESCDCIEALLPHDDLLVKYQYLSDFFIAFAYFSIPLELVYFVHKSSCFPYRWVLMQFGAFIVLCGATHFISLWTFFMHSKTVAVVMTITKMLTAVVSCITALMLVHIIPDLLSVKTRELFLKARAEELDKEMGLIIRQEETGRHVRMLTHEIRSTLDRHTILKTTLVELGRTLDLAECALWMPCQGGLNLQLSHNLNNLLPLGSTVPTNLPIVNEIFSTTQAIQIPHTNPLARMRTTAGRYIPPEVVAVRVPLLHLSNFHINDWPELSARSYAVMVLILPMNGLRKWRDHELELVQVVADQVAVALSHAAILEESMRAHDQLMEQNIALDVARQEAEMAVRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPVLAVGDAKRLIQTLLNVAGNAVKFAKEGHISIEASVAKPEYARDSHPPEVYPMPSDGQFYLRVQVRDSGCGISPQDIPLVFTKFAEAQSTSNRSTGGAGLGLAICRRFIQLMKGNIWIESEGLGKGTTVTFVVKLGVCNHPNAMPLLPTVPRSRLNQGSDDLFRYRQFHGDDSAMSVTVQRYQRSL

SEQ ID NO: 7226 - protein, 483 aa, Bacillus subtilis
MSSNKLTTSWGAPVGDNQNSMTAGSRGPTLIQDVHLLEKLAHFNRERVPERVVHAKGAGAHGYFEVTNDVTKYTKAAFLSEVGKRTPLFIRFSTVAGELGSADTVRDPRGFAVKFYTEEGNYDIVGNNTPVFFIRDAIKFPDFIHTQKRDPKTHLKNPTAVWDFWSLSPESLHQVTILMSDRGIPATLRHMHGFGSHTFKWTNAEGEGVWIKYHFKTEQGVKNLDVNTAAKIAGENPDYHTEDLFNAIENGDYPAWKLYVQIMPLEDAKTYRFDPFDVTKVWSQKDYPLIEVGRMVLDRNPENYFAEVEQATFSPGTLVPGIDVSPDKMLQGRLFAYHDAHRYRVGANHQALPINRARNKVNNYQRDGQMRFDDNGGGSVYYEPNSFGGPKESPEDKQAAYPVQGIADSVSYDHNDHYTQAGDLYRLMSEDERTRLVENIVNAMKPVEKEEIKLRQIEHFYKADPEYGKRVAEGLGLPIKKDS

SEQ ID NO: 7227 - protein, 833 aa, Saccharomyces cerevisiae
MNNAANTGTTNESNVSDAPRIEPLPSLNDDDIEKILQPNDIFTTDRTDASTTSSTAIEDIINPSLDPQSAASPVPSSSFFHDSRKPSTSTHLVRRGTPLGIYQTNLYGHNSRENTNPNSTLLSSKLLAHPPVPYGQNPDLLQHAVYRAQPSSGTTNAQPRQTTRRYQSHKSRPAFVNKLWSMLNDDSNTKLIQWAEDGKSFIVTNREEFVHQILPKYFKHSNFASFVRQLNMYGWHKVQDVKSGSIQSSSDDKWQFENENFIRGREDLLEKIIRQKGSSNNHNSPSGNGNPANGSNIPLDNAAGSNNSNNNISSSNSFFNNGHLLQGKTLRLMNEANLGDKNDVTAILGELEQIKYNQIAISKDLLRINKDNELLWQENMMARERHRTQQQALEKMFRFLTSIVPHLDPKMIMDGLGDPKVNNEKLNSANNIGLNRDNTGTIDELKSNDSFINDDRNSFTNATTNARNNMSPNNDDNSIDTASTNTTNRKKNIDENIKNNNDIINDIIFNTNLANNLSNYNSNNNAGSPIRPYKQRYLLKNRANSSTSSENPSLTPFDIESNNDRKISEIPFDDEEEEETDFRPFTSRDPNNQTSENTFDPNRFTMLSDDDLKKDSHTNDNKHNESDLFWDNVHRNIDEQDARLQNLENMVHILSPGYPNKSFNNKTSSTNTNSNMESAVNVNSPGFNLQDYLTGESNSPNSVHSVPSNGSGSTPLPMPNDNDTEHASTSVNQGENGSGLTPFLTVDDHTLNDNNTSEGSTRVSPDIKFSATENTKVSDNLPSFNDHSYSTQADTAPENAKKRFVEEIPEPAIVEIQDPTEYNDHRLPKRAKK

SEQ ID NO: 7228 - protein, 479 aa, Oceanobacillus iheyensis
MENVTIKVPNNFMLGAAVSAWQTEGWIGKRDSQDSYLDIWYKNNKHVWHNGYGPAGATNFYQRYEEDIDYMKEIGLTHFRTSINWSRFLIDYENAIVDEEYAAYVDDVIEKLIQNGVEPMICLEHYEVPAVLFEKYGGWESKHVVELFVQYANKVFERYGDKVKHWFTFNEPIVVQTRVYLDAIRWPFEQSTKKWMQWNYNKVLATAKVVNLFKDLQLKDKNGAKIGVILNPEVTYARSTATHDQQAAKMYDLFFNRIFLDPSIKGEYPKELFDVMKKHGITFDFTEEELNLIKDNTVDYVGLNLYFPHRVKARTAGWNEQTPFHPAYYYEIFELPGKKMNPYRGWEIYPQIMYDMGIRMKEEYDNIEWFIAENGMGVENEKRFKDASNMIQDDYRIEFIREHLKWLLKAVEEGVNCKGYMLWAFTDNVSPMNAFKNRYGLVEIDLEDNRNRHLKKSAYWYKQLIESRKFEAENDENYK

SEQ ID NO: 7229 - protein, 469 aa, Vibrio fischeri
MKFAHDFLFGAATASYQVEGAWDQDGKGPTNWDEFTKIPGKTFEGTNGDVAVDHYNRYKEDIALMAEMGLESYRFSISWARIFPNGTGEINQKGIDFYNNLIDECLKYGIVPFVTLYHWDLPLALEKEGAWLNKATGDAYVEFAKLCFNEFGDRVKHFITFNETVVFCALGYMAGAHPPGIQNDPKKYFQATHNVFYAHAKAVIEYKKLNQFGEIGLSHVFSPAFGVDDSEESHFAAMHANQFSMNWFYDPILLGKYPEYVVKQLQEEGNLPDWTDEELQTIFEAAPLNDFMGLNYYQPQRVEKIQGDVEARTITRENSTGSPGNPSYDNVYRTVKMADKKYTKWDWEISPEGFVGGLEMLKEHYGQIKLYITENGLGDEDPIIEGEVCDIPRINFIKEHLGAVKEAVRRGVHIKGYYAWSAIDLLSWLNGYKKQYGFIYVDHQNGLARKKKASFHWFKDVIATRGEDI

SEQ ID NO: 7230 - protein, 119 aa, Metrosideros excelsa
NKINRQVTFSKRRCGLLKKAHEISVLCDAEVALIVFSTKGKLFEYATDACMEKILERYERYSYAERQILTNNAETNGNWTLEHAKLKARMEILQKNQKNLMGEELDSLSLKELQNLEHQ

SEQ ID NO: 7231 - protein, 168 aa, Haloarcula marismortui
MVASLMVLYGPYTTLTIARSDRDVVQEHLLRDGHSERWGQFELPAEATVVGLAGKTGERSDAFNDIAQSFERDLKLRYGGATVADLAQVLEYGGLFGYPVTSGYPNGKLRVHFESAPLAYLVEAAGGASSDGSQSLLDVEPDGIHDRTPTFLGNAELVDELEAALSET

SEQ ID NO: 7232 - protein, 133 aa, Glycine max
MAAASLRKGNARLPPEVNRALFVRNLPFNISSEEMYDIFGKYGAIRQIRLGNAKDTRGTAYVVYEDIYDAKNAVDHLSGFNVANRYLIVLYSQLNRMSKKTDIKKKEDEITRLQEKYGVGSKTPPPTTPDPAR

SEQ ID NO: 7233 - protein, 204 aa, Hypocrea jecorina
MSDSPQSPPKDVDQGAQSPDEEGQMNDNQEPHSAGGTGYEFEGVKEQDRWLPIANVARIMKNALPDNAKIAKEAKECMQECVSEFISFITSEASEKCQQEKRKTVNGEDILFAMTSLGFENYAEALKVYLSKYREQQNQSNRDRVLENNTWGNAMIPGEKTEPGTTNPEYAPPEGANPPESGAEPNYMYTSHAGHNGAGAGENY

SEQ ID NO: 7234 - protein, 367 aa, Pseudomonas syringae
MNDLSKATDLFSPVQMGSIDLANRIVMAPVTRSRYAEDGVPKDLHATYYAQRATAGMIVAEATNISAQGRGYAATPGIWNEKQVAGWRKVTDAVHAAGGKIVSQLWHVGRFSGVDLQPGGEAPVAPSALQAEGNTYTVDGFVPVSMPRALETDEISGIIAQYRHAAENAKRAGFDGVEVHSANSYLLDQFLRDSTNQRTDHYGGSIENRARLTLEVTQAIVDIWGNDRVGIRLSPVTPDAGNTAPDSNVMGLHGYLIQQLNTLNLAYLHFVEGATATSREVPEGVDMDALSAQFHGPFIGNNNYDLEMAVERRAQGKIDAVAFGRLFISNPDLVARLFHGAELTIAPRESYYGGGAKGYTDWPLGQY

SEQ ID NO: 7235 - protein, 208 aa, Phytolacca americana
KRRNGLLKKAYELSVLCDAEVALVVFSSRGRLYEYANHSVKGTIERYKKACSDQSGAGSVAEANAQYYQQDSAKLRNQIRTITENNRLLSRHMMGEGLSSLTMKELKNLEGKLERGISRIRSKKNELLFAEIEFMQKREIELHNNNQFLRARIAENERAQQSMSLMPGGGDYELVPSQSFDSRNYFQVNALQPNNQYSRQDQTPLQLV

SEQ ID NO: 7236 - protein, 762 aa, Bergeriella denitrificans
MNRNRHIRRGYHPEAGERQIIDSLFAATHSDPFAYLGRHRVNDEREAVRVLRPDAHHIDIIDRHTGAVIMPSEKIDERGLFAAVLPEHAPDYALLVTYHEGEAAVREEDDYRFGSALQHTDAWLLGEGTHLRPYETLGAHFAEMDGVSGVRFAVWAPNARRVSVIGEFNGWDSRRHAMRPHTGNGLWDIFIPGVGLNALYKFSVLDANGNIREKADPYAFGAELRPTTASVVRGLPAKAEAPAFRRRANSVEAPISIYEVHLGSWRRNPENNYWLTYTQLADELVNYVKDMGFTHIELLPLSEYPFDGSWGYQATGLYAPTSRFGSPDELKALIDAAHAAGISVILDWVAGHFPTDDHGLNTFDGTALYEHADPREGYHQDWNTLIYNFGRNEVKNFLQGNALYWIERFGFDGIRVDAVASMIYRNYSRKDGEWIPNRYGGSENLEAIAFLRQTNAVLKSETPGAGSFAEESTSFADVTREAGLNFDFKWNMGWMNDTLRYMQEDPVHRKYHHGKMTFGMMYQYSENFVLPLSHDEVVHGKRSLLGKMPGDCWQQFANLRAYYGFMYGFPGKKLLFMGNEFAQGREWNYQEGLDWHLLDEAGGWHKGVQDYVRDLNHIYTAHAPLYQLDQQPEGFEWLVADDSDNSVFVFERRDRAGNRIIVISNFTPVVREHYRFGVNAPGRYTEILNSDRTQYQGSGIANGADITAENVPSHGKAQSLSLTLPPLATVYLYQKAAPATEIQTALRADKQPAVKDKQAKAK

SEQ ID NO: 7237 - protein, 192 aa, Thalictrum dioicum
KRRNGLLKKAYELSVLCEAEIALVVFSNRGRLYEYANNSVRKTIDRYKKTCGEGSSTLTVSEANLLFYQQESSKMKQQIEILQNSNRHLMGEALSCLSIKELKQLESRLEKGLSRIRSKKNEMLLAEIEYMQKKEIELHNDNIYLREQITVNEKAQQHINSMPGNVYEAITSAPYNSKPNQYGSDATFLQLC

SEQ ID NO: 7238 - protein, 365 aa, Pseudomonas syringae
MSEINKDVPALFNMGSLKLKNRFALAPMTRVSATEQGCATQAMARYYERFAKGGFGLIITEGNYTDRSFSQGYPFQPGLTDDEQALAWRATTDAVHRHGSAVIAQIMHAGALSQANRFVNEAAGPSAIRPKGEQMAFYYGEGRYRVPRAMSDKDIADTLDGFARATRRAVGAAGFDGVEIHGANGYLLDQFLTDYTNQRTDQWGGNVYQRLRLTLDVIAEVKKAAGQAPVGVRISQGKVNDFQHKWAGGERDAEVIFGALADAGVDYIHITEHQAWQPAFAQGEASLVRLARRYAPDVALIANGGLHDPEKAAQVFRDGADIIAVGKGALANPDLPRLLLEGGAIREFDPAILGPIANIKDSELG

SEQ ID NO: 7239 - protein, 690 aa, Sorghum bicolor
MSASSSSLCGGDPAMRSVVWFRRDLRVEDNPALAAAARAGGEVVPAYVWSPEEEGPYYPGRVSRWWISQSLKRLDASLRRLGAGKLVTRRSADAVVALLQLVRDTGATHVYFNHLYDPISLVRDHRLKEMLAAEGIVVQSFNADLLYEPWEVVDDEGQPFTMFTAFWNRCLSMQYDPPAPLLPPKKINSGDLSMCPSEDLIFEDDSERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVNESYFKIWRQGRTGYPLVDAGMRELWATGWLHDRIRVVVSSFFVKVLQLPWRWGMKYFWDTLLDADLESDALGWQYITGSLPDSRELDRIDNPQFEGYKFDPHGEYVRRWIPELVRLPTEWIHHPWDAPVSVLQAAGIELGSNYPLPIVELDAAKARLQEALSEMWQLEAASRATMNNGMEEGLGDSSEVPFPEELQMEVDRATANVVMTVRRREDQMVPTMTSSLNRAETEVSADLGNSEDTRAQVPFHAHFHPRVEREDMIQNTEGPALRINGTHQHNIFQQPQNHRREALAPSVSEASSSWTGREGAVVPVWSPPAASGHSETFAADEADVSSRSYLDRHPRSYRLMNWSQLSQSL

SEQ ID NO: 7240 - protein, 200 aa, Pyrococcus abyssi
MKVLVTGFEPFGGDDKNPTMEIVKFLDGKEIGGAKVIGRVLPVSFKRARKELVAILDEIKPDVTINLGLAPGRTHISVERVAVNIIDARIPDNDGEKPIDEPIVENGPAAYFATIPTREIVEEMKRNNIPAVLSYTAGTYLCNFVMYLTLHHSATKGYPRKAGFIHVPYTPDQVIEKKNTPSMSLELEIKGVEIAIRKSL

SEQ ID NO: 7241 - protein, 226 aa, Thalictrum dioicum
MGRGKIEIKRIENTTNRQVTFCKRRNGLLKKAYELSVLCEAEVALVVFSSRGRLYEYSNNSVKKTIERYKKASTDSPNSGSVYEANVQFYQQEASKMRNQIASLQNHNRNLLGESLSNLNIRELRQIEKKIEGGISKIRAKKNELLFSEIEYMQKREIDLQTDNKYLGAMIAANERVPPEHMNLMPANEYHIMSSAPFDSRNFLPANLLDHNNNYSHSDQTTLQLG

SEQ ID NO: 7242 - protein, 148 aa, Unknown
  uncultured soil bacterium
MALVPWTPMHNFAALQGQMNQLLNQFFRGGNGEEAPWGVSAWMPPVDLYETPDEFILSADLPGLTKDDIHLEVHDRTLTLRGERKPAAGMTEAHYQRRERAYGSFQRAFTLPTPVDTDKVQASMKDGILDLHLPKHEAAKPRRIAVQS

SEQ ID NO: 7243 - protein, 200 aa, Houttuynia cordata
NGLLKKAYELSVLCDAEVALVVFSSRGRLYEYANNSVKATIERYKKSNADSTNSGSVAESSSQYYQQESAKLRNQISQLQNAIGRLTPEGIASMNPREVTNAEKEILRSITKIRSKKNEVLSAEIEYMQKREIDLQNDNIYLRSKIAENERVHQHMNVMPGQQYEVMPAHPFDSRNFLEANLLEPNLHYSQQEQTALQLG

SEQ ID NO: 7244 - protein, 216 aa, Sanguinaria canadensis
IENTTNRQVTFCKRRNGLLKKAYELSVLCDAEVALIVFSNRGRLYEYANNSVKSTIERYKKTCQDPSNSGCAVEANTQFYQQEASKLRQQIGFLQNSNRNLTGEALSSMTVKELKQLETRLEKGISRIRSKKNELLFSEIEYMQKREIDLQNDNMYLRAKIAENERAQQHMNLMPGNEYDVMTSSAYDSRNFLQVNLLESTNHHYSRQEQTALQLG

SEQ ID NO: 7245 - protein, 458 aa, Streptomyces cattleya
MAGFLLRCRPEGAVPQHLGAGTGLATEVTRDGADVLVVHGDPLTPGGQAPIHAPLDELIAWTVRAYSRFCAVLVRDDRAVLWSDNGATCPLHYARGADDTLLVATSAGALLPLLGTAPVLGEGDRAVLPGGRFAGVTAVPAGTAVTLAVAGFDTEPLLTRRYHRLPARPTETDPERAVTAVRDALTHAVGRLATGLTEAGVMLSGGVDSSSVAALAAREVTSLSTYTVGTPFGDEFAQAAWFAERLGSKHHELVFEPEQLTALLPEMIRSLETWDLLTLQIAAPACFLLGHIATGARQVMLSGYGADLIFAGLGGTGTETRIERSVAAQTAATAVSNEFNPAYADARDVVVRYPYWTREVMSTALGIRGRLKVRPDTAKWVLRSAVTGILPDEVAWRPKRGIHEGTAMSRMFAAALGSDDRHTQARRLYEMATEVFRDTAAGTDELEGSDEGLAGVAS

SEQ ID NO: 7246 - protein, 92 aa, Brassica napus
TDKYGGSLENRCRFALEVVQAVADEIGADKVGIRLSPFASYSDASDSNPEALGLYMAQALNKLGILYCHMVEPRMVNIGEKLETPHSLRAMR

SEQ ID NO: 7247 - protein, 540 aa, Streptococcus anginosus
MAKDIKFSADARSAMVRGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIETAVATAVEALKANSVPVSNKEAIAQVAAVSSRSEKVGEYISEAMEKVGNDGVITIEESKGMETELDVVEGMQFDRGYLSQYMVTDNEKMVADLDNPYILITDKKISNIQEILPLLENILKTSRPLLIIADDVDGEALPTLVLNKIRGTFNVVAVKAPGFGDRRKAMLEDIAILTGGTVITEDLGLELKDATIEALGQASKVTVDKDSTVIVEGSGDAEAIANRVAVIKSQIESSTSDFDREKLQERLAKLSGGVAVIKVGAATETELKEMKLRIEDALNATRAAVEEGIVSGGGTAFVNVLSAVEALDLSGDEATGRNIVLRALEEPVRQIALNAGFEGSIVIDRLKNSEAGTGFNAATGEWVNMIDAGIIDPVKVTRSALQNAASVASLILTTEAVVANQPEPASPTPAMDPSMMGGMM

SEQ ID NO: 7248 - protein, 179 aa, Zea mays
MVLSHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQDPGTTNNGCKCWV

SEQ ID NO: 7249 - protein, 540 aa, Streptococcus constellatus
MAKDIKFSADARSAMVRGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIETAVATAVEALKANSVPVSNKEAIAQVAAVSSRSEKVGEYISEAMEKVGNDGVITIEESKGMETELDVVEGMQFDRGYLSQYMVTDNEKMVADLDNPYILITDKKISNIQEILPLLENILKTSRPLLIIADDVDGEALPTLVLNKIRGTFNVVAVKAPGFGDRRKAMLEDIAILTGGTVITEDLGLELKDATIEALGQASKVTVDKDSTVIVEGSGAAEAIANRVAVIKSQIESATSEFDKEKLQERLAKLSGGVAVIKVGAATETELKEMKLRIEDALNATRAAVEEGIVSGGGTAFVNVLNTVEALDLSGDEATGRNIVLRALEEPIRQIAINAGFEGSIVIDRLKNSEVGTGFNAATGEWVDMIEAGIIDPVKVTRSALQNAASVASLILTTEAVVASQPEPASPAPAMDPSMMGGMM

SEQ ID NO: 7250 - protein, 515 aa, Unknown
  Burkholderia sp. 383
MRMKLKNIGLIAAGLATGVFATLQVSASAEQTATAPLPLDQLRLFAEVFGQIKREYVEPVDDKKLLTAAIKGMVSSLDPHSSFLDKTDYDELQEQTKGRFAGLGIEISQEDGLVKVISPIEDTPAFRAGIRPGDLITRINDKPVRGMTLDKAVKQMRGEPGTKVTLTIFRKSDDRTFPVTVTRAIIKVQSVKMKILDPGYAYVRITSFQERTTPDLAQKLQDIARQQPNLKGLVLDLRNNGGGLLQSAVGVAGAFLPPDSVVVSTNGQIADSKQVYRDTYDNYRLPSFDGDPLKNLPPVFKTVPMIVLTNAYSASASEIVAGALQDSKRAQIMGKTTFGKGSVQTVRPMTADTALRLTTAYYYTPSGRSIQNKGITPDVPVDQYADGDPDDVLVTREVDYSNHLANTQDPNEKKEQEDREQRRMDQLRILEEQNDKKTPEQRQKDRDRKPIEFGSADDFMMQQALNKLEGKPVQESKSLLAESTTKSPAGKATASKASGASAKPAAAPKPASAPQ

SEQ ID NO: 7251 - protein, 682 aa, Salmonella enterica
MNTFFRLTALAGLLALAGQSFAVEDITRADQIPVLKEETQHATVSERVTSRFTRSHYRQFDLDEAFSAKIFDRYLNLLDYSHNVLLASDVEQFAKKKTVLGDELRTGKLDVFYDLYNLAQKRRFERYQYALKVLERPMDFTGNDTFNLDRSKAPWPKDEAELNALWDGKVKFDELSLKLIGKSDKEIRETLTRRYKFAIRRLAQTNSEDVFSLAMTAFAREIDPHTNYLSPRNTEQFNTEMSLSLEGIGAVLQMDDDYTVINSLVAGGPAAKSKSISVGDRIVGVGQAGKPMVDVIGWRLDDVVALIKGPKGSKVRLEILPAGKGTKTRIITLTRERIRLEDRAVKMSVKTVGKEKVGVLDIPGFYVGLTDDVKVQLQKLEKQNVNSIVIDLRSNGGGALTEAVSLSGLFIPSGPIVQVRDNNGKVREDSDTDGVVYYKGPLVVLVDRFSASASEIFAAAMQDYGRALIVGEPTFGKGTVQQYRSLNRIYDQMLRPEWPALGSVQYTIQKFYRVNGGSTQRKGVTPDIIMPTGNEETETGEKFEDNALPWDSIDAAKYVKSDDLAPFGPELLKEHNARIAKDPEFQYIMKDIARFNAMKDKRNIVSLNYAQREKENNEEDALRLARINDRFKREGKPLLKKLDDLPKDYQEPDPYLDETVKIALDLAHLEKEKPAEQAAADK

SEQ ID NO: 7252 - protein, 422 aa, Zea mays
  misc_feature (72)..(72): Xaa can be any naturally occurring amino acid
  misc_feature (214)..(214): Xaa can be any naturally occurring amino acid
MARRRPMDYEELNEKVKKAQYAVRGELYLRASELQKEGKKIIFTNVGNPHALGQKPLTFPRQTALHPVPVRXVVALCQAPFLLDDPNVGLMFPPDAIVRAKRYLAMAPGGLGAYSDARGIPGIRKEVADFIHKRDGYPSDPELIYLTDGASKGVMQILNTIIRNEMDGILVPVPQYPLYSATISLYGGSLVPYYLEEEANWSLDFVNIRQTVAXRAMVMINPGNPTGQCLSEANIKELLQFCYHENLVLLADEVYQQNIYQDERPFISARKVMFDMGPPISSELQVVSFHTVSKGYWGECGQRGGYFEMTNLPPKTVDEIYKVASIALSPNVPGQIFMGVMVNPPKPGDISYLKFAAERLNMLPLRSFSLPPVSTEKMDLCEIFKSIHESLRRRARMMTDGFNSCRNVVCNFTEGAMYSFPQ

SEQ ID NO: 7253 - protein, 225 aa, Meliosma dilleniifolia
MGRGKIEIKRIENTTNRQVTFCKRRNGLLKKAYELSVLCDAEVALIVFSTRGRLYEYANNSVKATIDRYKKACADTSNTGSVSEANAQFYQQESSKLRQQIVILQNSNRHLMGEALSAMTVKELKQLEGRLEKGISRIRSKKNEMLFAEIEYMQKREIDMQNDNMYLRAKIAENERAQQHMSMMPTSEYEAMPPQQFDSRNFLQVNLLEPNHHYSRQEQTALQLG

SEQ ID NO: 7254 - protein, 233 aa, Haemophilus somnus
MLIPIPALNDNYIWVYKRENLSVIVIDIPEIAALSQFIQAQNLVIGALLITHNHRDHIGALAEFKQFYPHVHIYGPAECADQGVTQVIDAGRLIIDEYHIDVLPTGGHTAQHLSFLIDGHLFCGDTLFSAGCGRVFTGDYSQMFTSLQLLKSLPDETIVCPAHEYTLGNLAFALTTGKNKSAVQKQLEKVKKLRAENKPSLPTTLALEKQINPFLQVESLDEFIELRKAKDVF

SEQ ID NO: 7255 - protein, 1028 aa, Zea mays
  misc_feature (600)..(600): Xaa can be any naturally occurring amino acid
SSQARILAQTTLDAELNAEYEESGDSFDYSKLVEAQRSTPPEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMQALCNTVVKEVFDLTGYDRVMAYKFHEDEHGEVFAEITKPGIEPYLGLHYPATDIPQAARFLFMKNKVRMICDCRARSVKIIEDEALSIDISLCGSTLRAPHSCHLQYMENMNSIASLVMAVVVNENEDDDEPESEQPPQQQKRKKLWGLIVCHHESPRYVPFPLRYACEFLAQVFAVHVNKEFELEKQIREKSILRMQTMLSDMLFKESSPLSIVSGSPNIMDLVKCDEVHGDSTGLSTDSLQDAGYPGAASLGDMICGMAVAKITSKDILFWFRSHTAAEIKWGGAKHDPSDEDDSRRMHPRLSFKAFLEVVKMKSLPWSDYEMDAIHSLQLILRGTLNDALKPAQSSGLDNQIGDLKLDGLAELQAVTSEMVRLMETATVPILAVDGNGLVNGWXQKVADLSGLRVDEAIGRHILTLVEDSSVPIVQRMLYLALQGREEKEVRFELKTHGSKRDDGPVILVVNACASRDMHDHVVGVCFVAQDMTVHKLVMDKFTRVEGDYRAIIHNPNPLIPPIFGADQFGWCSEWNAAMTKLTGWHRDEVIDRMLLGEVFDSSNASCLLKSKDAFVRLCIIINSALAGEEAEKAPIGFFDRDGKYIECLLSVNRKVNADGVVTGVFCFIHVPSDDLQHALHVQQASEQTALRRLKAFSYMRHAIDKPLSGMLYSRETLKGTDLDEEQMRQVRVADNCHRQLNKILADLDQDNITDKSSCLDLDMAEFVLQDVVVSAQILSDFLFVSVKFSPAGGSVDISSKLTKNSIGENLHLIDFELRIKHQGAGVPAEILSQMYGEDNREQSEEGLSLLVSRNLLRLMNGDIRHLREAG

SEQ ID NO: 7256 - protein, 212 aa, Chloranthus spicatus
IENTTNRQVTFCKRRNGLLKKAYELSVLCDAEVALIVFSTRGRLYEYANNSIKSTIERYKKASADSSSTTSIAEANTQYYQQEASKLRQQIHILQNSNRHLMGDALSSLSIKELKQLENRLERGITRIRSKKHELLFAEIEYMQKREADLQNDNMYLRAKIAENENAQQANMLPGPEFDTLPTFDSRNYFQANILEAAPQYSHQDQTALHLG

SEQ ID NO: 7257 - protein, 416 aa, Arabidopsis thaliana
MGLFGTKKIGKYEIGRTIGEGNFAKVKLGYDTTNGTYVAVKIIDKALVIQKGLESQVKREIRTMKLLNHPNIVQIHEVIGTKTKICIVMEYVSGGQLSDRLGRQKMKESDARKLFQQLIDAVDYCHNRGVYHRDLKPQNLLLDSKGNLKVSDFGLSAVPKSGDMLSTACGSPCYIAPELIMNKGYSGAAVDVWSCGVILFELLAGYPPFDDHTLPVLYKKILRADYTFPPGFTGEQKRLIFNILDPNPLSRITLAEIIIKDSWFKIGYTPVYHQLSDSIKDNVAEINAATASSNFINAFQIIAMSSDLDLSGLFEENDDKRYKTRIGSKNTAQETIKKIEAAATYVSLSVERIKHFKVKIQPKEIRSRSSYDLLSAEVIEVTPTNCVIEISKSAGELRLYMEFCQSLSSLLTAEVS

SEQ ID NO: 7258 - protein, 213 aa, Chloranthus spicatus
IENTTNRQVTFCKRRNGLLKKAYELSILCDAEVALVVFSSRGRLFEYSNNSVKTTIDRYKKAHADSNSASVSEANTQFYQQEAAKLRQQLGILQNSNRHMMGESLSSMNIKELKSLEVKLEKGISRIRSKKNELLFSEIEYMQRREMDLQNDNMYLRSKIAENERAQQHMNVLPGPEYDVMPAFDGRNFLPVNLLGSNHHQFSHQDQTALQLG

SEQ ID NO: 7259 - protein, 435 aa, Unknown
  Malus x domestica
MRMLSRNATFNSHGQDSSYFLGWQEYEKNPYHEVHNTNGIIQMGLAENQLCFDLLESWLAKNPEAAAFKKNGESIFAELALFQDYHGLPAFKKAMVDFMAEIRGNKVTFDPNHLVLTAGATSANETFIFCLADPGEAVLIPTPYYPGFDRDLKWRTGVEIVPIHCTSSNGFQITETALEEAYQEAEKRNLRVKGVLVTNPSNPLGTTMTRNELYLLLSFVEDKGIHLISDEIYSGTAFSSPSFISVMEVLKDRNCDENSEVWQRVHVVYSLSKDLGLPGFRVGAIYSNDDMVVAAATKMSSFGLVSSQTQHLLSAMLSDKKLTKNYIAENHKRLKQRQKKLVSGLQKSGISCLNGNAGLFCWVDMRHLLRSNTFEAEMELWKKIVYEVHLNISPGSSCHCTEPGWFRVCFANLPERTLDLAMQRLKAFVGEYYNV

SEQ ID NO: 7260 - protein, 226 aa, Saruma henryi
MGRGKIEIKRIENTTNRQVTFCKRRNGLLKKAYELSVLCEAEVALIVFSSRGRLYEYANNSVRTTIDRYKKASDSSNPASVSETNSQYYQQEATKLRQQIGILQNANRHLMGESLSSMSVKELKQLETRLEKGISRIRSKKNELLFAEIEYMQKREVELQNDNIFLRGKIVENERAQQNMNMLPGGGGYEVMSQHPPYDSRNYLPVNLLEHNQHFSHQEPTALQLG

SEQ ID NO: 7261 - protein, 516 aa, Corynebacterium glutamicum
MSEKSAADQIVDRGMRPKLSGNTTRHNGAPVPSENISATAGPQGPNVLNDIHLIEKLAHFNRENVPERIPHAKGHGAFGELHITEDVSEYTKADLFQPGKVTPLAVRFSTVAGEQGSPDTWRDVHGFALRFYTEEGNYDIVGNNTPTFFLRDGMKFPDFIHSQKRLNKNGLRDADMQWDFWTRAPESAHQVTYLMGDRGTPKTSRHQDGFGSHTFQWINAEGKPVWVKYHFKTRQGWDCFTDAEAAKVAGENADYQREDLYNAIENGDFPIWDVKVQIMPFEDAENYRWNPFDLTKTWSQKDYPLIPVGYFILNRNPRNFFAQIEQLALDPGNIVPGVGLSPDRMLQARIFAYADQQRYRIGANYRDLPVNRPINEVNTYSREGSMQYIFDAEGEPSYSPNRYDKGAGYLDNGTDSSSNHTSYGQADDIYVNPDPHGTDLVRAAYVKHQDDDDFIQPGILYREVLDEGEKERLADNISNAMQGISEATEPRVYDYWNNVDENLGARVKELYLQKKA

SEQ ID NO: 7262 - protein, 196 aa, Unknown
  Nymphaea sp. EMK-2003
KRRNGLLKKAYELSVLCDAEVALIVFSSRGRLFEYANNNIKATIDRYKKACAESSNANSVTEANAQYYQQEATKLRQQIQILQNANRHLMGESLSNLSVKELKQLENKIERGITRIRSKKNELLFAEIEYMQKRELELQSDNMYLRAKVAESERAQHSNMLPGSDYETMQTFDSRNFFSVNMLQYSNQDQTALHLG

SEQ ID NO: 7263 - protein, 364 aa, Cupriavidus necator
MPEVQRMTLTQFLIEERRRYPDASGGFNGLILNVAMACKEIARAVAFGALGGLHGKASNQAGEAGAVNVQGEIQQKLDVLSNTTFLRVNEWGGYLAGMASEEMEAPYQIPDHYPRGKYLLVFDPLDGSSNIDVNVSVGSIFSVLRAPEGASAVTEQDFLQPGSAQVAAGYALYGPTTMLVLTVGNGVNGFTLDPNLGEFFLTHPNLQVPADTQEFAINASNSRFWEAPVQRYIAECMAGKSGPRGKDFNMRWIASMVAEAHRILMRGGVFMYPRDSKDPAKPGRLRLLYEANPIAFLMEQAGGRASTGRQTLMSVAPGALHQRIGVIFGSRNEVERIEGYHTDQTDPDLPSPLFNERSLFRASA

SEQ ID NO: 7264 - protein, 174 aa, Xanthomonas campestris
MPLTDLQHVPGATAAPADTQGFVFNHTMLRVKDAPRSLDFYTRVLGFRLLDARDFAEAKFSLYFLALLPEGTAVPDDDAARRLWMAGIPGVLELTHNHGTETQDGAVYHDGNSDPRGFGHICISVPDIHAACARFDSLGVPYQKRLEDGRMKHLAFIKDPDGYWVEIISNTPLA

SEQ ID NO: 7265 - protein, 930 aa, Yersinia pestis
MTKYSLRARMMILILAPTLLLGLLLSTSFMVNRYNELQNQIVSAGTNIIEPLAVASEYGMSFRNRDTVRQLINLLHRRHSNIVRSISVFDVDNKLFVTSNYNYNSSQLRLPPGEPVPDSLMLSYRGDSLILRMPIVSESNLSSEQASGQGESDQILGYIAIDLDLQSVRLKQYKEIFISTLLLLFCMCVAILFAYRLMRDVTGPIRNMVNTVDRIRRGQLDSRVEGHMLGELDILKNGINSMAMSLAAYHEEMQQNIDQATSDLRETLEQMEIQNVELGLAKKRAQEASRIKSEFLANMSHELRTPLNGVIGFTRQTLKTSLTPTQTDYLQTIQRSANNLLCIINDVLDFSKLEADKLILEHIPFSLRETLDEVIILLAHTAHEKGLELTLHINNDVPDQVLGDAMRLQQIVTNLLGNAIKFTEEGNIDILVVVKAIASQQVTLMVEIHDTGIGISESQQAQLFQAFRQADASTSRRHGGTGLGLVITERLVKEMGGNISFQSQMSCGSIFRFHLTLELNESIPYRQPDMAHLEGKQLAYIERNSTAARATINILNTTPLQVTHRQSLAQLPEQHYDFLLVGVPIPFRNNMAIHQDKLLTALKIADHVILALPSQSQVEAEQLKQIGAKDCLLKPISSIRLIPLLLAEDTHSKVPSEEQPRKQPKLPFRVMAVDDNPANLKLIGTLLEEQIEETVLCDSGAMAITYAREHTLDIILMDIQMPEIDGIRASEIIHQIPHHQETPIIAVTAHAVKGQQEQLLRLGMADYLAKPIDEARLLQVLSRYQSDNPPLSTASTASTASTASTAESLPLPVPKGAGVIDWAQAVRQAANKEDLARDLLTMLLEFMPQITARVQAILAGADDGDILNLVHKFHGSCACSGVPRLRQLCMTIELQLRQQVNLQDLEPEWLELLDEIENVSEAAKTYLRTE

SEQ ID NO: 7266 - protein, 548 aa, Haemophilus influenzae
MAAKDVKFGNDARVKMLKGVNVLADAVKVTLGPKGRNVILDKSFGAPTITKDGVSVAREIELEDKFENMGAQMVKEVASKANDAAGDGTTTATVLAQAIVNEGLKAVAAGMNPMDLKRGIDKAVSAVVSELKNLSKPCETAKEIEQVGTISANSDSIVGQLISQAMEKVGKEGVITVEDGTGLEDELDVVEGMQFDRGYLSPYFINKPETATVELDNPYLLLVDKKISNIRELLPVLEGVAKAGKPLLIIAEDVEGEALATLVVNTMRGIVKVAAVKAPGFGDRRKAMLQDIAILTAGTVISEEIGMELEKATLEDLGQAKRVVINKDNTTIIDGIGDEAQIKGRVAQIRQQIEESTSDYDKEKLQERVAKLAGGVAVIKVGAATEVEMKEKKDRVDDALHATRAAVEEGIVAGGGVALVRAAAKVAASLKGDNEEQNVGIKLALRAMEAPLRQIVTNAGEEASVVASAVKNGEGNFGYNAGTEQYGDMIEMGILDPTKVTRSALQFAASVAGLMITTECMVTDLPKDDKADLGAAGMGGMGGMGGMM

SEQ ID NO: 7267 - protein, 470 aa, Colwellia psychrerythraea
MLLWLRNDLRTHDNPALHYFLSRNALSQHDSAVPAKAIFFICEQQWQQHDWSPIKIDFIKRHAHALVKELALLNIELELIELDNFTQQKTYLHSYCQLHNITEVVANSEVEFNEQQRDKALYLELKASGIPLTLLEADVIVPKGKVLNQSGIMYKVFTPFKRAWLTYIQQGGFEYLGKVSVKSSAVNKADNQEEDQGSISSTWPLATVFEQQILPKFYQQKISTYKLNRDIPSIKGTSGISPYLAAGVISPRFVLRLLLNKHPDLLVASDSEEFSWLNEIIWREFYRHLLFHEQRLCKHQCYKENYQEMLWHNDAALFDAWCQGRTGYPLVDAAMRQLNQTGWMHNRLRMVVASFLTKHLLIDWRLGEKYFMQHLIDGDLASNNGGWQWAASTGCDAQPYFRIFNPIRQSERFDPKGVFIRKYIPELNNISDKAIHFPHQYIKDNELNIYWPAIVEHKEARLKALAFYKV

SEQ ID NO: 7268 - protein, 158 aa, Zea mays
MSLIRRSNVFDPFSLDLWDPFEGFPFGSGSSSSLFPSFPRTSSETAAFAGARIDWKETPEAHVFKADVPGLKKEEVKVEVEDGNVLQISGERNKEQEEKTDTWHRVERSSGRFLRRFRLPENAKTEQIRAAMENGVLTVTVPKEDAKKPEVKSIQISG

SEQ ID NO: 7269 - protein, 262 aa, Brassica napus
  misc_feature (252)..(252): Xaa can be any naturally occurring amino acid
MAAAVSTVGAINRAPLSLNGSGAGAASVPATTFLGKKVVTASRFTQSNNKKSNGSFKVVAVKEDKQTDGDRWRGLAYDTSDDQQDITRGKGMVDSVFQAPMGTGTHNAVLSSYEYISQGLKQYNLDNMMDGLYIAPAFMDKLVVHITKNFLTLPNIKVPLILGIWGGKGQGKSFQCELVMAKMGINPIMMSAGELESGNAGEPAKLIRQRYREAADMIKKGKMCCLFINDLDAGAGRMGGTTQYTVNNQMVXRTLMNIADNP

SEQ ID NO: 7270 - protein, 207 aa, Mesembryanthemum crystallinum
MASRRRKLLKIIILGDSGVGKTSLMNQFVNKKFSNQYKATIGADFLTKELQFEDRLFTLQIWDTAGQERFQSLGVAFYRGADCCVLTYDVNVMKSFESLNRWREEFLIQASPADPDNFPFVLLGNKIDVDGGSGRVVSEKKAKAWCMSKGNIPYFETSAKDGTNVEEAFQCIAKNAIQNEPEEETYLPDTIDMAGSTRPQSSSACEC

SEQ ID NO: 7271 - protein, 213 aa, Unknown
  Nymphaea sp. EMK-2003
KRRSGLLKKAYELSVLCDAEVALIIFSSRGRLYEYANNSVKATIDRYKKACDSSNSGTVTEANAQYYQHESHKLRQQISKIQQDNRQMLGEGISEMSHRDLKNLESKLERSISKIRSKKNDLLNAEIQYMKKRDDDLQKENIYLRARINENERAHQQQQQQQHVTVMTGGPSSEYEVLPMTFQHVNLLEPSHHQHHHHHHYSAHQERTALQLG

SEQ ID NO: 7272 - protein, 224 aa, Unknown
  Nymphaea sp. EMK-2003
MGRGKIEIKRIENTTNRQVTFCKRRSGLLKKAYELSVLCDAEVALIVFSSRGRLYEYANNSVRGTIERYKKAYAESSSSGAVAETNAQYYQHEAHKLRQQISKIQQDNRQMLGEGVSEMSLRDLKSLENKLERSISKIRGKKNDLLNGEIQYMQNWNEDLQKENTFLRAKVCENERAQQQHISILAAGPAEYELPPAVPFQHINLMESSHHQYSHQERTALQLG

SEQ ID NO: 7273 - protein, 85 aa, Selaginella moellendorffii
EVVSLSPKTLMESDRYICEICNQGFQRDQNLQMHRRRHKVPWKLLKRATPEVRKRVYVCPEPSCLHHDPCHALGDLVGIKKHFRR

SEQ ID NO: 7274 - protein, 142 aa, Zea mays
NRLTALSCSTTRACRSDATRTAGADVDHPPSAFLLLLVLLGCASLASGGAPMAGHVLGGVKENPATANSGEYDGLGRFSGDEHNRRENALLESELVMEANEQVEVGTLHHLTLEDLEAGRKKLYEALDWVKPWLDFQELQEF

SEQ ID NO: 7275 - protein, 202 aa, Hypocrea jecorina
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMSDKKVVEYTVAKEFADSLGIPFLETSAKNASNVEQAFLTMARQIKERMGTTTANNTKPSVHVGQGQGVGNSSSSSCC

SEQ ID NO: 7276 - protein, 547 aa, Xylella fastidiosa
MAAKEIIFSEKARSRMVHGVNLLANAVKATLGPKGRHVVLDKSFGSPIITKDGVSVAKEIELADKFENMGAQMLKEVASKTNDHAGDGTTTATVLAQALIREGCKAVAAGMNPMDLKRGIDKAVIAAVTELKKISKPTSDDKAIAQVATISANSDESIGNIIAEAMKKVGKEGVITIEEGTTLENELDVVEGMQFDRGYSSPYFINNQQSQIVELDNPYILLHDKKISSVRDLLTVLDAVAKESKPLLIVAEEVEGEALATLVVNNIRGIIKVCAVKAPGFGDRRKAMLEDMAVLTGGTVISEEVGLSLEKATTSHLGKAKKVRVSKENTTIIDGIGDNDAINGRVKQIKTQIEETTSDYDREKLQERVAKLAGGVAVIKVGAATEVEMKEKKARVDDALLATRAAVEEGVIPGGGVALIRAITAISNLKGANEDQTHGIQIALRAMEAPLREIVANAGEEPSVILNKVKEGKDNFGYNAATGEFGDMVNLGILDPTKVTRSALQNAASIAGLMITTEAMVAEAPKKDEPTPPAAGGGMGGMGGMDF

SEQ ID NO: 7277 - protein, 217 aa, Meliosma dilleniifolia
KRRNGLLEKAYELSVLCDAEIGLIVFSSRGRLYEYSNNSIKSTIERYKKACTNSSSTTTIVETSAQYYQQEAVKLRQQIQILQNANRHLMGESLGSLSIKELKQLENRLERGITRIRSKKYELLFAEIEYMQKREVELQNDNLYLRTKISENERPQQTMMVPEPGFDAIQTYNSQKQDFEQEIQTYDARNNYLQATNMLEGGPTTYSHPDQTALHLG

SEQ ID NO: 7278 - protein, 173 aa, Pseudomonas syringae
MSLHELNTLPGVTANPEAPTRQFVFNHTMLRVKDITQSLDFYTRVLGFSLVEKRDFPEAEFSLYFLALVDKAQIPDDDAARNEWMKSIPGILELTHNHGTESDANASYHNGNSDPRGFGHICVSVPDVKVACERFEALGVDFQKRLSDGRMNSLAFIKDPDGYWVEIIQPTPL

SEQ ID NO: 7279 - protein, 204 aa, Berberis gilgiana
KRRNGLLKKAYELSVLCDAEVALIVFSARGRLYEYANNSVKTTIERYKKACSDSTNTGSVSEANAQFYQQEATRMRQQIGNLQNANRHLLGQDLSSVSVKDLKQMETRLEKGISRIRSKKNELLFAEIEYMQKREIDLQNDNMYLRAKIAENERAQQQMNLMPGNEYETITSAPYDSRNFLQVNLLPESNNQYSRSDQTALQLG

SEQ ID NO: 7280 - protein, 202 aa, Akebia quinata
RRNGLLKKAYELSVLCDAEVALVVFSNRGRLYEYANNSVKTTIERYKKACIDSSNSGSVSEANAQFYQQESLKLRQQIGNLQNLNRHLMGEALGSMSIKELKQLETRIEKGISRIRSKKNELLFAEIEYMQKREIDLQNDNMYLRAKIAENERAGQHMSLMPGNEYEVMSSAPFDSRNFLQVNLLEPNNHYSHTDQIALQLG

SEQ ID NO: 7281 - protein, 185 aa, Arabidopsis thaliana
MASEARESPANNPGLSTNRDEATKGYIMQQTMFRIKDPKASLDFYSRVLGMSLLKRLDFSEMKFSLYFLGYEDTTTAPTDPTERTVWTFGQPATIELTHNWGTESDPEFKGYHNGNSEPRGFGHIGVTVDDVHKACERFEELGVEFAKKPNDGKMKNIAFIKDPDGYWIEIFDLKTIGTTTVNAA

SEQ ID NO: 7282 - protein, 690 aa, Caulobacter crescentus
MRRTTAHRAFRRTMNLIAGGKPLASALKAIVQAVEAEDPTILCGILLLDADRRRLLMGAAPSLPTFYNQAIEGVEIGPSVGSCGTAAYLGRRVMVDDIQSSPLWVGYQELAAQAGLAACWSEPIKTSDGAVAGTFAIYHREVSKPNKEDIAFIEAAAQLAAFAIDRRRAEEELAASEARARLLAEQALETSRNLSNFFDVSADLLSISNMQGRFVKVNRAWETALGYPIEALEGVPFLPLLHPEDQQSTRVQINRIEVDDEVNGFVNRYRRADGSYCQLEWRARRCDDLVFGVARDVTERLRIQAEMAEARDAAEAANRAKNDFLANMSHEIRTPLNGVIALAAALDETPLTSKQAEMVAMIRRSGETLERLVSDILDVSKIEAGQMTLQPQAFDLGALVDGLLDVTRLRAKEKGVAVRLERSPTAAGGFLGDSVRIGQVLSNLFSNAVKFTDQGEVIVRVDVEEAGNGQAARLFVEVEDTGVGFDAEKAEMIFQRFNQADSTITRRFGGSGLGLSISKTLVEMMGGEITAQSSPGAGSLFRVTLPLSRTQMGPDAEIDAPRSAAPGEGLKVLLAEDHPINQRVVQLILEPCGAAVTVVENGAQAVEAMASGAFDVVLMDMQMPVMDGLAATRAIRAREGEGQRTPIIMLSANAMDVHRREALQAGADLHVPKPITIAALLDSIGQVMAR

SEQ ID NO: 7283 - protein, 507 aa, Symbiobacterium thermophilum
MLSAFSPPLPCDPARSHPTPEFPSSLQDYCEIRGIQSQPPARRDPTMDWLASLRSQIKPYRDRFPSHARLPRAGLPRAEILAEIAAMGAAESPAWRDGYASGAVYHGDEHHIAFLNEVYALQSQSNPLHPDLWPSTAKFEAEVVAMTAHMLGGDAAGGTVCGTVTSGGTESLLLAMKTYRDWARATKGITAPEAVVPVSAHAAFDKAAQYFGIKLVRTPLDADYRADVAAMREAITPNTVVVAGSAPGYPHGVVDPIPEIAALAAEHGIGCHVDACLGGFILPWAERLGYPVPPFDFRLEGVTSVSADTHKYGYGAKGTSVILYRRPDLLHYQYFIAADWPGGLYFSPTFAGSRPGALSATAWAAMLSLGEEGYLDATRRILQAADRLKAGVRAIPSLKILGDPLWVIAVASDELNIYQVMEEMAGRGWRLNGLHRPPAFHVALTLRHTEPGVVDRFLADLQDAVAQVRAHPEKATGMAPVYGMAAAAPPELVRQVLTGFIDLLYEV

SEQ ID NO: 7284 - protein, 374 aa, Colwellia psychrerythraea
MTFSPLFTATELGPYTLKNRIVFPPLTRSRSSQPGNIPNQLMANYYSQRAGAGFMVTEGTQIEPRGQGYAWTPGIHSAEQVQGWKQVTQAVHDAGSIIFCQLWHVGRVSHTSLQPNQAAPVGPSALKADAVKVFIETAPEQGALADPSEPRALSTIEVEELVQMYKQAAVNAKEAGFDGVELHCANGYLVNQFISEHTNDRTDKYGGSLENRLRFLKEITQAVADVMGADKVGVRFAPLFESTDEVRVYLGLVESDPHATYIAAIKALNDIGIAYLSLAEADWDNAPDLPEDFYKAVRNTFDGLVMYAGKYTPEKALRILTEGNGDIFGFGRPFIANPDLPERIKNEWSLNDVDPTSMYGGTDKGYTDYPVYAL

SEQ ID NO: 7285 - protein, 492 aa, Arabidopsis thaliana
MDPYRVRPSSAHDSPFFTTNSGAPVWNNNSSLTVGTRGPILLEDYHLLEKLANFDRERIPERVVHARGASAKGFFEVTHDITQLTSADFLRGPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGAGVNTYMLINKAGKAHYVKFHWKPTCGIKCLSDEEAIRVGGANHSHATKDLYDSIAAGNYPQWNLFVQVMDPAHEDKFDFDPLDVTKIWPEDILPLQPVGRLVLNKNIDNFFNENEQIAFCPALVVPGIHYSDDKLLQTRIFSYADSQRHRLGPNYLQLPVNAPKCAHHNNHHDGFMNFMHRDEEVNYFPSRLDPVRHAEKYPTTPIVCSGNREKCFIRKENNFKQPGERYRSWDSDRQERFVKRFVEALSEPRVTHEIRSIWISYWSQADKSLGQKLATRLNVRPNF

SEQ ID NO: 7286 - protein, 273 aa, Arabidopsis thaliana
MALEAMNTPTSSFTRIETKEDLMNDAVFIEPWLKRKRSKRQRSHSPSSSSSSPPRSRPKSQNQDLTEEEYLALCLLMLAKDQPSQTRFHQQSQSLTPPPESKNLPYKCNVCEKAFPSYQALGGHKASHRIKPPTVISTTADDSTAPTISIVAGEKHPIAASGKIHECSICHKVFPTGQALGGHKRCHYEGNLGGGGGGGSKSISHSGSVSSTVSEERSHRGFIDLNLPALPELSLHHNPIVDEEILSPLTGKKPLLLTDHDQVIKKEDLSLKI

SEQ ID NO: 7287 - protein, 398 aa, Hordeum vulgare
VQTPVIVRFSTVVHERGSPETLRDPRGFAVKFYTREGNFDLVGNNMPVFFIRDGMKFPDMVHAFKPSPKTNMQENWRVVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDRFDFDPLDVTKTWPEDIIPLQPVGRMVLNKNIDNFFAENEQLAFCPAVTVPGIHYSDDKLLQTRIFSYADTQRHRLGPNYLMLPVNAPKCAHHNNHHDGLMNFIHRDEEVNYFPSRFDPTRHAEKYPMPPRVLSGCREKCIIDKENNFKQAGERYRSFDPARQDRFLQRWVDALTDARVTHEIQSIWVSYWSQCDASLGQKLASRLKIKPNM

SEQ ID NO: 7288 - protein, 664 aa, Clostridium acetobutylicum
MNKYKKLFEPIKIGKCEIKNRFALAPMGPLGLADSEGGFNQRGIDYYTERAKGGTGLIITGVTFVDNEVEEHGMPNCPCPTHNPVQFVRTGREMTERIHAYNSKVFLQMSGGFGRVTIPTNLGEFPPVAPSPIQHRWLDKTCRELTVDEIKSIVKKFGEGAFNAKRAGFDGVQIHAVHEGYLIDQFAISLFNHRTDEYGGSLENRLRFAREIVEEIKNRCGEDFPVTLRYSPKSFIKDLRDGALPGEEFVEKGRDLDEGVEAAKLLVSYGYDALDTDVGSYDSWWWSHPPMYQEKGLYRKYAKLMKDTVDVPVICAGRMDDPDMALEAVENGTCDVISLGRPLLADPDYVNKLRSNKCKSIRPCISCQEGCMGRVQHYSMLNCAVNPQACKERANSLTPIIKSKKVLIVGGGVAGCEAARVLALRGHEPVLYEKSNRLGGNLIPGGAPSFKEDDIALADWYTNTLKELNVEVNLNSEVTKEQILNSKFDTVIVATGSTPKVFPLGDDEKVFTAAEVLLGQKDPGETTVVVGGGLVGCELALDLAKKGKKVTIVEALNKILALNGPLCSANSEMLQKLIPFNGIDVKANSKVKGYKNGLLKMETENGIEELPCDSVILSVGYKEENSLYKELEFEIPEIYLLGDARKVSNIMYGIWDAFEVANHI

SEQ ID NO: 7289 - protein, 343 aa, Oryza sativa
MDHAAEAQRTDLMTITRHVLNEQGRHPESRGDFTILLSHIVLGCKFVASAVNKAGLAKLIGLAGDTNVAVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 7290 - protein, 204 aa, Helleborus orientalis
KRRNGLLKKAYELSVLCDAEVALIVFSTRGRLYEYSNNSVKKTIERYKKASTDSSGSGSVSEVNAQYYQQEASKLRNQIATLQNSNRNLLGEQLSNLNIRELKQIEKKIETGINKIQSKKNELLFAEIEYMQKREADLQNDNMYLRAKISENERTQQHMSLMPGTNDYEVISSGAFDSRNFLQVNLLGSNDTYSRSDQTALQLG

SEQ ID NO: 7291 - protein, 216 aa, Helleborus orientalis
IENTTNRQVTFCKHRNGLLKKAYELSVLCDAEVALIVFSSRGRLYEYSNNSVKKTIERYKKASTDSSNSGSASEANAQYYQQEAAKLRNQIAALQNSNRNLLGEQLSNLSIRELKQIEKKIETGINKIRSKKNELLFAEIEYMQKREVDLQNDNMFLRAKISENERTQQHMSLMPGTNNYEVISSGPFDSRNFLQVNLLESNNNYSRSDQTALQLG

SEQ ID NO: 7292 - protein, 149 aa, Rhodopseudomonas palustris
MRYLHTMLRVRNLDTALEFFVGALGLKEVRRIDNDKGKFTLLFLCAPEDEELVKQSKGRPAPTIELTHNWDEESYGEDRFFGHLAFEVDDIYATCERLMKLGITINRPPRDGQMAFVRSPDLQSVELLQKGEALPPQEPWASMPNTGHW

SEQ ID NO: 7293 - protein, 214 aa, Aquilegia alpina
IENTTNRQVTFCKRRNGLLKKAYELSVLCEAEVALIVFSNRGRLYEYANNSVRKTIDRYKKTCGEGSSTLTVSEANLLFYQQESSKMKQQIEILQNSNRHLMGEALSCLSIKELKQLESRLEKGISRIRSKKNEMLLAEIEFMQKREIELHNDNIYLREQITANERAQQHMNSLPGNVYEAITSAPYNSRDFLQVNLRESKPNQYCDSTALQLC

SEQ ID NO: 7294 - protein, 355 aa, Geobacter metallireducens
MSALFTPFTLRSVTFRNRIFVSPMCQYSSLDGMPTDWHLVHLGSRAVGGAGLVMVEATAVSPEGRISPDDSGIWDDRHGEGFAPITRFIAEQGAVPGIQLAHAGRKASTDLPWRGGLPLGPEARGWQPVAPSPRPFAADYPVPRELTVEEMDDVVSQFRDGAQRALAAGFQVVEIHMAHGYLLHEFLSPLSNRRTDDFGGSLENRIRLPLRVTRAVREVWPADLPLFVRISATDWVEGGWDLDQSVVLARKLREAGVDLVDCSAGFLTPDAVIPFGSGYQTPFATAIRREAGIPTGTVGFITDPAQAEQIVATGLADAVLLAREMLRDPYWPLHAARSLGVNVPWPPQYERAKLP

SEQ ID NO: 7295 - protein, 203 aa, Aquilegia alpina
KRRNGLLKKAYELSVLCEAEVALIVFSSRGRLYEYSNNSVKKTIERYKKASTDSNNSGSVSEANAQFYQQEATKLRNQIASLQNHNRNLLGESLSNLNIRELKQIEKKIEGGISKIRAKKNELLFAEIEYMQKRELDLQTDNKYLRAMIAANERAPEHMNLMPANEYHALSSAPFDSRNFMPANLLDHNNNYSRSDQTTLQLG

SEQ ID NO: 7296 - protein, 725 aa, Aspergillus oryzae
MRALSLASLIGIASAACPYMTGELERRDTGTDDATAATEEFLSQYYMADNDTFLTSDVGGPIEDQNSLQVGDRGPTLLEDFIFRQKIQRFDHERVPERAVHARGVGAHGVFTSYGDYSNITAASFLGAEGKETPVFVRFSTVAGSRGSSDLARDVHGFATRFYTDEGNFDIVGNNIPVFFIQDAILFPDLIHAVKPRGDNEIPQAATAHDSAWDFFSQQPSSLHTLLWAMSGHGIPRSLRHVDGFGIHTFRFVTDNGDSKLVKFHWKSLQGKASMVWEEAQQVSGKNPDFMRQDLFEAIEAGRYPEWELGVQIMDEEDQLKFGFDLFDPTKIVPEEYVPITKLGKMTLNRNPRNYFAETEQVMFQPGHIVRGVDFTEDPLLQGRLFSYLDTQLNRHGGPNFEQLPINQPRVPVHNNNRDGAGQMFIPLNPNAYSPNTLNKGSPKQANQTVGKGFFTAPGRESTGRFTRAVSPSFEDVWSQPRLFYNSLTPAEQQFVVDAIRFENSNVKSSVVRNNVIIQLNRVSNDLARRVARAIGVEEPEADPTYYHNNKTTDVGTFGQKLKKLDGLKVGFLASVETPASIEAASELSKQLSEDGVDVVVVAERLSDGVDQTYSGSDAIQFDAVIVAPGAEGLFSTFSFTAPSNATSSSTLFPAGRPLQIVIDGFRFGKPVGAVGSAATALKNAGIQTSRDGVYVDKSVTSGFVDGIKDGLRTFKFLDRFKLDH

SEQ ID NO: 7297 - protein, 203 aa, Clematis integrifolia
KRRNGLLKKAYELSVLCDAEVALIVFSNRGRLYEYANNSVRKTIDRYKKTCSDPQTALTVSEANTMFYQQETTKMKQQIEILQNSNRHLMGEALSCLSIKELKQLESRLEKGLGRIRSKKNEMLLSEIEYMQKREIDLHNDNLYLRAKISDNEKAQHNMNVLPGNVYEAMTSAPYDARNFLQVNLPDTKEHPYCSGSTALQLC

SEQ ID NO: 7298 - protein, 478 aa, Mycoplasma mycoides
MMLIFMELIFYIKRIYMFKFKKDFWWGAASSGCQTESDKDKPNLNIMDYWYKQTPTDFYDNKGPNITCDTYSNYKTDVKLMSEIGLNSFRTSIQWTRLIKNLYTGEVDLKQVEFYRNYFLEIKKNNIKLIVNLFHFDTPIELENIGGWTNKKTVELYFLYAKQCFKYFSDLVDYWTTFNEPVVLVDGCYLNKWYYPKISNLKLVVQAAYNTILAHCKVANYFHSYFKNDQNKKISIILNLTPTIPKNSELKHLKAAKIRDELLNKSFLNAVIKGQFSTFLIKFLNENNLMPEYDQLELNEIKKTRIDFLAVNYYQPARVQAPLNNLTSSTELKLENWFLPYTNKNIRINPYRGWEIHPQTLYDIAIDIKNNYDNIPWIVSENGIGVSDENRFLNKQGYIDDQYRIDFIKEHLIYLYKAIEQGSNCFGYQMWTLIDNWSWANGFKNRYGFISLDTKTLKRTIKKSGYWIKQVIKDQGFE

SEQ ID NO: 7299 - protein, 394 aa, Hordeum vulgare
VRFSTVIHERGSPETIRDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVSRAGKSHYVKFHWRPTCGVSCLMDDEATLVGGKNHSHATQDLYDSIDAGNFPEWKLFVQVIDPDEEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRHAEPASFPVPTRPVVGKREKTRIKKENDFVQPGERYRSWAPDRQDRFVRRFSDALAHPKVSHELRVIWIDFLSKCDKSCGMKVANRLNVKPSM

SEQ ID NO: 7300 - protein, 405 aa, Arabidopsis thaliana
MGKECYYLSWILKFHLLLVLIQLVDSGSTIRFLPGFQGPLPFELETGISDLFELQTTTKNKNAGPIAFKAEEYNGSIPSLVSTTYAWTKVASILYLDQPVGTGFSYSRNPLADIPSDTGVAKPVNEFLHKWLDKHPEFLSNPLYVAGNSYSGIVIPTIVQEISNGNHLDSKPQINLQGFVLGNPATDTDIDLNSRIPFAHGKALISDEHYESLKRSCQGNYISVNPRNTKCLKLLEDFKKCVSGISEEYILKPDCMWLYSCMANLHSLSEYWANEKSVRKALLVNEGTVRKWIRCNTEIAYNKDIRSSVPYHKYISIEGYRSLVFSGDHDMLVPFLGTQAWIRSLNYSIVDDWRPWMVQNQVAGYTRTYANKMTFATVKGGGHTSEYKPVETYIMIKRWLSGQPL

SEQ ID NO: 7301 - protein, 505 aa, Helicobacter pylori
MVNKDVKQTTAFGAPVWDDNNVITAGPRGPVLLQSTWFLEKLAAFDRERIPERVVHAKGSGAYGTFTVTKDITKYTKAKIFSKVGKKTECFFRFSTVAGEKGSADAVRDPRGFAMKYYTEEGNWDLVGNNTPVFFIRDAIKFPDFIHTQKRDPQTNLPNPDMVWDFWSNVPESLYQVTWVMSDRGIPKSFRHMDGFGSHTFSLINAKGERFWVKFHFETMQGVKHLTNEEAAEVRKYDPDSNQRDLFDAIAGGDFPKWKMSIQVMPEEDAKKYRFHPFDVTKIWYLQDYPLMEVGIVELNKNPENYFAEVEQAAFTPANVVPGIGYSPDRMLQGRLFSYGDTHRYRLGVNYPQIPVNRPRCPFHSSSRDGYMQNGYYGSLQNYTPSSLPGYKEDKSARDPKFNLAHIEKEFEVWNWDYRAEDSDYYTQPGDYYRSLPADEKERLYDTIGGSLAHVTHKEIVDKQLEHFKKADPKYAEGVKKALEKHQKMMKDMHAKDMHHMKKKK

SEQ ID NO: 7302 - protein, 440 aa, Arabidopsis thaliana
MTLCSLSFGVKSLRYIGVGEEDEDQMFYYFIKSESNPKTDPLLLWLSGGPGCSSFTGLIYENGPLGFKVEAYNGSIPTLVSTTYSWTKVANIIYLDQPVGTGFSYSRNPLADIPSDTGSAKRVDEFLRKWLTKHPEYFSNPFYAGGNSYSGKMVPVIVQEISNGNCIYGKPQIRLQGYVLGSPVTDYDLDRNSRIQFAHGMALISNELYESMKRTCGGNYIFVDPLNTECLELIKDYDNCVSGIYENLILVPKCDLTSPDCHVSILVDFALATKLNHKRRIFTKLLSQSYRSMLSDYWANNESVRRALKVVEGTTGRWERCKWTLQNNKDIKSSIPYHKKNSIQGYRSLIFSGDHDMLTPYVGTQDWIRSLNYSIIDKWRPWMILDQVAGYTTTYANKMTFATVKVTPISTFSIDKNAKLFYITLLNRFVGLICRVAGTR

SEQ ID NO: 7303 - protein, 441 aa, Arabidopsis thaliana
MGSWIPKLLLLQLVLLLTKHADSSSIIKYLPGFEGPLPFELETGYIGVGDEDEDQMFYYFIKSESNPEEDPLLVWLSGGPGCSSFTGLVYENGPLGFKVEAYNGSIPTLVSTTYSWTKVANIIYLDQPVGAGFSYSRNPFADRPSDTGSAKLVNEFVRKWLAKHPDYFSNPFYVTGNSYSGKVIPAIVQEISNGNYICCKPQINLQGYVIGNPVAYYDHDKDSRIPFAHGVALISDELFESLKRSCGGSYSIVDPLNTECLKLIKDYHKCVSGIYQELILKPKCETTSPDCYTYRYLLSIYWANNEIVRRALKVVEGSKGKWERCDLSVRSNQDIKSSIPYHMNNSIKGYRSLVISGDHDMTIPFLGTQAWIRSLNYSITEKWRPWMILDQVAGYTKTYANKMTLATVKVCSFIHILIFFVNIKIESCFTSVVIGLWVWLL

SEQ ID NO: 7304 - protein, 507 aa, Arabidopsis thaliana
TTYHGTTCHSALSFSFLLPLSLTKTLVSFTRRRFSRHRNLQIRLSLHYDPCPVTSTPVIPPIRRHLAFASTKPPFHPSDDYHRFNPSSLSNNNDRSFVHGCGVVDREEDAVVVRSPSRKRKATMDMVVAPSNNGFTSSGFTNIPSSPCQTPRKGGRVNIKSKAKGNKSTPQTPISTNAGSPITLTPSGSCRYDSSLGLLTKKFVNLIKQAKDGMLDLNKAAETLEVQKRRIYDITNVLEGIDLIEKPFKNRILWKGVDACPGDEDADVSVLQAEIENLALEEQALDNQIRQTEERLRDLSENEKNQKWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVENDESDYWLLSNAEISMTDIWKTDSGIDWDYGIADVSTPPPGMGEIAPTAVDSTPR

SEQ ID NO: 7305 - protein, 479 aa, Vibrio fischeri
MDYKHNLQCVWFRHDLRTIDNPALQAAVDNQQPTFALFIYSESQWKKHNKAPIQIDLIKRRLVELKNELEQLNIPLIVISSPLFSEIPAKITALFNELSVNALFANKEYEHDERLRDTQVYESLLNTNCYFFDAKCILPVGTIINRTQQPYKVFTPFKKAWKASFYQQQPHITKTGKSVLCDPKLIKKLSLNNDDSFVFSSSNESGSWPVSTKAIIDILRQFCRQKVSQYHNNRDYPEIQGTSQLSPYLAIGAISAKQCALRLHLEANYELNQGEDIWLDELIWREFYTHLLHFYPNLSKNQAFLSYDKYIEWDNNLDHFERWCKGETGFPIVDAAMKQLNTTGWMHNRLRMITASFLVKDLHIDWRWGEQYFMSKLIDGDFASNNGGWQWCASVGCDSSPYFRIFNPITQGKKFDADCTFIKHWLPELKALSNKEIHHPNPAPLLKSDNYPDQIVDHAQQRIKVIEVYKQAKQLDIAS

SEQ ID NO: 7306 - protein, 381 aa, Streptococcus pyogenes
  misc_feature (81)..(81): Xaa can be any naturally occurring amino acid
MYGDLMTCFEQLLTQLKDWTDVYFNYDESGYGRLRDQKAAQFFKKNGIAVHTYQDHYLHGSQEIINQSGQPYKVFTPYYRXWQNYPKETPIKVELSQGRWLNLETPDDVLRTVESFKDEKYQDVATFDEASKQLNRFIQDQLAAYHANRDFPAQLGTSRLSPFLRIGAIGIRTVYHAVRQAPNSLGQATFLKELAWRDFYNMVYVAYPDQKTQPIQKAFSQIEWVNNPDWFQLWKEGKTGYPIVDAAMLQLQKTGWMHNRLRMIVASFLTKDLLCDWRLGEQYFQQQLIDYDAASNIGGWQWAASTGTDAVPYFRIFNPVTQGKRFDPKGEFIKAYLPQLEHVPEKYLHEPWKMPKNLQESVSCIIGTDYAQPIVDHAKQR

SEQ ID NO: 7307 - protein, 540 aa, Streptococcus pneumoniae
MSKEIKFSSDARSAMVRGVDILADTVKVTLGPKDRNVVLEKSFGSPLITNDGVTIAKEIELEDHFENMGAKLVSEIASKTNDIAGDGTTTATVLTQAIVREGIKNVTAGANPIGIRRGIETAVAAAVEALKNNAIPVANKEAISQVAAVSSRSEKVGEYISEAMEKVGKDGVITIEESRGMETELEVVEGMQFDRGYLSQYMVTDSEKMVADLENPYILITDKKISNIQEILPLLESILQSNRPLLIIADDVDGEALPTLVLNKIRGTFNVVAVKAPGFGDRRKAMLEDIAILTGGTVITEDLGLELKDATIEALGQAARVTVDKDSTVIVEGAGNPEAISHRVAVIKSQIETTTSEFDREKLQERLAKLSGGVAVIKVGAATETELKEMKLRIEDALNATRAAVEEGIVAGGGTALANVIPAEATLELTGDEATGRNIVLRALEEPVRQIAHNAGFEGSIVIDRLKNAELGIGFNAATGEWVNMIDQGIIDPVKVSRSALQNAASVASLILTTEAVVANKPEPVAPAPAMDPSMMGGMM

SEQ ID NO: 7308 - protein, 340 aa, Unknown
  Exiguobacterium sp. 255-15
MKTKLFEAIQIGGLQFRNRVIMAPMCMYSAKEDGLVTNWHVTHYASRAVGGVGGVILEATAVTPDGRISAGDLGVWSDDHIDGLRRIADQVKAAGAKAGIQLAHAGRKSTTAKPPVAPSAIGFDDSYDHPHELTVEEIDVIKQQFVEAALRVEQAGYDFIELHGAHGYLINTFLSPLSNKRQDQYGGSMENRMRFLLEIIDAIQEKSDLSLWVRISAADHAPGGMTAADYIPLAEELLKRNIDLLDCSSGAVVANAVPEVYPGYQVPYAAEIKQATGIKTGAVGLITTATLAEEIIRSERADVILLARELLRQPYWVYHAAAELKDEVSLPKQYERAPIR

SEQ ID NO: 7309 - protein, 550 aa, Cytophaga hutchinsonii
MNIKRWGVITAVAIGSVALLSAFKQTDKYFEIAKNMELFSAVYKEVNLLYVDEVNPSQTMTTGIDAMLESLDPYTNYIPEDKIEDFRTQMTGQYGGIGAVIGERKDKIIILMPYEGFPAQKAGLQIGDEILSVDGIVTTSKNSGDVSKLLRGQADTPLKIKVKRFNTPEPLEFTLVRQKIKISNVPYFGMVNTNTGYIKLSDFTQAASIEVKKALTDLKAKGATQIIFDLRGNPGGLLNEAVNISNIFIPKDKLVVSTKGKVSEWNTKYITELVPDDLNIPIAVLVSGRSASASEIVAGVIQDYDRGVIIGQRSYGKGLVQTTRELPYNSQIKVTTAKYYTPSGRCIQAIDYAHRAADGSVSKFADSLHVAFKTTNGRTVYDGGGVTPDITVVQDSISPILVALVSKSLLFDYATEYRSKHESIGDARTFNLSDRDYQDFVTWLKDKDYSYTTKVEKTLDEMTKQSKQEKYFDAMKDQLDQMKKVIAKDKENDLIKFQSQIMEYLEEEIASRYYLQKGIIESSFDSDKDIQSALEVLNNKTKYNSILSGK

SEQ ID NO: 7310 - protein, 1328 aa, Alternaria brassicicola
MAAETYSSVSAIIRNLARQHDPTRDPSFSAQVSANGAKTAVNAIALPGPESDEKTQLQQELSALCSRIDFLEHKSNHAANQQGQFPLTPAQEPSDEGALYTPAGVFRGNNGPPAQGRRGSNKERAIWVSNWLAAKESNGDPEQPAAALTEEQLNYLRVHLNQQADQIRNQREHIDNLSQEVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDINGMAKNLTDQVREIAVVTTAVAMGDLSRKIERPARGEILQLQQTINSMVDQLQSFATQVTKVARDVGTEGKLGGQAEIAGVKGMWNELTVNVNAMAQNLTTQVRDIAQVTTAVAQGNLTRKVEAECKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSSASRANERKLNLAYDVSYKVPDYVVGDSFRLRQIILNLVGNAIKLTEPGEVKVAISMAQEQECDPDHYVFQFAVSDTGIGIRGDKLNLIFDTFQQADGSTTRKFGGTGLGLSISKRLVTLMGGRMWVESDAGKGSVFYFTYKVRLGKPAIQAIQPQLVAYKQHTVLFVDQGNTGFSDEITEHLKTLDLVPMVVHSVEEVPETTKRTDMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERDNGIPSTPVIALTAHAMVGDREKCLAAQMDDYLSKPLRQNQLIQTILRCATVGSTMYDHSSEPRYTASSHLPNITLPGKGNDNGGASSSSGGLPSPGKKRPQLEARGFTERGGAQSPNLLAVDQTDNGSVERLLLRSHSS

SEQ ID NO: 7311 - protein, 267 aa, Arabidopsis thaliana
  misc_feature (233)..(233): Xaa can be any naturally occurring amino acid
  misc_feature (243)..(243): Xaa can be any naturally occurring amino acid
FLRMDGSGTGSRSGVESILPNYKLGRTLGIGSFGRVKIAEHALTGHKVAIKILNRRKIKNMEMEEKVRREIKILRLFMHPHIIRLYEVIETPTDIYLVMEYVNSGELFDYIVEKGRLQEDEARNFFQQIISGVEYCHRNMVVHRDLKPEDLLLDSKCDVKIADFGLSNIMRDGHFLKTSCGSPNYAAPEVISGKLYAGPEVDVWSCGVILYALLCGTLPFDDENIPNLFKKDXKGGIYTLPSXILSPGARDFYPPRMLFSLTPMKTS

SEQ ID NO: 7312 - protein, 206 aa, Pennisetum ciliare
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKEGTNVEDAFQCIVKNALKNEPEEELYVPDTVDVVGGNRAQRSSGCC

SEQ ID NO: 7313 - protein, 188 aa, Legionella pneumophila
MEVTTMDIKKLAPWNWFKEEEAQNKSVPLSTTGQSCISPLSQLHQEIDRIFDNVLRSVGISNLDIEKTPSNSAQNLLLKPCIDIAATDKEYTITVEVPGVEEDHIKLELSDNTLIIKGEKKHESEKKDKDIYRIERAYGSFQRVLSLPEDANQEDIKAQIKNGVLTITMPRKEVSKPKGKLIDIKKAS

SEQ ID NO: 7314 - protein, 731 aa, Bordetella bronchiseptica
MMRDSPSIQGTLDAATQHALLAGRHADPFSVLGPHQAGAHTVVRVLAPGARTVMAVLPGGQRTPLLPMQPGLFENTVPGLQPGAPAAYRLCIEWEGGIQHTADPYAFGPVLDAAQLDHCAAGGWRYLAGLLGAHAASVDGCAGTRFALWAPNARRVAVVGDFNGWDGRRHAMRLRYPAGVWELFLPDVGPGARYKFQVLGADGHTVLKADPLARQAEAPPATASIVPDERPFAWTDEAWMEQRAARQRCDAPISIYEVHAGSWFDDAGAPRWQSLAARLPEYARSLGFTHIELLPVMAHPFGGSWGYQPLGLFAPAAAHGAPADFAHFVDRCHEAGLGVILDWVPAHFPDDAHGLARLDGTPLYEHADPREGRHPDWNTLIYNYGRREVRAFLIASAIHWLRHYHVDGLRVDAVASMLYRDYSRPAGQWIPNRHGGRENLEAIDFLRELNAAVGVQCPGAITVAEESTAWPGVTAPVANGGLGFDYKWNMGWMHDTLRYMRRDPIHRRHHHHDLSFGMVYAYAERFVLPLSHDEVVHGKGSLLGKMPGERAAQLAQLRLYYAFMWAHPGKKLLFMGGEFGQQGEWNHDAMLQWSLLDDPAHRGLQRLIADLNHVYATLPELHCRDADPSGFAWIVGDDADNSVLAFARVDASHCLVAVCNFTPVPRPGYRFGVPHAGDWRVRVDTGATRYGGAGGGPPICLRSEPIPAHGHPQSLVLDLPGFTALYLRHSE

SEQ ID NO: 7315 - protein, 203 aa, Clematis integrifolia
KRRNGLLKKAYELSVLCDAEVALIVFSSRGRLYEYSNNSVRKTIERYKKASSDTSNTGSVSEANAQFYQNEAGKLRNQIASLQNNNKNLLGESLSNLSIRELKQLEKKIEGGITKIRSKKNELLFAEIEYMQKREIDLQNDNLYLRAKIADNERTQQQMNLMPGNEYEVISSAPFDSRNFLPVNLLEPNNSYSHCDQTTLQLG

SEQ ID NO: 7316 - protein, 584 aa, Bordetella bronchiseptica
MNEPAPHGATVCAPGKIRFRLWAPSAPPALALEIEGRAPIALRPGPDGYAQAIVDGAPGLRYRYRLAADCAVPDPASRLQDGDVHGHSVVVGPDRYPWRHTGWRGRPWQDSVIYEAHAGLCGGYAGLRRRLPEVARLGVTLLELMPIADFPGPRNWGYDGVLPYAPDTAYGTPDELKALIDAAHGLQMGVMLDVVYNHFGPDGNYLHRYAADFFDARADTPWGAAIDYRQQAVQRYFIDNALYWLREYRFDGLRLDAVHAMGRTDWLAGLAREARAACPDRRVHLVVENDANQASLLAQGFDAQWNDDAHHVLHHLLTGERQGYYADYAQAPAALLARALGEGYVYQGQAAPTRGGRARGEPSAHLPPWAFVLFLHNHDQVGNRADGLRLTSLLAPGSPALRAAIALQLLAPHIPLLFMGEEYGSTAPFFYFTSHGPELAAAVRAGRAREFAASMHDCDPPPDPNDPDTYRRSCPWPPPGAERQAWFEYYRELLRLRARLLGGRLTGARADGAAALGPAAVRAAWRLGDGARLTLYANLLPGSVIVPAPPAGQLAYATLAGAGQDLAAGVLRGGCALALWEPAP

SEQ ID NO: 7317 - protein, 216 aa, Ranunculus ficaria
IENTTNRQVTFCKRRNGLLKKAYELSVLCEAEVALIVFSNRGRLYEYSNNSVKKTIERYKKHSTDSSNTGSVSEANAQFYQQEANKLRNQIATLQNSNKNLLGESLSNLSVRELKAIEKKIEGGIAKIRSKKNELLFAEIEYMQKREIDLQNDNMFLRAKIAENERTQQQHMSLMPVNDYEVISSAPYDSRNFLPVNLLDSNHNYSRNDQTTLQLG

SEQ ID NO: 7318 - protein, 203 aa, Ranunculus ficaria
KRRNGLLKKAYELSVLCEAEVALIVFSNRGRLYEYANNSVRKTIDRYKKQCSDASTALTVSEANSLFYQQESSKMKQQIDILQNSNRHLMGEALSCLSIKELKQLESRLEKGLSRIRSKKNEMLLAEIEYVQKREIDLHNDNVYLRQKISENERAQQHMNSLPGNAYEAMTSAPYDARNFLQVNLSDNKDNHYGSSSTALQLC

SEQ ID NO: 7319 - protein, 225 aa, Brassica napus
MALEYESLNENVKKCQYAVRGELYLRASELQKEGKKIIFTNVGNPHALGQKPLTFPRQVVALCQAPFLLDDPNVGMIFPADAIARAKHYLSLTSGGLGAYSDSRGLPGVRKEVAEFIQRRDGYPSDPELIFLTDGASKGVMQILNCVIRGERDGILVPVPQYPLYSATILLLGGSLVPYYLDESENWGLDVNNLRQSVAQARSQGISVRAMVIINPGNPTGQCLS

SEQ ID NO: 7320 - protein, 847 aa, Phaseolus vulgaris
MFNCLCLNPFISVSSTIACTIHTVRSRQHLAPQKSVDLAVGYRNPLGYGFGSGLRRSLHEMVSSRFKGVAVMTDDKSTISSTEEYLENIGIFSIDPSLKPYKDHFKYRLKRYVEQKKLIEEYEGGLEEFAKGYLKFGFNREEGGIVYREWAPAAQEAQIIGDFNGWDGSNHQMEKDQFGVWSIKIPDVDGNPAIPHSSRVKFRFRHGDGVWVDRIPAWIKYATVDPTRFAAPYDGVYWDPPLSERYQFKYPRPPKPKAPRIYEAHVGMSSSEPRINSYREFADEILPRIRANNYNTVQLMAGMEHSYYASFGYHVTNFYAVSSRSGTPEDLKYLIDKAHSLGLQVLMDVIHSHASNNITDGLNGFDVGQTSQDSYFHTGDRGYHKLWDSRLFNYANWEVLRFLLSNLRWWLEEFEFDGFRFDGITSMLYHHHGINIAFTGDYNEYFSEATDVDAVVYLMLANCLIHSILPDATVIAEDVSGMPGIGHQVSGGGIGFDYRLAMAIPDKWIDYLKNKNEYSWSMKEISWSLTNRRYTEKCVSYAESHDQAIVGDKTVAFLLMDEEMYSGMSCLVDASPIVERGIALQKMIHFITMALGGEGYLNFMGNEFGHPEWIDFPREGNGWSYEKCRRQWNLVDTDHLRYKFMNAFDRAMNLLDDKFSFLKSTKQIVSSAHDEDKVIVFERGDLIFVFNFHPENTYEGYKVGCDLPGKYRVALDSDAWKFGGHGRVGHGVDHFTSPEGIPGVPETNFNNRPNSFKVLSPARTCVVYYRVDENQEGSNDSLVGLEDTFAAADVAKIPDKSASIESEYSNNLDGVKETSTSAQISVESEVINLDKVGIVAASLDREI

SEQ ID NO: 7321 - protein, 200 aa, Saxifraga careyana
KRRNGLLKKAYELSVLCDAEVALIVFSTRGRLYEYANNNIRSTIERYKKANSDSLNTGDVVETNTQFYQHESVKLRQQIQMLQNSNRNIMGESLSSLTLKELKQLENRLERGITRIRSKKHEMLLAEIEYMQKREIDLENESIYLRAKIGEAESIEQANVAAANDLHAIQAYVAHNFFQPSLLDAEPSFGYPNKKSPRLG

SEQ ID NO: 7322 - protein, 687 aa, Burkholderia vietnamiensis
MRYPHLFKPMQLNQLTLRNRIVSTAHAEVYAEPGGLPGDRYIRYYEEKAKGGVGLAICGGSSPVSIDSPQGWWKSVNLSNDKIIDPLTRLADTMHKHGAKIMIQATHMGRRSSFHGEHWPHLMSPSGVREPVHRGNAKIIEIEEIRRIIGDFAAAAKRVKAAGMDGIEISAAHQHLIDQFWSKRSNHRTDEWGGSLENRLRFGIEVLTAVREAVGKDFCVGLRMCGDEFHEDGLDHEALKEIAQAMSETGLIDYLSVVGSGGDTHNTIANCMPPMALPPEPFVHLAAGIKSVVKIPVMHAQSIRDAGQAERLLANGMIDLVGMTRAQIADPHMVIKIRDGREDEIKQCVGANYCIDRQYNGLDVLCIQNAATSREATMPHIIEKSRGPKRKVVVVGAGPAGLEAARVAKLRGHDVVLFEKNAEVGGQVMIAAKAPQREQMSGIIRWFDMETKRLGVDRRLGVAADEKMIMAEKPDIVVLATGGSSFTWQVSAWGVAEGLAVSSWDILTGKVEPKQNVLLFDGVSTHAGAGVADFMASRGSKVEVVTPDVKVADDCGGTTFPIFYRRLYALGVIPTPNTMLDRVYEEDGKKIAVLRNEYTEELEERAVDQVVIENGSAPNDELYWKLKPESVNRGQIDPHTLFAAEPQPCLSEELGNGRFLLFRVGDCISMHNVHGAIYDSLRLVKDF

SEQ ID NO: 7323 - protein, 604 aa, Pseudomonas syringae
MPLRTDDNWRHGAVLLDPEHTRFALWAPDASYVSVELQDGQSLAMLPQPEGWFVLEARCKAGTRYRFKVDHTLEVPDPASRAQVDDVHSQSIVVDPQAYSWQNTAWNGRPWHEAVIYELHVGAMGGYAAVEKHLARLAALGITAIELMPLAQFPGDRNWGYDGVLHYAPQSSYGTPEQLKHLIDTAHGVGLMVILDVVYNHFGPDGNYLGSYAKEFFRSDLHTPWGDAIDFRRPQVRDFFVDNALMWLLEYRIDGLRMDAVHAIRDETFLPEFATRVRERIEPSRHVWLNLENEFNQASLLDKGFDAQWDDDGHNTLHVLLTGETDAYYSDFAKEPTHKLARLLGEGFVYQGEQTRHGHTRGEPSGHLAPSAFVLFLQNHDQIGNRALGERLPQLCSPDALRAATALLLLSPMIPLMFMGDEWAASEPFLFFTSHHGELADAVREGRRKEFADFAAFADPEKREHIPDPNDIKTFEASRPAFSATELQTEKGLEHRQWVDYYAQLLALRHQEIVPRLQGASFLNTEILGDKAVSARWTLGDGSVLRIDLNLSEQPVATTPAPHAREIFSSAAKSSELSPDAILNPYTAIVSLTASDVLEEQDEQ

SEQ ID NO: 7324 - protein, 212 aa, Saxifraga careyana
KRRNGLLKKAYELSVLCDAEVALIVFSTRGRLYEYSNNSVKQTIERYKKACSGPSNSGSVSEANAQSYQQEASKLHAQINNLQNTNRQMLGEALGSLSPRDLKNLENKVEKGISKIRSKKNELLFSEIEYMKKREIDLHNENQYIRAKIAETERAQQQMSLMPPGGGSTNYDQQLNMHPQQFDSRDFFQVNALQPNNHHYSRQHDQISLQLV

SEQ ID NO: 7325 - protein, 200 aa, Triticum aestivum
  misc_feature (180)..(180): Xaa can be any naturally occurring amino acid
HASEEHRSKSSQKSIDHPSASNTSQIVDSFHQHLESPPIRPTISLIRRSNVFDPFSLDFFDPFDGFPFGSGSNSSGSLVPRTSSDTAAFAGARIDWKETPEAHVFKADVPGLKKEEVKVEVEDGNILQISGERNKEQEEKTDTWHRVERSSGKFLRRFRLPENAKAEQVKASMENGVLTXVTVPKEEAKKPEVKSIQISG

SEQ ID NO: 7326 - protein, 318 aa, Triticum aestivum
PIISCNTWTKKKKKSLCKQAPPRTPPEFPGYRRPTRPGNLTHYPWRADEDRFKSWRQGMTGYPLVDAGMRELWATGWTHNRIRVIVSSFAVKFLQIPWTWGMKYFWDVLLDADIESDILGWQYISGSLPDGHELGRLDNPEVQGQKYDPDGEYVRTWIPELARMPGEWIHHPWDAPSSILEVAGVELGFNYPMPIVELHTARECLDDAISTMWQLDTAEKLAELDGEVVEDNLSHIKSFDVPKVVLKELSPHCDREVPTDDGRNLELQPKELKGTNKQTICVDVIKASKMEDTGSIANSPISRKRSSSGSVFNVPSYV

SEQ ID NO: 7327 - protein, 431 aa, Daucus carota
MKPPFVPSDDYYRFGESRGVADHEADVIIVKSTPSKRKPGNYNEVESSRLSMSPAYTNTVKSPNQTPVSGKGGRVYGRSNATKSLASVPQTPMSNAGSPSPLTPAGSCRYDSSLGLLTKKFINLIKQAEDGTLDLNNAAETLEVQKRRIYDITNVLEGIGLIEKKLKNRIHWKGIDASRPGEMEDDSNVLQAEVEKLSLEEKRLDDRIREMQEKLRDLSEDEANQKWLFVTEEDIKGLECFMNKTLIAIKAPHGTTLEVPDPDEVVDYPQRRYRIILRSTMGPIDVYLVSQFEEKFDEMNSVQPSMSLPLASSTGSNDNPAAETAIVGHGLENGTMTQDGHGVNSDLYTSEDISGGIMKILPSELDNDADYWLLTDPSISMTDMWKTDAGVEWDGASLLNEEFELPCISPRPQTPPSGVADVSTVANGTQR

SEQ ID NO: 7328 - protein, 331 aa, Oryza sativa
MEANLPPGFRFHPRDEELIVDYLYHKLSGGDGGGGAGEFYGGVAMVDVDLNKCEPWELPAYFLHNLIIFPARARARAAGRRRRADAARVGATEWYFFSLHDRKYATGQRTNRATRSGYWKATGKDRAIVTRRRAAGGEAVAGGEVVGMRKTLVFYQGRAPRGSKTEWVMHEFRVDGHAVADHPSSSTSSSSSNLLKEDWVLCRVFYKSRTANPRPVVSGEAAVSLSGELSLPPPPPLPVAPAVIDGYTGGGYYEQDSSAGCHHHHHRPPTSAALPFKDLTDFRDLLSNMVQGGGAAAAAAKSEGFHLGWSEEESSGYVQQSAMASQAWNPF

SEQ ID NO: 7329 - protein, 363 aa, Caulobacter crescentus
MSLDALFQPFEFKSLKLPNRVVMAPMTRSFSPGGVPTDEVAAYYRRRAENQVGLIVTEGTGVARPASLNDANVPRFHGEKELAAWKKVVDEVHAAGGKIAPQLWHVGAAKGKDVLGKVDSPSGLSKAGGNPFTEPMTDAEIADTIQAFATAAADAKRLGFDTVELHGAHGYLIDQFFWQGTNVRSDAWGGPTIGERGRFAAEILKAVRAAVGPDYPVIIRLSQWKQQEYTARLAETPKEMEAWLQPLADAGADIFHCSQRRFWEPEFEGSDLNFAGWAKKLTGAPTITVGSVGLSGEFIAAFGGEGSQPTSIDNVIGGLERGEYDMVGVGRALLQDPEWVTKIREGRSDELKAFERAALGTLY

SEQ ID NO: 7330 - protein, 334 aa, Haemophilus influenzae
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVASGYIVYGSSTMLVYTTGHGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIEPTALHERVPLFVGSEDMVKKAQEMMEEFKEE

SEQ ID NO: 7331 - protein, 108 aa, Triticum aestivum
  misc_feature (18)..(18): Xaa can be any naturally occurring amino acid
  misc_feature (25)..(26): Xaa can be any naturally occurring amino acid
  misc_feature (34)..(34): Xaa can be any naturally occurring amino acid
  misc_feature (36)..(36): Xaa can be any naturally occurring amino acid
  misc_feature (47)..(47): Xaa can be any naturally occurring amino acid
  misc_feature (54)..(54): Xaa can be any naturally occurring amino acid
  misc_feature (57)..(57): Xaa can be any naturally occurring amino acid
  misc_feature (60)..(61): Xaa can be any naturally occurring amino acid
  misc_feature (66)..(66): Xaa can be any naturally occurring amino acid
  misc_feature (68)..(68): Xaa can be any naturally occurring amino acid
  misc_feature (85)..(85): Xaa can be any naturally occurring amino acid
  misc_feature (91)..(91): Xaa can be any naturally occurring amino acid
  misc_feature (102)..(102): Xaa can be any naturally occurring amino acid
MAAISSTSYFSQSQLPAXGGGSNGXXPRRRRVGXCXMLEAASASGSXGGGAVVXRTXSLXXEDLEXLXGCLDLGFSFSYNEIPGXCGTLPXLELCYSMTRRXLDEQRT

SEQ ID NO: 7332 - protein, 135 aa, Oryza sativa
  misc_feature (11)..(11): Xaa can be any naturally occurring amino acid
  misc_feature (35)..(35): Xaa can be any naturally occurring amino acid
  misc_feature (58)..(58): Xaa can be any naturally occurring amino acid
  misc_feature (72)..(72): Xaa can be any naturally occurring amino acid
  misc_feature (121)..(121): Xaa can be any naturally occurring amino acid
MATDGGGSTPXPKEKKANLRDPYSMKHVLNLTASXDAKSKGFPKDARLTNRRLPAGAXSDRRWLLAMLTHRXFEQNRYILLACIELHATLNVALQICTYTQEKNAILLTYPSAGSCNRTGXCISSKEPRLSDMYT

SEQ ID NO: 7333 - protein, 447 aa, Oryza sativa
MAATKSKAAKKGAPLLGKYELGRLLGRGTFAKVYHARSLAPGADPVAVKVLDKPDLAAAGAGMATRVLREVAAMRRLRHPNVLRLHEVLATRSKVYLVMELAPGGDLLSRLASLPSRRLPEHAAQRVFLQLVSALIYCHARGVSHRDVKPQNVLLDAHGNLKVSDFGLAALPDSLRDDGRLHTACGTPAFAAPEVLRRKAYDGAKADAWSCGVILFVLLAGHLPFDDSNIADMCRKAHRREYALPRWVSQPARRLVSRLLDPNPATRLAVAELATHPWFKRSLSLDSQLGSLLGGQPERELAFQAPPPLNAFDIISMSPGLDLSGLFGESKRRREKRFVTTASPERTVERLGQAGAKLGYFMVGKKGVERLPLGGLSGLVAMSMEMSEVSPSMMLVELRLEGGDDGDGDGGAEEFGWEELRAELGDDVVMAWHGCDGGKKDKEGILL

SEQ ID NO: 7334 - protein, 548 aa, Shigella flexneri
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 7335 - protein, 486 aa, Candida albicans
MTTVEQLETVDITKLNAIAAGTNKKVPRVVAAGLGGKLMGTSDLVKVTAEEITKDSMESLAEKDAREKAKYANKKHISEEPWTLDNFAKKINWLNMILVVFIPVFGAYCAWNYPPQWKTLVLTFVMYAFSGISITAGYHRLYSHKSYDAALPVRLFFAFFGAGAIEGSIKWWGHSHRIHHRYTDTPRDPYDARRGFWFSHMGWMLTKANPKNRARADISDLVADWVVTFQHRHYLLLMITAAFIFPTLVAGLGWGDYWGGFIYAGILKGFAIQQATFCVNSLAHWIGVQPFDDRRTPRDHVLTAFVTFGEGYHNFHHEFPSDYRNALKWYQYDPTKVTIWCLSKLGLAWNLKKFSQNAIEQGLVQQQQKKLDRMKNKLNWGAEIEKLPVWTREEFNERAKQEGLIIISGIIHNVKNFIKEHPGGQALVRASLGKDATKAFNGAVYAHSNAAHNLLATMRVAVVKDGEVNADTFDLQEQMMEKEKQS

SEQ ID NO: 7336 - protein, 608 aa, Brassica rapa
MCGILAVLGCVDNSQATRSRIIKLSRRLRHRGPDWSGLHCYEDCYLAHERLAIIDPISGDQPLYSEDKTVVVTVNGEIYNHKALRESESLKSHKYHTGSDCEVLAHLYEEHGEEFINMLDGMFAFVLLDTKDKSYIAVRDAIGVIPLYIGWGLDGSVWFASEMKALSDDCEQFMAFPPGHIYSSKQGGLRRWYNPPWFSELVPSTPYDPLVLRDTFEKAVIKRLMTDVPFGVLLSGGLDSSLVASVAIRHLEKSDARQWGSKLHTFCIGLKGSPDLKAGKEVADYLGTRHHELHFTVQEGIDAIEEVIYHVETYDVTTIRASTPMFLMSRKIKSLGVKMVLSGEGSDEIFGGYLYFHKAPNKKELHEETCRKATPLEFLDHDVSCAYLLCLNLVCLLLMQIKALYQYDCLRANKSTSAWGVEARVPFLDKAFLDVAMGIDPEWKMIRPDLGRIEKWVLRNAFDDEKNPYLPKHILYRQKEQFSDGVGYSWIDGLKDHANKHVSDAMLTNANFVFPENTPLTKEAYYYRAIFEKFFPKSAARATVPGGPSVACSTAKAVEWDAAWKGNLDPSGRAALGVHVAAYEGDKAEAPRPEKVQKLAEKTAEAIV

SEQ ID NO: 7337 - protein, 700 aa, Burkholderia vietnamiensis
MTNSAPSGSQPSAAPQSDSAKARQLDEHCQHPDGEALRTNQGVRIADNQNTLRAGARGPSLLEDFIMREKITHFDHERIPERVVHARGSAAHGVFRVYESMADYTKAAFLQDPAAETPVYVRFSTVQGPRGSADTVRDVRGFAVKFYTEEGNYDLVGNNMPVFFIQDAIKFPDFVHAVKPEAPNEMPTGASAHDTFWDFVSLVPETTHMVLWLMSDRALPASYRAMDGFGVHTFRFVNAAGAEHFVKFHWRPVSGAYSLLWDEAQRIAGHDPDFNRRDLWMAIERGDYPEFELGVQLIDPADARKFDFDLLDPTKLVPEELVPVKPIGRMTLNRNPDNFFAETEQVAFHPGHVVPGIDFTNDPLLQGRLFSYTDTQLSRLGGPNFHELPINRPLCPFANNQRDAMHRQTIAVGQASYEPNSLNGGWPRETPPAPAGGGFETVPEPLEGTKVRVRSESFADHFSQAALFYQSMTDIEQRHIRDAYCFELGKVTKPEIRARVVNEIIARFDAGLAAEVAERLGLPAPQTATTPAVARLAPSLSLVGRAKPTIRSRKIALVATPGVSQALVDQVRSTLAAAGAVPTVVAPTLAPIGSIAPQATLAGMPSVMFDAVFVCGGDGRELANNAEACHFVREAFKHLKPIAAVGSGRQLLSAAHLPDPAEGVCVGHVADLDAVLGAFSGELGRHRVWAREQQAAELPA

SEQ ID NO: 7338 - protein, 247 aa, Datisca glomerata
MALEALNSPTTATPVFHYDDPSLNYLEPWTKRKRSKRTRLDSPHTEEEYLAFCLIMLARGRVASANRRDSQSSIQIQPEATTSATKVSYKCSVCDKAFSSYQALGGHKASHRKLAGGEDQSTSFATTNSATVTTTTASGGGGRSHECSICHKSFPTGQALGGHKRCHYEGSIGGNSIHHHNNTTNSGSNGGMSMTSEVGSTHTVSHSHRDFDLNIPALPEFRSNFFISGDDEVESPHPAKKPRILMK

SEQ ID NO: 7339 - protein, 497 aa, Escherichia coli
MVFPLLVKSNWKNKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATAVVNTIRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 7340 - protein, 396 aa, Danthonia spicata
  misc_feature (124)..(124): Xaa can be any naturally occurring amino acid
  misc_feature (181)..(181): Xaa can be any naturally occurring amino acid
  misc_feature (354)..(354): Xaa can be any naturally occurring amino acid
TGYDRVMVYKFHEDEHGEVVAESRRPDLEPYLGLHYPATDIPQASRFLFQQNRVRMIHDCHATAVRVIQDPGLQQALCLVGSTLRAPHGCHAQYMANMGSIASLVMAVIISSGSDDEQMARGGXSSAMKLWGLVVCHHTSPRFIPFPLRYACEFLMQAFGLQLNMELQLAHQMSEKHILRXQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPDDKDDGLRMHPRSSFKAFLEVVKSRSLPWENAEMDAIHSLQLILRDSFRXAAEGTSNSKAIVBGQVQLGELELRGINELSSVAREMVRLIET

SEQ ID NO: 7341 - protein, 233 aa, Unknown
  Allium sp. AL-2003
VQLKRMENKINRQVTFSKRRNGLLKKAHEISVLCDAEVALIVFSAKGKLYEYSTDSSMEKILERYERYCFAEKSSTMSDIDSQEDWSLEYHKLKAKVESLNNRQRHLMGEQLESLSLREIGQLEQQLENSLKTVRTRKSQELLSSISELQDKEKTLRDENKALENELMKRARAKAILEQQARWKHHNHKQQDNLHNPNINIGNYQTRNNEGGVEPATDVQVRVVRNLLPHWML

SEQ ID NO: 7342 - protein, 161 aa, Zea mays
MSLIRRGSAFDPFSLDLWDPFQGFPFGSGSSSSSSLFPSFGGTTSSETAAFAGARVDWKETPEAHVFKTDVPGLKKEEVKVELEDGNVLQISGERSKEQEEKTDTWHRVERSSGKFLRRFRLPENARTEQISASMENGVLTVTVPKEEAKKADVKSIQISG

SEQ ID NO: 7343 - protein, 1402 aa, Xanthomonas oryzae
MRCRRKELHSHSIVRRYNEVDVRRPELWARNGQREGTNMPKSRWDLRRIYGRRAFFGALLILSAGLIAAIVTGVWLQQHNEREREQRFQYVVRTLTRNISERMSTLEHGLRGARGAVIGAGSDIISRERFTSYSRSRDYPREFPGVLGYGYIHRVAPADEDAFLQNARADGAPDIQRRPLAPWDGERYIVLYFEPESSGNHPLGIDIASDPHRRAAALQAARSGEPIMTSPISLFGYRVPRESGFWLLLAIYREGMPLQTPQQRMVATSGWVYAPFSLAQIVQSALGERDDIALDISDRNEPTHNLYRSGTPAIDSALGPPVVTLLPMYGRTWVITAHPTASFIASLNQNSPWLIGGLVMAGSVLFAALLVLYFSNGLRREEVLRKQMELAALVSHSSEAIVAETPDGRITLWNPAAEAMFGYTAEEAIDQDLTMLLAPQAYAMPEIDHADAALAANASAAQTMHHRDGHQVHVLASKSPIIESEGTLSGHSHFFRDISDRVRSHQRSIDLNASLEHQVAERTGELVKFSVLQRAILAHAGYAIIATDSSGFVTLFNPAAEKMLGYNAAEVIGRRKASQFIEQDELQERARMLADQTGTPVAHTLEAIAALTSLGRSDTSEWTYVSHDGRRLPVLLTLSTLRDDHDQVIGYLGVAVDLTEQKLHEKQLRLAMDAAKSANQSKSDFLANMSHEIRTPMNAILGMLYLLQRSELPGAAQDMVAKIDRSARTLLEIINDILDFSKIEAGRIDLECAPFDLNQLFDNIAELMRSSLSAKPVEMIVEPLPRDSRWLLGDALRINQVLVNLVGNAIKFTEQGEVVLSVRRFPSGDPNKFKLLFSVRDTGIGISKEKQSLIFSPFLQADTSTSRRYGGSGLGLTISRRLIELMGGELEVESVPGRGSEFYFVITLEKSAPPQEQRDLPSLPPEAMPRVLIADDHDAALNNLVRIATELGWRVDAVASGQAALQAIEHAAEPYDIFLLDWRMPDIDGVAIAREIRARATPGPHPVIVMVTAYERRLLEQHPEQQDLDAVMTKPVTGAALHRLFEQLMDQRPGTRAATPTFVARRLEGVHLLLVDDSEINCEVAQRILEGEGAMVTVAHDGEQAVSTLKRTPNLFHLVLMDVQMPVVDGYEATRRLRQIPALASLPVIALTAGAFRPQQEKALAAGMNGFIAKPFNVEELVTAIRHFLQPGTRRIPSLPHETEVYAGPEWEHSEPELLDATRARSLWREREPYARYLTKLLRDNPDPAEVAAEHLRRNELPAIGAMAHKLRGAAGSLALPALADAAGDLETSIDEGHDITASLIALKDVMQRTAEAIQAFLQHGDTDIAADEDGVALDADSVQILTSAFASDNADQIDHALMICAPRLPRTLQEALQRAVEDFDFRRAETTLREWQTTHLH

SEQ ID NO: 7344 - protein, 438 aa, Glycine max
MGEKSNVGGDAINTTLLHGKYELGRLLGHGTFAKVYHARHLKTGKSVAMKVVGKEKVVKVGMMEQIKREISAMNMVKHPNIVQLHEVMASKSKIYIAMELVRGGELFNKIARGRLREEMARLYFQQLISAVDFCHSRGVYHRDLKPENLLLDDDGNLKVTDFGLSTFSEHLRHDGLLHTTCGTPAYVAPEVIGKRGYDGAKADIWSCGVILYVLLAGFLPFQDDNLVALYKKIYRGDFKCPPWFSSEARRLITKLLDPNPNTRITISKIMDSSWFKKPVPKNLMGKKREELDLEEKIKQHEQEVSTTMNAFHIISLSEGFDLSPLFEEKKREEKELRFATTRPASSVISRLEDLAKAVKFDVKKSETKVRLQGQEKGRKGKLAIAADLYAVTPSFLVVEVKKDNGDTLEYNQFCSKELRPALKDIVWRTSPAENPTLA

SEQ ID NO: 7345 - protein, 212 aa, Antirrhinum majus
KAHELSVLCDAEVALIIFSNRGKLYEFCSSTSMLNTLERYQKCNYGPPETNVSTREALELSSQQEYLKLKARYEALQRSQRNLLGEDLGPLNSKELESLERQLDMSLKQIRSTRTQAMLDTLTDLQRKEHALNEANRSLKHRLMDGSQISLQWNPNAEDHVGYGRQPSQPSADGFYHPLECEPTLHIGFQSDQITVAGAGPSVNNYISGWLP

SEQ ID NO: 7346 - protein, 518 aa, Desulfotalea psychrophila
MAGKDIKYGVKARESVLIGVNTLANAVKVTLGPKGRNVLIEKSFGAPTITKDGVSVAKEIELKDKFENMGAQMVKEVASKTSDVAGDGTTTATVLAQAIYTEGVKLVAAGGNPMEIKRGIDKGVEAVIAELRNIATPTKEQKEIAQVGTISANSDETIGNIIAEAMDKVGKEGVITVEEAKSMETTLDVVEGMQFDRGYLSPYFVTDPERMEVIMDDPYILLVEKKVSNMKDLLPVLEQVAKMGKGLFILAEDVDGEALATLVVNKLRGTINVAAVKAPGFGDRRKAMLEDIAILTGGQVISEDLGIKLENVTLNDLGTCKRIVTDKDATTIVDGAGDAAQLSSRVKQIHAQIADTTSDYDREKLQERLAKLIGGVAVINVGAATEIEMKEKKGRVEDALNATRAAVEEGVVPGGGVAYMRWLDALEALHLEGEQELGKKILSVPLKSLFVRLPIMLAVKVLLLLMQLRSLKDQTVSTQLPKFTKTLSLQVLSILPRLPVQPCKTQLLYPVCFSPPSV

SEQ ID NO: 7347 - protein, 469 aa, Caulobacter crescentus
MALGGAALGLSACEGPGETDLTPKGRQFPKDFVWGVATAAFQTEGSQTADGRGPSIWDVFERVPGHVKNGDTAADATDSYRRYQDDVDLIAGASLSAYRFSMSWSRILPTGAGAVNAAGLDHYSRLVDALLAKGITPYATLFHWDLPQGLQDKGGWANRDTAQRLADYARAVVERLGDRLKNYIILNEAAVHTVFGHVLGDHAPGLKDAALLGPVTHHMNLGQGLAIQALRAARSDLSVGTTMALQPCRPAGGPLAFWNRLASDGLDEIWNLAWLDPLFKGTYPKAMEEPLKGVVRDGDLKTTRQPVDFLGVNYYAPAYVRLDLSAPSKIAAAAAPNSAEQDAFGRHIDPSGLFEVLDRVRREYGAPKMLVTENGCSDPFSSGPAILDDTFRIKYLRRHLEAVLAAREAGCDVRGYFEWTLIDNFEWDLGYTSKFGITTMEAASGRRIPKASYGWFKALAQTGTLPSSP

SEQ ID NO: 7348 - protein, 236 aa, Escherichia coli
MGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 7349 - protein, 591 aa, Gibberella zeae
MATAHMAVRTDTFPHSTSRSHSHSHQSMGARIIPIPTPTIKMSPPSNGDPMEITSPAPSSNGNHNSDSEANGNGQSNDRPKNSPAPDSNTVTSNSVNNSNSMPAPPPAAAAVHQPKIVQTAFIHKLYNMLEDPNIQHLISWSASAESFVMSPSADFSKVLSQYFKHTNISSFVRQLNMYGFHKERDVFHTGNPDTTLWEFKHGNGNFKRGDLVGLREIKRRASRHALVHRESNYTKPVTSQPGTPAEPVPLPPDSADARLLNIEHTLFDLSNRLQRSEENAHYMHVKNQAAMETMNRLLHFNQELSRTMLSIVPAESPISRDVIALQGEIQRQVDVLRTIEEPPQEPPYTGRQQYFAGVENAPVSPRQLAQDDQRRGPTLNVPSARSQNFYKPPVPSNLSAGTRRQYGSISGGSTTQSSPLRTAPPPPPPAPHPLSNVETVPGPGSLARRHTAADIRAHGWQPTPSPFASGAPSGAWPPSPSRAAPEEQRIRDSLSTYSLQNASQAHPHSRPTTPPPPFVNGLGGGSDTFGGWSWGSAGRENKNLSVKDHSAPTTRRGSMAHILNPSDTAERSDEDEDPRGDDDRKRKRMQ

SEQ ID NO: 7350 - protein, 1328 aa, Alternaria brassicicola
MAAETYSSVSAIIRNLARQHDPTRDPSFSAQVSANGAKTAVNAIALPGPESDEKTQLQQELSALCSRIDFLEHKSNHAANQQGQFPLTPAQEPSDEGALYTPAGVFRGNNGPPAQGRRGSNKERAIWVSNWLAAKESNGDPEQPAAALTEEQLNYLRVHLNQQADQIRNQREHIDNLSQEVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDINGMAKNLTDQVREIAVVTTAVAMGDLSRKIERPARGEILQLQQTINSMVDQLQSFATQVTKVARDVGTEGKLGGQAEIAGVKGMWNELTVNVNAMAQNLTTQVRDIAQVTTAVAQGNLTRKVEAECKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHKIRTPMNGIIGMTQLTLDTDLTHAQREMLTIVHNLAGQLLTIIDDILDISKIEANRMVMEEIPFSMRGTIFNALKSSASRANERKLNLAYDVSYKVPDYVVGDSFRLRQIILNLVGNAIKLTEPGEVKVAISMAQEQECDPDHYVFQFAVSDTGIGIRGDKLNLIFDTFQQADGSTTRKFGGTGLGLSISKRLVTLMGGRMWVESDAGKGSVFYFTYKVRLGKPAIQAIQPQLVAYKQHTVLFVDQGNTGFSDEITEHLKTLDLVPMVVHSVEEVPETTKRTDMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERDNGIPSTPVIALTAHAMVGDREKCLAAQMDDYLSKPLRQNQLIQTILRCATVGSTMYDHSSEPRYTASSHLPNITLPGKGNDNGGASSSSGGLPSPGKKRPQLEARGFTERGGAQSPNLLAVDQTDNGSVERLLLRSHSS

SEQ ID NO: 7351 - protein, 444 aa, Arabidopsis thaliana
MVRRQEEEKKAEKGMRLGKYELGRTLGEGNFGKVKFAKDTVSGHSFAVKIIDKSRIADLNFSLQIKREIRTLKMLKHPHIVRLHEVLASKTKINMVMELVTGGELFDRIVSNGKLTETDGRKMFQQLIDGISYCHSKGVFHRDLKLENVLLDAKGHIKITDFGLSALPQHFRDDGLLHNTCGSPNYVAPEVLANRGYDGAASDIWSCGVILYVILTGCLPFDDRNLAVLYQKICKGDPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVNQEERTQKGQVGLSVTAEVFEIKPSLNVVELRKSYGDSCLYRQLYERLLKDVGTSSPEQEIVT

SEQ ID NO: 7352 - protein, 483 aa, Proteus mirabilis
  misc_feature (52)..(52): Xaa can be any naturally occurring amino acid
EKKKLTTAAGAPVVDNNNVITAGPRGPMLLQDVWFLEKLAHFDREVIPERRXHAKGSGAFGTFTVTHDITKYTRAKIFSEVGKKTEMFARFSTVAGERGAADAERDIRGFALKFYTEEGNWDMVGNNTPVFYLRDPLKFPDLNHIVKRDPRTNMRNMAYKWDFFSHLPESLHQLTIDMSDRGLPLSYRFVHGFGSHTYSFINKDNERFWVKFHYRCQQGIKNLMDDEAEALVGKDRESSQRDLFEAIERGDYPRWKLQIQIMPEKEASTVPYNPFDLTKVWPHADYPLMDVGYFELNRNPDNYFSDVEQAAFSPANIVPGISFSPDKMLQGRLFSYGDAHRYRLGVNHHQIPVNAPKCPFHNYHRDGAMRVDGNSGNGITYEPNSGGVFQEQPDFKEPPLSIEGAADHWNHREDEDYFSQPRALYELLSDDEHQRMFARIAGELSQASKETQQRQIDLFTKVHPEYGAGVEKAIKVLEGKDAK

SEQ ID NO: 7353 - protein, 145 aa, Alvinella pompejana
MLVKRYEPFNEIRRSFDLVNQIINSVDKNVESDNALVDFIPNINTREDSNAYYIEVELAGVKKEDVDIKIDENILSISGEKRFKDNLKAEDYYKIESKYGTFARSFTLPERVDVSKIEAKSEDGIIEIKIPKLTIEKESKKITIK

SEQ ID NO: 7354 - protein, 543 aa, Streptococcus pyogenes
MAKDIKFSADARAAMVRGVDMLADTVKVTLGPKGRNVVLEKAFGSPLITNDGVTIAKEIELEDHFENMGAKLVSEVASKTNDIAGDGTTTATVLTQAIVHEGLKNVTAGANPIGIRRGIETATATAVEALKAIAQPVSGKEAIAQVAAVSSRSEKVGEYISEAMERVGNDGVITIEESRGMETELEVVEGMQFDRGYLSQYMVTDNEKMVADLENPFILITDKKVSNIQDILPLLEEVLKTNRPLLIIADDVDGEALPTLVLNKIRGTFSVVAVKAPGFGDRRKAMLEDIAILTGGTVITEDLGLELKDATMTALGQAAKITVDKDSTVIVEGSGSSEAIANRIALIKSQLETTTSDFDREKLQERLAKLAGGVAVIKVGAPTETALKEMKLRIEDALNATRAAVEEGIVAGGGTALITVIEKVAALELEGDDATGRNIVLRALEEPVRQIALNAGYEGSVVIDKLKNSPAGTGFNAATGEWVDMIKTGIIDPVKVTRSALQNAASVASLILTTEAVVANKPEPAAPAPAMPAGMDPGMMGGF

SEQ ID NO: 7355 - protein, 242 aa, Unknown
  Gerbera hybrid cultivar
MGKGRLELKRIENKINRQVTFAKRRNGLLKKAYELSVLCDAEVALIVFSTRGKLYEFSSTSSMLKTLERYEKCSFGPPEQRRPAAKEDLQEQSSYQEYMRLKERYDALKRLERNYYGEEIDSLTTSELESLERQLHCSLKQIRTIRTQSLLDKLYEQQKMEHQLYESNKTLRLRLDEEGQAEALQWDAHAHANGMVYAHQHQVSQPMRDTFYHPTGCETTLQIGYQSEQMSAVNHQMQGWPA

SEQ ID NO: 7356 - protein, 1314 aa, Debaryomyces hansenii
MSSHQRQDSIASLSSTATGNIHPQKIGPWKLGKTLGRGATGRVLLATHQSTGQKAAVKVVSKSELNDDEINKKSADEAGLPYGIEREIIIMKLLTHPNVLRLYDVWETSKALYLVLEYVEGGELFDLLVERGPLQEVEAIKYFRQIILGTAYCHALGICHRDLKPENLLLDSGLNVKLADFGMAALESNGKLLETSCGSPHYAAPEIVSGLKYHGAASDIWSCGVILFALLTGRLPFDDENIRNLLLKVQAGSFEMPCELSPEAVDLIDKMLTVDPMKRIPTERILSHPLLTKYPIPNEDLISVKSLPHPETAYKSLGSEKNIDKQILQNLSILWHDRSQGDIVDCLLKTGSNPEKTFYALLMRYRHNQEESAGSSPTRSNSQNFNNKIGNKDNNRKKRMSQVSASTSRNRPVLFQYKNGIKSSIGNGNGRLSSTSSVSNSPRKSPVRRSSNRYSFAQSPRKFGGTSDETTLHSSSVPRNIYNEIVSAQRNGQGVMPPPLPSKDNMDSKSNPIVDEVSNQDLLSSAKISPTKNKRGSVIRNSISKNRLSRRKSRTSFTPGLKRNSITTKLLSTYAKLAGETDWEFMDKQTKRTSATFATLCDKIFNQEQYDAEDEKLIDEEEKQAKEYERLMEIERKKHEAELRARKELAKQRKREKRKSLLSSRKLSILVKDDANNSEQDITVTDSDALSQPKRQSRNQAMRSISEGHGKESDDLTKEDLENLKRRSVTQPTPRRRKTPVLTRRPVSRLDPLWTAYENEEIERAQDALEAEYRDADFKTKKKINRESMVSVMDDKEVDNEPHVDDDATDEVQDEEAVKAKSRGYELPEPDMERSDLSDEYMSEIRKSRLLNSQLNINAIANGEKEVKSEKRQDKEPKTLIGDVRIPTVTRKSRCFTNSNKRLSVLSMYSTKQSYRDLNSILGDENDENNDVEGQLPQLRTSFADRLDRAGLADAEEEDDEPLDEGSIMDFDQHLANKRSSYYAGDKSRRQSRYSTTKRNSQAPTVDVPAIPKKSNKERDREDDTFVTKDDDVHRRKSAYSAKGANNNDDEDMIFENIKLPNEDRRQSASTAKSNKKKSFQPSAESMLIPNVDNIPEDAKTRKPDPRSQPYEKVRKPKVSNGELKSTGPEGQVKNPLEDTTNEPRENQKRKGSIFRKLSWGSKKTMDNSAAQLPSPADSRAPSVEEKPKSKSGFFRWFSSSSNQPGIESEIRRFKAILPKQEMSSALFALLNSWSNFGLKNLRNDTVGYNITGEISKNNAFNLKNCKFRIKVNPREFNQKSEIVCARVKGSKVTTDTLFKEIEKVLQKEGVMDI

SEQ ID NO: 7357 - protein, 569 aa, Triticum aestivum
MALLAAATLNPTTHLSLRSRAGRNSENLWLRSAASSQKSKGRFCNLTIRAGTPSKPAEPIGPVFTKLKPWQIPKRDWFDKDFLFGASTSAYQIEGAWNEDGKGPSTWDHFCHTYPERISDMTNGDVAANSYHLYEEDVKALKDMGMKVYRFSISWSRILPDGTGKVNQAGIDYYNKLINSLIDNDIVPYVTIWHWDTPQALEDKYGGFLNRQIVDDYKQFAEVCFKNFGDRVKNWFTFNEPHTYCCFSYGEGIHAPGRCSPGMDCAVPEGDSLREPYTAGHHILLAHAEAVQLFKARYNMHGDSKIGMAFDVMGYEPYQDSFLDDQARERSIDYNMGWFLEPVVRGDYPFSMRSLIGDRLPMFTKEEQEKLASSCDIMGLNYYTSRFSKHVDMSPDFTPTLNTDDAYASSETTGSDGNDIGPITGTYWIYMYPKGLTDLLLIMKEKYGNPPVFITENGIADVEGDESMPDPLDDWKRLDYLQRHISAVKDAIDQGADVRGHFTWGLIDNFEWSLGYSSRFGLVYIDKNDGNKRKLKKSAKWFSKFNSVPKPLLKTTNNNATMTAASVSV

SEQ ID NO: 7358 - protein, 238 aa, Oryza sativa
ENSTNRQVTFAKRRNGLLKKAYELSVLCDAEVALIVFSNRGKLYEFCSTQSMTKTLEKYQKCSYAGPETAVQNRESEQLKASRNEYLKLKARVENLQRTQRNLLGEDLDSLGIKELESLEKQLDSSLKHVRTTRTKHLVDQLTELQRKEQMVSEANRCLRRKLEESNHVRGQQVWEQGCNLIGYERQPEVQQPLHGGNGFFHPLDAAGEPTLQIGYPAEHHEPMNSACMNTYMPPWLP

SEQ ID NO: 7359 - protein, 108 aa, Arabidopsis thaliana
HRDEEVNYFPSRYDQVRHAEKYPTPPAVCSGKRERCIIEKENNFKEPGERYRTFTPERQERFIQRWIDALSDPRITHEIRSIWISYWSQADKSLGQKLASRLNVRPSI

SEQ ID NO: 7360 - protein, 392 aa, Janusia mediterranea
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPSVKVIQDERLPQPLSLCGSTLRSPHGCHAQYMTNMGTIASLVMSVTVNEDDDTMDGDQQQMARKLWGLVVCHHTSPQFVPFPLRYACEFLIQVFGVQITKKVELAAQVREKHILQIQTMLCDMLLRDAPVAIITQSPNVMDLVKCDGAALYFKSKTWFLGVTPTEEQIRDIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDMEMDAI

SEQ ID NO: 7361 - protein, 392 aa, Janusia linearis
DLEPVNPADVPVTAAGALKSYKLAAKAISRLQSLPSGNISLLCDVLVKEVRDLTGYDRVMVYKFHEDEHGEVVSECRRSDLESHLGLHYPATDIPQASRFLFMKNKVRMICDCLAPPVKVIQDERLPQPLSLCGSTLRSPHGCHAQYMTNMGTIASLVMSVTVNEDDDTMDGDQQQMTRKLWGLVVCHHTSPQFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDMEMDAI

SEQ ID NO: 7362 - protein, 492 aa, Zea mays
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYSLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAISVPAIHYSDDKLLQTRIFSYADTQRHRLGPNYLMLPVNAPKCAHHNNHHDGFMNFMHRDEEVNYFPSRFDPARHAEKVPIPPRVLTRCREKCIIQKENNFKQAGERYRSFDPARQDRFIQRWVDALTHPRVTHEHRTIWISYWSQCDAALGQKLPSRLNLKPSM

SEQ ID NO: 7363 - protein, 392 aa, Janusia californica
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNEDDDTMDGDQQQMTRKLWGLVVCHHTSPQSVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDIEMDAI

SEQ ID NO: 7364 - protein, 392 aa, Gaudichaudia mcvaughii
DLEPVNPADVPVTAAGALKSYKLAAKAISRLQSLPSGNISLLCDVLVKEVRDLTGYDRVMMYKFHEDEHGEVVSECCRSDLESYLGLNYPATDIPQASRFLFMKNKVRITCDCLAPSVEVIQDERLTQPLSLCGSTLRSPHGCHAQYMTNMGAIASLVMSVTVNEDDDTMDGDQQHMTRKLWGLVVCHHTSPRFVPFPLRYACEFLIQVFGVQVNKEVELAAQVRERHSLQIQTMLCDMLLREAPVAIITQSPNVMDLVKCDGAALYFKNKTWFLGVTPTEEQIRGIAEWPLKYHSGNTGLSTDGLMEAGYPGASGLGDAVCGMAAVSITSRDFLFWFRSHTAKEIKWGGAKHDPDDKDDLRKMHPRSSFKAFLEVVKWRSTPWEDIEMDAI

SEQ ID NO: 7365 - protein, 379 aa, Methanococcoides burtonii
MEENGKTKEEILLFLKKAKSADASYERVLSSMCTYPHEIAVLAHTQFIESNMGDPGLFPGTFNLEKQVLAMFGKMLHHKNSPEKAGYLTTGGTESNIQAIRSMHNFRHDISRPNIVMPESAHFSFDKVANLSGIEIRKASLDKLLKVDLDSVRSLIDKNTIGLVGIAGTTEFGQLDPINELSKIAIEKGIFLHIDAAFGGFVIPFMDIDYTYDFRLEGVTSMTIDPHKMALSTIPSGGLLFKEPEYFECLEIHTPYLSVNKQYSLTGTRSGAGVASTYAVMKHLGRKGYKKVVSDCMSVTKKLVDGAEKLGINTVIDPVLNIVALDVPEADLVRKKLLDEYGWHVSITRNPRALRIVIMPHIKNETIELFLKDLAKVIK

SEQ ID NO: 7366 - protein, 332 aa, Prosthecochloris aestuarii
MNKLITIERHFLEQQKSHPEATGELTDLLNDVAFAAKLVRREVVRAGLADILGMAGTTNVQGEEVKKLDLFANEKIINAIGEHGRFALMGSEENEGTIIPPNNDTGRYILLFDPLDGSSNIDVNVSVGTIFSIYRLTGDDPKEADINDCLQKGSEQVAAGYVIYGSSVMMVYTTGQGVHGFTYDPTIGEFLLSHENITTPERGKYYSINEGSLHQFNDSTVNFINYLKEDDEATGRPYSTRYIGSLVADFHRNLMTGGVFVYPATKGHPNGKLRLMYEANPLAFICEQAGGRATNGKERILDINPTELHQRTPLYIGSKEDVLKAEEFEKEG

SEQ ID NO: 7367 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFVDMLDGIFSFALLDTRDNSFIVARDAIGVTSLYIGWGLDGSVWISSELKGLNDDCEHFESFPPGHLYSSKERAFRRWYNPPWFSEAIPSAPYDPLALRHAFEKAVVKRLMTDVPFGVLLSGGLDSSLVAAVTARYLAGTNAAKQWGTKLHSFCVGLEGAPDLKAAKEVADYIGTVHHEFHYTVQDGIDAIEDVIYHIETYDVTTIRASIPMFLMSRKIKSLGVKWVISGEGSDEIFGGYLYFHKAPNKDEFHQETCRKIKALHKYDCLRANKSTFAWGLEARVPFLDKDFIRVAMNIDPEYKMIKKEEGRIEKWVLRRAFDDEEHPYLPKHILYRQKEQFSDGVGYGWIDGLKAHAEKHVTDRMMLNAANIFPFNTPTTKEAYYYRMIFERFFPQNSARLSVPGGPSVACSTAKAVEWDAAWSNNLDPSGRAALGVHASAYGNQVKAVEPEKIIPKMEVSPLGVAI

SEQ ID NO: 7368 - protein, 392 aa, Aspicarpa hirtella
DLEPVNPADVPVTAAGALKSYKLAAKAISRLQSLPSGNISLLCDVLVKEVRDLTGYDRVMVYKFHEDEHGEVVLECRRSDLESYLGLHYPATDIPQASRFLFMKNKVRMICDCLAPPVKVIQDKRLPHPLSLCGSTLRSPHGCHAQYMTNMGTIASLVMTVTVNEDDDMMDGDQQHMTKKLWGLVVCHHTSLRFVPFPLRYACEFFIQVFGVQINKEVELAAQVREKHILQIQTMLCDLLLRDAPVTIITQSPNVMDLVKCDGAALYFKNTTWLLGVTPTEEQIRGIAEWLLKYHSGNTGLSTDSLMEAGYPGASGLGDAVCGMAAVSITSRDFLFWFRSHTAKEIKWGGAKHNPDDKDDLRKMHPRSSFKAFLEVVKWRSMPWEDIEMDAI

SEQ ID NO: 7369 - protein, 251 aa, Brassica oleracea
MGRGRVEMKRIENKINRQVTFSKRRAGLLKKAHEISILCDAEVSLIVFSHKGKLFEYSSESCMEKVLEHYERYSYAEKQLKVPDSHVNAQTNWSVEYSRLKAKIELLERNQRHYLGEDLESISIKELQNLEQQLDTSLKHIRSRKNQLMHESLNHLQRKEKEILEENSMLAKQIRERESILRTHQNQSEQQNRSHHVAPQPQPQLNPYMASSPFLNMGGMYQGEYPTAVRRNRLDLTLEPIYNCNLGYFAA

SEQ ID NO: 7370 - protein, 479 aa, Thiomicrospira crunogena
MKTLVWLQRELRINHHPALEAAMAASDDIIVAYFHDPEQTIGAANTVWLANSLQQLQQDFKTRHGRLWCLEGIFEQQLEQVIQTHQIEQVFYTFQLGHPFKAMQQQALNVCQRCQVPLRAFETENWLHYNQLLNQSGQPYKVFTPFYNTLSRKLSELEPFSDPIDTLEKTARTVCQSGQDQNLPQSLNQILARPWARKIMQHWQVGEHKAWSKFETFITEGLANYEQDRDFPAIDGTSQLSPHLHFGELHSRAIVFELLSLETEPTIANQAIRVWLRQLAWREFARAILWHFPHTETHPFQAKFETFYRPLAEDDSESSKNYQAWCEGRTGVPIIDAGMKQLWETGWMHNRVRMLVASWLTKNADIDWRAGAQWFNDTLVDADPANNTLGWQWVAGCGVDAAPYYRLFNPVRQSEKFDANGQYLRQWLPELKTYSNKHIHAPWLIAPNEKHFCPIIDLTESRQHHLDKVATLKSLNQIH

SEQ ID NO: 7371 - protein, 574 aa, Chlorobium tepidum
MSWFTTQRHSGLCRDFGRRWRRVATISSAIALICAQPLFAVPAAKPNEDFFSIAKSIELLGDVYKNVAQNYVDPVNVSEFMYSGIDGMLGQLDPYTAFLDEEQSGELDEITSGQYAGIGVTLGIFSGDLFIISVIDGQPAAKAGLKVGDQIIAIDGVKVSKKSIDEVRSTIKGSPGTNIRLSIKRDGQGPLTVISLTRGEVRISSVPFFGLFGSSGYVQMNSFSEHSREELSAAIRKIRQEAAKNRVVLNGIVLDLRGNPGGLLTSAVEVAGLFVEKNSRIVSTRGRAADSEQVYVTKTEPQEPTLPLVVMIDGDSASASEIVSGAIQELDRGVILGENSFGKGLVQSIINLPYDHILKMTTAKYYTPSGRLIQKPIARDESRRKVVLSNGDADSTKVFYTRNRRKVYGGGGIRPDVVAKADSLSEYQHKIENSGLLFRYASRFHRKHPEFRLQQLSSEPLYDDFNRFLEKEHFSFRSGAQKTLDSLKTLVQKEAGADKALAGQLDALDKALAASTRRNISRDSLHITAALQREIMRHYDERAALKRAIEDDPVAAKAFALLGDQKRYRSLLKP

SEQ ID NO: 7372 - protein, 270 aa, Glycine max
EGNEKGLQPRINLQGYLLGNPITTRNEGNDQIPFAHGMGLISDELYASLQRNCKGEYENRDSRNVLCLRDLKHYDECLSGINTFYILDRYCKSDSPKKHEAQWRRSLTQKFEASLNSHLRVPDIRCQIFGFFLATQWANDESVRKSLHIREGTIGKWERCYTTDFEEQIFSSFEFHVNLSAKGYRSLIYSGDHDAVVPFMSTQAWIRALNYSIVEDWRPWLLEDQVAGYTRIYSNQMTFATVKGSGHTAPEYKPEEGFAMFSRWIANMPL

SEQ ID NO: 7373 - protein, 217 aa, Chelidonium majus
  misc_feature (211)..(211): Xaa can be any naturally occurring amino acid
VKKAHEISVLCDAEVGLIVFSTKGKLFEFSSESSMDNILERYERQCFVEEELKATHPESEGNWSLEHTKLKARIEILQKNQRHFMGEDLDPLSLKELQNLEHQLDIALKHVRSRKNQLLYASIAELRKKEKALHEQNILLGKKIKQKEEQIAQWSAQQNDAQNSSSFLTQAPQNSQSFLTQALPSLTLRTGYYQTARVVVCEEDGARSNMXMPPWML

SEQ ID NO: 7374 - protein, 362 aa, Dechloromonas aromatica
MIGDTMQFGRTTLSKFVIENTRASHGELGALLIDVAAAVKTISAMVAKGALAGHHGALDSTNVQGEVQKKLDVLTNDAILRHCEWGGQLAGMASEEMDDPYPIPAEYPRGRYLLVFDPLDGSSNSDVNVSVGTIFSIFSRRAAGDAELGDYLRPGSEQVAAGYAIYGPSTMMVLTLGNGTHGFTLDRESGNFILTHANIRVPEDTREFAINTSNERFWEPPVQRYVSECKAGKSGVRGEDFNTRWIASMVAEVHRILIRGGIFMYPKDSKDPSKPGRLRLLYEANPMAMLIEQAGGAASTGRQRILDVVPDSLHQRAPVILGSKNEVERLARYHHEYDTGADRPFVSPLFSERSLFRDESRA

SEQ ID NO: 7375 - protein, 782 aa, Pseudomonas syringae
MDISLKNRLSFKQARLAVLIGFALGTLLSLFQIAIDYASEDASINREIKSLLEIIQNPASRIAYNIDSELAQELTLGLLRSPAVVSARLTDNNDAVLASVERPMATGRYRVFSDWLFGESRQFQEKLHLNHLPDETIGTLYLTVDTFAFGSHFLQRAEITLLNGFVRSLALAGILTILFYATLTKPLVRVIRELSSRDPRNPDQGKITCPPHHEQDEIGVLVATFNRQFETMGSEFSRRRAAEDRLTEHLNELENIVSARTNELKASNIRLRESNEELQIARSTALDMAHARSAFLAHMSHEIRTPLNGLLGMLALSLDSPLSAEQRQQLMIAHDSGKVLVELLNDILDMSKFDAGHLEIERIPFDLGVLIEDTANLLSQNAAPSVELTCLIAPDFPAMVTGDPTRVRQIVSNLLSNALKFTRFGRVDVRLTHHKDVSGENRVRIEVRDTGIGIAQDAQAKIFQPFTQAETAITRQYGGTGLGLALTNNLCEAMNGTLSIQSQSGFGSQFCAELPLPVHVSAVTQTALRGRVTVVSSAGSGLVELLGNLLPTWGVDLKRRSIDDRPEDVDLDSSPDLVITDCPECLFAIRPTTPVPILLVTAYGNFMPGEQVTALAPLQQQARPLARNALYHTLRRVLGQEETGVRDTKAPEQTAQRMARVLLVEDNPVNQLVAKGILGKLGCEVIISSHGGEALEQLEQGHFDLVLMDCNMPVMDGYEASRQIRSSGRWPNLPIVALTANAMPDERERCKAAGMNDYLAKPFRRAELAGILDQWIPIADIR

SEQ ID NO: 7376 - protein, 219 aa, Chelidonium majus
  misc_feature (12)..(12): Xaa can be any naturally occurring amino acid
GLVKKAHEISVXCDAEVALIVFSTKGKLFEYSTDSGMERILERYERYSYAERELVASELDQGNWSLEYTKLKAKIEILQKNQRHFMGEDLESMSLKELQNLEQQLDTALKQIRSRKNQLMYESISELQKKEKVLQEQNNQLGKKLKEKEKEVAQQQAQWDQQSQGQSSPSFLLSQSLPSLNIGGSYHMRGSNGSEEEGVRPQTTRTNTTLMPPWMVHHL

SEQ ID NO: 7377 - protein, 1299 aa, Unknown
  Nostoc sp. PCC 7120
MTTDRDSSSKKFGLSPEQFAALFPFHLVIDRELKIVQAGEVIQRILEPMVLLDSYLGEHFQISRPKCLTSFEGICQQTRSLFILQAHYQEIQLKGQMLNLESRDHLLFLGSPWITDIADLKNLGLKINDFPLHDSVSDYLFLLQAKNSALADAQKLTTKLKDQKTELQTTALRLRTLIESLQSGILLEDANQHIILVNQEFCDYFRIPLPPQALQGMDCQQALEASKHLFTEPERFICTTDEIIRQGKMFLHQEWELQDGRTLEQNYIPIVVDHKLYGHLWKYRDITQYKKSEVALRLSEERLKLAVDAVEEGLWDWNLVTGEVYRSARWFTMLGYTPMEIGNDIKFRDKLIHPDDIPLMQQRLISHLKGDTPFYEVEIRLLAKSGEWRWILDRGKLVSRDSQGRAIRMVGTHLDITQRKQAEQDLQQQYQHTLLLKQITEEIRQSLQWEKILKTTVTEVQRILQVDRALIFQINSDGSGKVVQEAVMPGWSVTLDQDIYDPCLKDGYLNMYRDGRITAIADVYQGGLKPCYVEFLQQFQVKANLVVPIRVRRNLWGLLIVHQCDRPRQWTELELDLLKHLADQMGIALTQSQLLAQETRQAQLLALQNEELNVAKQVAEKANMAKSNFLATMSHEIRTPMNAIIGMSGLLLDTTLKPEQFDYVETIRNSSHTLLTIINDILDFSKIESGKLELEEQPFDLRLCVEEALDLLAPQAASKGIELMYQLEPDTPTLVVGDITRIRQILWNLVSNAVKFTKIGEICITIGAKQKIYKQTDPTRYEFQFAVQDTGIGIERDRLHRLFKPFSQVDASMTRRYGGTGLGLAISKRLSEIMGGKMWVESQSHQGSIFYFTATLQVNSSAINSAAKVDPELVGKRLLLAVGNANLRKCLTRQLQSLGLDVQAVDSNATALHCLWQHTSLALAVLDVDSPQINGLHLSTKIRAIPQHQNLPLVMLSAKGKQTLEVKQVASEFTAFLHKPLRHYQLHNTLLQIVRGKWLSKSTPQGIIPSYSRLPKPNLPAIDTHLAENLPLKILLVEDVLVNQKIAMNMLHLLGYRTDVANNGLEALEALQRQLYDVVFMDIQMPEMDGWETTHKIRQEFSPTLQPWIIAMTAHARPEDRQQCLAAGMDDYISKPISLEDITTALKKFGSQRQPALESPASVSISAPPAPTPQPKIEEVIDQQTLEYLRNLGGSDEADEDGGGSSIITELIQLYLEDTPAKIQAIQDAATLEDRSQLARIAHALRSPSVSIGAINLGKICETVEDEAKEQSMDQLTALVNQLNNEYQNVVAALKTLIF

SEQ ID NO: 7378 - protein, 218 aa, Corylopsis sinensis
GLVKKAHEISVLCDAEVALIVFSTKGKLFEYSTDSCMEKILERYERYSYAERQLVATDPNSQGNLSLEYSRLKAKVELLQRNQRHFLGEDLDSLSLRELQTMEQQLDTALKRIRSRKNQLMYESISELQKKEKAMQEQNNMLAKKIKEKEKTMTQQAQWEEQNQDPGAASFLLQQPLPCLNIGNTYNQGVGGGAPEVRRNELDLTLEPVYPCHIGCFA

SEQ ID NO: 7379 - protein, 229 aa, Corylopsis sinensis
VQLKRMENKINRQVTFSKRRAGLLKKANEISVLCDAEVGLIVFSTKGKLYDMERIFDRYERYSYAERQLVVTNHESQGSWTIEHAKLKARMEVLQRNQRHFMGENLDSVSLKELQNLEHQLDNALKHIRSRKNLLMQESISELQRKDKSLQEENNSLSKKIKEKENALAHRAQWEQQNQGLNSFPILLSQPPQSLNIGTYQTGCSEGEEGTPFQQRPNTLLPHWMVSHL

SEQ ID NO: 7380 - protein, 338 aa, Listeria innocua
MSKLFSEYKLKDVTLKNRIVMSPMCMYSVENKDGIATDFHFAHYVSRAAGGTGLVILEATAVQEVGRISEFDLGLWNDEQVPALKRLVDGLHYHGAKAGIQLAHAGRKAVLPGEIVAPSAIPFDEKSAKPVELTKEAIKEVVADFKRAAYRAKEAGFDVIEIHAAHGYLIHQFLSPISNRREDNYGGPAGNRYKILSDIIKAVKEVWDGPIIVRVSATDYAHGGLQLEDHIPFAKWMKADGVELIDVSTGGLVNVEPPVFPGYQVPFADEIRRGAGIATGALGLITRGEQAEEILCNERADLIIIGRELLRNPYFAKEAAETLGETIEAPKQYSRAWK

SEQ ID NO: 7381 - protein, 539 aa, Tsukamurella tyrosinosolvens
  misc_feature (426)..(426): Xaa can be any naturally occurring amino acid
MAKTIAFDKKARRGLERGLNALADAVKVTLGPKGRNVVLEKKWGAPTITNDGVSIAKEIELEDPYEKIGAELVKEVAKKTDDVAGDGTTTATVLAQALVREGLRNVAAGANPLGLKRGIEKAVEAVTEHLLKAAKEVETKDQIAATAGISAGDPAIGELIAEAMDKVGKEGVITVEESNTFGLQLELTEGMRFDKGFISGYFATDAERQEAVLEDPYVLLVSGKISTVKDLLPLLEKVIQSGKPLAIIAEDVEGEALVTLIVNKIRGTFKSVAIKAPGFGDRRKAMLQDMAILTGGQVISEEIGLSLDTAGLEVLGQARQVVVTKDETTIVDGAGSKEQIAGRVSQIRAEIENSDSDYDREKLQERLAKLAGGVAVIKAGAATEDLKERKHRIEDAVRNAKAAVEEGIVAGGGSSLAQSGTVFDSXALEGDEATGANIVKVALDAPVKQIAVNAGLEPGVVAEKVRNSPAGTGLNAATGVYEDLLAAGINDPVKVTRSALQNAASIAALFLTTEAVVADKPEKAGAPVDPTGGMGGMDF

SEQ ID NO: 7382 - protein, 340 aa, Brassica rapa
MDHEADAYRTDLMTITRFVLNEQSKYPESRGDFTILLSNIVLGCKFVCSAVNKAGLAKLIGLAGDTNIQGEEQKKLDVLSNDVFIKALVSSGRTSVLVSEEDEEATFVESSKRGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAAEENN

SEQ ID NO: 7383 - protein, 686 aa, Pseudomonas aeruginosa
MAFEAMFQPIQIGKLTIRNRVLSTAHAEVYATDGGMTTERYVKYYEEKAKGGIGLAICGGSSVVAIDSPQQWWSSVNLSTDRIIPHFQNLADAMHKHGAKIMIQITHMGRRSRWDGYHWPTLMSPSGIREPVHRATCKTIEVEEIWRVIGNYAQAARRAKEGGLDGVELSAVHQHMIDQFWSPRVNKRTDEWGGSFEGRMKFGLEVLKAVRAEVGEDFCVGMRICGDEFHPDGLSHEDMKQIAKYYSDTGMLDFIGVVGSGCDTHNTLANVIPNMTFPPEPFLHLAAGIKEVVDVPVLHAQNIKDPNQATRILEGGYVDMVGMTRAHIADPHLIAKIKMGQVDQIKQCVGANYCIDRQYQGLDVLCIQNAATSREYMGVPHIIEKSAGPKRKVVVVGGGPAGMEAARVAAERGHDVTLFEKKEQLGGQITTAAKAPQRDQIAGITRWYQLELARLGIDLRLGTAADPETILDLRPDVVVLANGGHPFLEQNEHWGAADGLVVSSWDVLDGTVEPGKNVLVYDTICEFSGMSVADFLADKGAQVEIVTDDIKPGVAIGGTTFPTYYRSMYPKEVIMTGDLMLEKVYREGDKLVAVLENEYTGAREERVVDQVVVENGVRPDESLYYALKQGSRNKGQIDVEALFAIQPQPCLSQPGEGYLLFRIGDCVAQRNTHAAIYDALRLCKDF

SEQ ID NO: 7384 - protein, 479 aa, Unknown
  Polaromonas sp. JS666
MGQKLKIAGWISIGAVAGALTTVQLQAVARGGLTPLPLEELQQLAAVFGMVKTDYVEPVDEKKLITDAISGMVASLDPHSVYFDKKSYKEFREGTSGRFVGVGIEISQEDGLVKVVSPIEGSPADRAGLKPNDLITRIDDTAVKGLSLNDAVKKMRGEPKTKVLLTIFRKDENRTFPVTITREEIRTQSVRSKVVEPGYAWIRLSQFQERTVEDFVTKLEQIYKQEPNLKGLVLDLRNDPGGLLDAAVAVSAAFLPENVTVVSTNGQLAESKFTYKASPEFYQRRNGADPLKRLPAAIKKVPLVVLVNEGSASASEIVAGALQDYKRATIMGNQTFGKGSVQTVRPLGPDTGIKLTTARYYTPSGKSIQARGIVPDVMVDDTAEGSPFAALRTREADLEKHLNSGQGSEVKDASREKAREEALKRLEEEAKKTPEQRRPPELGSDKDFQLAQAINQLKGRPVLVSKTAVVEPKNEKKEN

SEQ ID NO: 7385 - protein, 222 aa, Brassica rapa
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIGRDIKQRLSDTDSRAEPATIRISQTDQELDCAGHTEVCMLWKLKTNYIN

SEQ ID NO: 7386 - protein, 370 aa, Cucumis melo
QMGLAENQLSFDLLESWLTKNPDAASFKRDGKSIFRELALFQDYHGLPAFKKALVEFMAEIRGNKVTFEANNIVLTAGATSANETLMFCLAEAGDAFLLPTPYYPGFDRDLKWRTGVEIVPIHYTSSNGFQVTQPALEQAYKEAESRNLRVKGVLVTNPSNPLGTTMTRNELDLVFDFITSKGIHLISDEIYSGTVFGSPGFVSAMEVLKERSNEEEEVWKRVHIVYSLSKDLGLPGFRVGAIYSNDVMVVAAATKMSSFGLVSSQTQYLLSAMLSDKKFTRTYISENQKRLKQRQKMLVSGLEKAGIKCLESNAGLFCWVDMRHLLESDTFESELKLWKKIGYEVGLNISPGSSCHCTEPGWFRVCFAN

SEQ ID NO: 7387 - protein, 643 aa, Shewanella oneidensis
MCGFAGFFNTSNLTDHARILECMGLELFNRGPDSFGIWFNSDDRIGLVHRRLAIVDLSAAGHQPMTSDSGRYIISYNGEIYNHQELRDELESIRQYNWRGHSDTETLLAAIEQWGLKITLQKATGMFGIALWDTLNKELYLARDRFGEKPVYYGLHKDAFIFASQLNAFRAYPDFKPEINRDSITLLLRHNYIPAPYSIYSDIHKLLPATILKLDSNNNISLETYWSAKDIMSNASSTETDLPVGKQVEALENTLKKAVALQMSADVPLGAFLSGGVDSSLIVSLMQAQSNKPVKTFSIGFDDPRFNEAVFAKEVAKHLGTEHTELYLTAEDALEVIPKLAEIYDEPFSDSSQIPTFLVSKIARQYVTVSLSGDAGDELFCGYNRYLMTSKVWKRLSVLPVFLRSFLANVFTFVPVNVWNLFGKLLPSRLQLSNLGDKLHKAAAVLACRDVEQLYLGLVSHWQNPEQVVLGSKEPLTVLTDPKRKANFSDPILQMMAQDTLSYLTDDILVKVDRAAMAVSLETRVPFLDHSVLEHAWRLSLDLKLRDGKTKWCLREILYKYVPKDLIERPKMGFAVPLDAWLRGPLKVWADNLLAAERLRQEGFFDAELIDRMWQEHKSGKRNWQYQLWDILMFQSWYEKYHK

SEQ ID NO: 7388 - protein, 392 aa, Gaudichaudia albida
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMIYDCLAPPVKVIQDKRLPQPLSLCGSTLRSPHGCHAQYMTNMGTIASLVMSVTVNEDDDTMDGDQQHMTKKLWGLVVCHHTSPRFVPFPLRYACEFLIQVFGVQINKEVELAAQVREKHILQIQTMLCDMLLRDAPVTIITQSPNVMDLVNCDGAALYFKNKTWLLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDIEMDAI

SEQ ID NO: 7389 - protein, 353 aa, Saccharomyces cerevisiae
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEYVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHYKEALTTKDLKKLIWNEIFS

SEQ ID NO: 7390 - protein, 474 aa, Arabidopsis thaliana
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLNMFTFLFDDIGIPQDYRHMDGSGVNTYMLINKAGKAHYVKFHWKPTCGVKSLLEEDAIRVGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCIIEKENNFKEPGERYRTFTPERQERFIQRWIDALSDPRITHEIRSIWISYWSQV

SEQ ID NO: 7391 - protein, 392 aa, Gallardoa fischeri
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDEQLPQPLSLCGSTLRSPHGCHAQYMTNMGTIASLGMSVTVNEDDDMMDGDQHQMTRKLWGLVVCHHTSPRFVPFPLRYACEFLIQVCGVQINKEVELAAQVRKKHILQIQTMLCDMLLRDAPVAIITQSPNVMDLVKCDGAALYFKNKIWLLGVTPTEEQIRDIAEWLLKYHSGNTGLSTDSLMEAGYPGASALGDAVCGMAAVSITSRDLLFWFRSHTAKEIKWGGAKHDPDDKDDLRKMHPRSSFKAFLEVVKWRSKPWKDVEMDAI

SEQ ID NO: 7392 - protein, 392 aa, Peixotoa glabra
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVQVIQDERLPQPLSLCGSTLRSPHGCHAQYMTNMGTIASLVMSVTVNEDDDTMDGDQQQMTRKLWGLVVCHHTSPRFVPFPLRYACEFLIQVFGVQITKEVELAAQVRKNHTLQIQTMLCDMLLRDAPVAIITQSPNVMDLVKCDGAALYFKNKTWLLGVTPTEEQIRDIAEWLLKYHSGNTGLSTDSLMEAGYPGASTLGDAVCGMAAVSITSRDFLFWFRSHTAKEIKWGGAKHDPDDKDDLRKMHPRSSFKAFLEVVKWRSMPWEDVEMDAI

SEQ ID NO: 7393 - protein, 392 aa, Ryssopterys timorensis
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVLQDERLPQPLSLCGSTLRSPHGCHAQYMTNMGTIASLVMSVTINEDDDMMDGDQQQMTRKLWGLVVCHHNSPQFVPFPLRYACEFLIQVFGVQINKEVELAAQVREKHILQIQTMLCDMLLRDAPVAIITQSPNVMDLVKCDGAALYFKNKTWLLGVTPTEEQIRDIAQWLLEYHSGNTGLSTGSLMEAGYSGASALGDAVCGMAAVSITLRDFLFWFRSHTAKEVKWGGAKHDPDDKDDLRKMHPRSSFKAFLEVVKWRSMPWEDIEMDAI

SEQ ID NO: 7394 - protein, 654 aa, Zea mays
MDGCDCIEPLWPTDDLLVKYQYISDFFIALAYFSIPLELIYFVKKSSFFPYRWVLIQFGAFIVLCGATHLINLWTFTTHTKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLFHTLRHQITVGSSVPMNLPVVNQVFSSNRAIIIPHTSSLARVRPLAGRYVPPEVAAVRVPLLHLSNFQINDWPELSAKSFAIMVLMLPSDSARKWHVHELELVEVVADQVRAVSFAMVTITYYFHPEKDVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDEHFYLKVQVKDTGCGVSPQDLPHVFTKFAHPQSGGNRGFNGSGLGLAICKRFVSLMGGHIWIDSEGTGRGCTATFVIKLGVCDNTNTYQQQLVPLVWPSSADSNLSAPKVLPDGRGSVSLKSRYQRSV

SEQ ID NO: 7395 - protein, 423 aa, Xanthomonas campestris
MSTAPQKPLAIRERLSEVRYEIRGELARRARELEAQGRKLIKLNIGNPGAFGFRAPEHLQRAIADDMGRTDPYTHQQGLPEAREAIAAAYARRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRELLERIVAIAVKHNLLLMVDEIYDQVLYDGAAFVPVAPLAGEHPCITFSGLSKVHRACGWRVGWALLSGEQSRINDLRNAMDLLGALRLCANVPGQYAIDAAVNGPDTISALCAPGGRLYETRRAVIEACAASSHLSLVAPAGALYAFPAVVGPAARAFDDHTFALDLMNDEGVLVVPGSSFNVPYRHHFRVTLMPEAAVMRDVFARIDRALTRRAEAVTKVVPLKSRSVA

SEQ ID NO: 7396 - protein, 392 aa, Unknown
  Sphedamnocarpus sp. Davis 03-01
DLEPVNPADVPVTAAGALKSYKLAAKAISRLQSLPSGNISVLCDVLVKEVRDLTGYDRVMVYKFHEDEHGEVVSECRRSDLESYLGLHYPATDIPQASRFLFIKNKVRMICDCLAPPVKVIQDERLPQPLSLCGSTLRSPHGCHSQYMTNMGTIASLVMPVTINEDDDTMDGDQQQMTRKLWGLVVCHHTSPRFVPFPLRYACEFLIQVFGVQINKEVELAAQVREKHILQIQTMLCDMLLRDAPVAIITQSPNEMDLAKSDGTDLYYKNKTWLLGVTPTEEQIRDIAEWLLQYHSGNTGLSTDSLMEAGYPGASALGDSVCGMAAVSITSRDFLFWFRSHTAKEIKWGGAKHDPDDKDDLRKMHPRSSFKAFLEVVKWRSMPWEDVEMDAI

SEQ ID NO: 7397 - protein, 618 aa, Candida albicans
MSEQAQTQVSADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYAAPEVISGKLYAGPEVDVWSAGVILYVMLCGRLPFDDEFIPALFKKISNGVYTLPNYLSAGAKHLLTRMLVVNPLNRITIHEIMEDEWFKQDMPDYLLPPDLSKNKNSKIDVDEDVIRALSVTMGYDRDEIVNVIEKANKQVAAGNSSSQQSKSSNEILDAYLLMKENHALVKDLKKSKSENIESFLSQSPPPSPFPNAGSTSSAPGVQQSLTYQTLATVPDLSTLPNSTIAILPTSLPSIHRAYMAETKQNGDPSQQHAPPPTKKSKTRWHFGIRSRSYPLDVMGEIYRALKNLGAEWAKPTEEELWTIRVRWKYDTSAQFECGSAPNLMKMQIQLFQLEPNNYLVDFKFDGWESAHGNAGTDSPQSHRQQDLDEVGSFSAYPFLHLATRLIMELAVNSQSG

SEQ ID NO: 7398 - protein, 236 aa, Heuchera americana
VQLRRMENKINRQVTFSKRRGGLVKKAHEISVLCDVEVALIVFSNKGKLFEYSTDSCMEKILERYERYSYAERRLVATGSESQENWSLEYTKLKAKIELLQRSQRQFMGEDLDLLSLRELQNLEQQLDTALKHIRSRKNQLMNQSISDLQKKEKAIQEQNNLLAKKIKEKEKAMSQQAEWEQQNNGASTSNFLNPQPLPCLNISSTYQGGAQPEAMRRNELDLTLEPIYSCHLGCF

SEQ ID NO: 7399 - protein, 686 aa, Pseudomonas syringae
MAFEAMFQPIQIGKLTIRNRVLSTAHAEVYATDGGMTTDRYVKYYEEKAKGGIGLAICGGSSSVAIDSPQGWWKSVNLATDRIIPHFQNLADAMHRHGAKIMIQITHMGRRSRWDGDHWPTLMSPSGIREPVHRATCKTIEPEEIWRVIGNYASAAARAKAGGLDGVELSAVHQHMIDQFWSPRVNKRTDEWGGSFENRMRFGLEVIKAVRKEVGPDFCVGLRICGDEFHPDGLSHEDMKQIAKYYDDTGMIDFIGVVGSGCDTHNTLANVIPNMSYPPEPFLHLAAGIKEVVKAPVLHAQNIKDPNQATRILEGGYVDMVGMTRAHIADPHLIAKIKMGQIDQIKQCVGANYCIDRQYQGLDVLCIQNAATSREYMGVPHIIEKSTGPKRKVVVVGAGPAGMEAARVSAERGHDVTLFEKKEFIGGQITTASKAPQRDQIAGITRWFQLELARLKVDLRLGVAADAATILDLRPDIVVLAVGGHPFLEQNEHWGAAEGLVVSSWDVLDGKVAPGKNVLVYDTICEFTGMSVADYLADKGSQVEIVTDDIKPGVAIGGTSFPTYYRSMYPKEVIMTGDMMLEKVYREGDKLVAVLENEYTGAREERVVDQVVVENGVRPDEAIYYALKEGSRNKGQIDIDALFAIQPQPSLSQPGDGYLLFRIGDCVAQRNTHAAIYDGLRLCKDF

SEQ ID NO: 7400 - protein, 929 aa, Pseudomonas syringae
MRWLRIAIASTVGLLTLLFMLSAQAEHGAGWSTLLDEKAHLTLDEIRSARYQNQFSPTELERVAAADRGSAVWLHYRLQPTQHEQLLRIFAPDLSSADMYVMDGDRQIDHLRTGNDVPIEDQRLPSNDFLLPVPQSSASLDIYLRLVSAQKMRPSITLEPAIESAANETQPLLFGLLFGALSMLIVQNLTRYGHTRSRSNLWLAACESLLGLSALLLLNLLRPIDPWNIAQTPSAHLALLLAAVAGLIYTYCFFVHRNARKLDRLLLGNAVLMGIGALLVLFDEKLPINFLTFGLVSLTTLSILAVSMWHWQKGYRSARLFVLGMITFNIGYMVVLPGLLWLSLVPPQWLLLALLSVFCISGLLMSLALSERHRSITEDRFSISRDQAASTAEINAKAEFLAKISHEIRTPMNGVLGMTELLLGTPLSVKQRDYVQTIHSAGNELLTLINEILDITKLESGQIELDDVQFDIGALVEDCLNIFRAKAEQQQVELISQIQPQVPRVINGDPTRLRQTLLSLLENALKKTDEGEILLAVALESSKNGKTRLRISVQDSGESLSDEEREELLHAELHSRNFLASSRLGGHLGLVIARQLIILMDGEFGIQNSGTQGNTLWLNLPLDAKLLEQPTIDLDSPLKDARVLVVDDNDTCRKVLVQQCSAWGLNVSAVASGKEALALLRTKAHLRDYFDVVLLDQNMPGMTGMQLAAKIKEDPSLNHDILLIMLTGISNAPSKIIARNSGIKRILAKPVAGYTLKTTLADELTQLNKGVAAQKPGPVINTPVSVPGDFRILVAEDNSISTKVIRGMLGKLNLNPDTASNGEEALRAMKAQRYDLVLMDCEMPILDGFSATEQLRAWEVGNQRVRTPVVALTAHILTEHKDRARQAGMDGHMAKPIELSQLRELVEHWVAHRDKARGLPSDGEQYRRN

SEQ ID NO: 7401 - protein, 706 aa, Candida glabrata
MSEHNNENLNLHEGLNLDDDDLENMLKNPNLFTTSPGIDVESIPSATNQNSVNGQDDKSGIKSQNSDTNEVIEDIVNPSIDPYVSTPHNDEMASPEDDIDSINNKDSNKLMTSLVRQNYGPHLGRDNADINSSNFRSHYQNLFDDNYLKTDMGSPVNKNKRKREDDDDDQLYSSQILRGPLSPGGNAHKVDNRLMSYGSNNLNSRQQTPGMENTPSVLNRRFQNKTRPAFVNKVWSMINDPVNSHLIQWSEDGLSLIVVNREKFVHEILPKYFKHSNFASFVRQLNMYGWHKVQDVKSGSIQSSSDDRWQFENEFFVRGREDLLNRIVRQKGTSANATPGTQSNMKYGNGNQIRGLPNVNGQTLRLMNEANMGNTMDITAVLGELEQIKFNQMAISKDLMRINKDNELLWKENMIARERHRTQQQALEKIFRFLRNVVPHADQKLLMDVAEPVSSRIEEAQDISDAPSVSSKSFDFDDGKEDRSRYIPLQDEDGKRPLYLLKNRTMSENSNKSSGGRLASTHNDSSGRISEIPFEEDDLSPPRHEVTDVGHISGQKNVAIDKLKADLHEQEARIKYLEDMVENKTLDSHLNDSMTMPMMPSPSTMLMHDMVEPSTIALGKEATDTSEGKHHGHDQQGQVQGQDQVQGQDQMHSQDQQNDMSAIGGLSELSPGLSPGLSSGLSPGFDIGDYLNSSQNHMTPMYEDKK

SEQ ID NO: 7402 - protein, 210 aa, Heuchera americana
  misc_feature (194)..(194): Xaa can be any naturally occurring amino acid
SVLCDAEVALIVFSNRGKLYEFCSTSNMLKTLERYQKCSYGAVEVNRPCKELESSYREYLKLKGKFEGLQRTQRNLLGEDLGPLNTKELEQLERQLDSSLKLIRSTRTQFMLDQLSDLQNKEQVLMDSNRSLARKLDEISAKNNNLRLSWEGGEQSIPYSQQQAQPQGLFQPLDCNPTLQIGYNSIGSDPDDYXQLMHRMSTGFMPSWML

SEQ ID NO: 7403 - protein, 667 aa, Unknown
  Bradyrhizobium sp. BTAi1
MSQHQPFAQALSPLDVGPLRFRNRIFVPAHTTNFGEHHLPSAQHLAYHRARARGGVGAIIFESIRVHANSLGRPQAVCGFDPACIDPFRRITDAVKAEGAVMLGQIIHLGRQVEGDFERTVAWGASAVPWSISALPPRPMDEFDMEEVIEGHLVTARNLVAAGFDGIELQMAHGHLLQQFMSPLSNKRNDEYGGALENRLRFPARVLAALRAELGAGFCLGIRISGEEYAEGGLGIDEAERIVPMLARQTRIDFINVSHSAYVASYSLATQMADMAFDPAPFRSLPARIRAELRTEGFDTPVFAVCRFTGLDEADAMIAAGHADAVGMARAHLAEPAIVRKSVEGRLDEIRRCIGCNQGCAGMLERNLPIRCLINPIAGLEAQFDEPEALPRGARKKVLVVGGGPAGLEAARVAAALGHDVTLWERSDQLGGQLRTAWLMPKRANFETFVAFQIAALARLGVTTIFNKEASAAEIAAFGADRIILATGSTTTPMPVPGSGPVFTLPDALRAPDRLGAAVAVFDRTGEWGTLAALEHFADLGKAVTLFVPAASYAWRTTIYSTLANSRRLRERKVRIATLRAVRAFDGGTLEVEDLSTGEVARLSGFSALVAVDHNSADQTLYLALRRAGLPVMQAGDNNAPRTALEATYQGHMAARAPFPAASGLTT

SEQ ID NO: 7404 - protein, 544 aa, Brassica napus
MKLLHGLALVFLLAAASCKADEEITCEENNPFTCSNTDILSSKNFGKDFLFGVASSAYQACRGVNVWDGFSHRYPEKSGSDLKNGDTTCESYTRWQKDVDVMGELNATGYRFSFAWSRIIPKGKVSRGVNQGGLDYYHKLIDALLEKNITPFVTLFHWDLPQTLQDEYEGFLDRQIIQDFKDYADLCFKEFGGKVKHWITINQLYTVPTRGYAVGTDAPGRCSPMVDTKHRCYGGNSSPEPYIVAHNQLLAHATVVDLYRTKYKFQKGKIGPVMITRWFLPFDESDPASIEAAERMNQFFHGWYMEPLTKGRYPDIMRQIVGSRLPNFTEEEAELVAGSYDFLGLNYYVTQYAQPKPNPYPSETHTAMMDAGVKLTYDNSRGEFLGPLFVEDEVNGNSYYYPKGIYYVMDYFKTKYGDPLIYVTENGFSTPSSENREQAIADYKRIDYLCSHLCFLRKVIKEKGVNVRGYFAWALGDNYEFCKGFTVRFGLSYVNWEDLDDRNLKESGKWYQRFINGTVKNSAKQDFLRSSLSSQSQKKKLADA

SEQ ID NO: 7405 - protein, 486 aa, Bacteroides fragilis
MENKKLTAANGRPIADNQNSQTAGPRGPIMLQDPWLIEKLAHFDREVIPERRMHAKGSGAYGTFTVTHDITKYTRAAIFSQVGKQTECFVRFSTVAGERGAADAERDIRGFAMKFYTEEGNWDLVGNNTPVFFLRDPLKFPDLNHAVKRDPRNNMRSANNNWDFWTLLPEALHQVTITMSPRGIPASYRHMHGFGSHTYSFLNAENKRIWVKFHLKTMQGIKNLTDQEAEAIIAKDRESHQRDLYESIERGDFPKWKFQIQLMTEEEADNYRINPFDLTKVWPHKDFPLQDVGILELNRNPENYFAEVEQSAFNPMNIVEGIGFSPDKMLQGRLFSYGDAQRYRLGVNSEQIPVNKPRCPFHAFHRDGAMRVDGNYGSAKGYEPNSYGEWQDSPEKKEPPLKVHGDVFNYNEREYDDDYYSQPGDLFRLMPADEQQLLFENTARAMGDAELFIKQRHVRNCYKADPAYGTGVAQALGIDLEEALKE

SEQ ID NO: 7406 - protein, 370 aa, Deinococcus radiodurans
MTVSSAAAPQPASPAAPLLFTPLKLRSLELPNRVVVSPMCTYSATDGVANEFHLVHLGQYALGGAGLILAEATAVSPEGRITPEDLGLWDDRQIVPLGHITDFVHQHGGHIGVQLAHAGRKASTYAPWRGKGAVPAELGGWQVIGPDENSFHDLFPTPAMMGADELRGVVDAFSAAARRAQVAGFDAVEVHAAHGYLLHQFLSPLANTRTDDYGGSFENRTRLLLEVVRAVRHVWPAHLPLFVRLSATDWAEGGWDLEQTVQLSKLLKYEGVDVLDISSGGLTAAQQIEVGPGYQVPFAAAVSRAETEISVMAVGLIETGAQAEAILQAGDADLIALGRPFLRDPHWAQRAARELGLRPVSIDQYARAGW

SEQ ID NO: 7407 - protein, 475 aa, Brassica napus
  misc_feature (299)..(299): Xaa can be any naturally occurring amino acid
MAAAVSTVGAINRAPLSLNGSGAGAASVPATTFLGKKVVTASRFTQSNNKKSNGSFKVVAVKEDKQTDGDRWRGLAYDTSDDQQDITRGKGMVDSVFQAPMGTGTHNAVLSSYEYISQGLKQYNLDNMMDGLYIAPAFMDKLVVHITKNFLTLPNIKVPLILGIWGGKGQGKSFQCELVMAKMGINPIMMSAGELESGNAGEPAKLIRQRYREAADMIKKGKMCVLFINDLDAGAGRMGGTTQYTVNNQMVNATLMNIADNPTNVQLPGMYNKEENARVPIIVTGNDFSTLYAPLIRDXRMEKFYWAPTREDRIGVCKGIFRTDNVKDEDIVTLVDQFPGQSIDFFGALRARVYDDEVRKFVEGLGVEKIGKRLVKSTHGSAVFEQPAMTLEKLMEYGNMLVMEQENVKRVQLADQYLNEAALGDANADAIGRGTFYGKAAQQVNLPVPEGCTDPQADNFDPTARSDDGTCVYNF

SEQ ID NO: 7408 - protein, 629 aa, Cytophaga hutchinsonii
MCGITGIFAFNQIGAFYMINLGKSIELLAHRGPDGRGTFVEELIALGHRRLSVIDTINGRQPMHDSTDRYVLTFNGEIFNYKILREQLIQEAGYTFTTDSDTEVLLNAYIHWGEACLLKLNGFFAFAIYDKQKHEIFVARDRMGVKPLLYYKDEDKFIFASEMKAVLAYNVPKEIDWVSVQQYFTLGYIPEPDSIFKDVKKLEAGSYLLINKAGVISKKYYEIPSSTQTKHQHSFEQAAAHVKELVDASVKDRLVADVPVGAFLSGGLDSSIVVASASKHVENLHTFSVGFKGADFYDETKSAELVAKTFNTSHTTFSLSQTELADNILPCLESMSEPFGDTSSLPLFVLSKKVAPSMKVILSGDGADELFGGYNKHRAEWLIKNPNWQIRFAQLIQPVVKILPGNRNTPMGDKIRQAQKLIEGLTLTDAERYYRWCSVFSEEAHKEMFQENIADNEEYKIRKGGILHAFKKNPYDLNRILYTDLNLVLGSDMLHKVDSMSMANGLEVREPMIDYRLVEYVSTLPSSYKINKNGGKQVLKHAYKDELPAEILSKAKHGFDVPLTKIFSKELKAWILDELLSQKFIEQQHVFKWSYIKNIRNAIDKNSNLDESKIWPLITFQFWWKKFMN

SEQ ID NO: 7409 - protein, 547 aa, Unknown
  Silicibacter sp. TM1040
MAAKDVKFDTDARNRMLKGVNTLADAVKVTLGPKGRNVVLEKSFGAPRITKDGVSVAKEIELEDKFENMGAQMVKEVASRTNDEAGDGTTTATVLAQSIVREGLKQVAAGLNPMDLKRGIDLATDKVVEAIKAMAREVKDSDEVAQVGTISANGEAEIGRQIADAMQKVGNDGVITVEENKGLETETDVVEGMQFDRGYLSPYFVTNADKMTAELEDCLILLHEKKLSSLQPMVPLLEQVIQSQKPLLIIAEDVEGEALATLVVNKLRGGLKIAAVKAPGFGDRRKAMLQDIAILTGGQVISEDLGMKLESVTMDMLGTAKKIQITKDETTIVDGAGEKAEIEARVAQIRAQIEETTSDYDREKLQERVAKLAGGVAVIRVGGMTEVEVKERKDRVDDALNATRAAVQEGVIVGGGVALVQAGKSLEGLTGVNADQNAGIAIVRRALEAPLRQIAENAGVDGAVVAGKIRESEDKNFGFNAQTEEYGDMFSFGVIDPAKVTRTALEDAASIAGLLITTEAMVADKPAKEGAAPAGGMPDMGGMGGMM

SEQ ID NO: 7410 - protein, 192 aa, Apium graveolens
GNSIPPIMPIGRGAYGIVCSIMNTETNEMVAIKKIANAFDNYMDAKRTLREIKLLRHLDHENIIALTDVIPPPVRRNFSDVYIATELMDTDLHQIIRSNQVLSEEHCQYFLYQLLRGLKYIHSANIIHRDLKPSNLLLNSNCDLKICDFGLARPNTDDEFMTEYVVTRWYRAPELLLNSSDYTAAIDVWSVG

SEQ ID NO: 7411 - protein, 1003 aa, Unknown
  Burkholderia sp. 383
MPAKLKRLLAHAAAVGRKPFDPGRVRRQQQMLLYGGGSAVTAFIVVCAALVIRLDVQDSLGQARATFLQRGAELHANLQTADRALSAFGIRTEQLWDQGVQPPQDAVQSFSADHGRLLVRAAGGWEPFLAIAEVTPDRPAESYARYLGATLAQIDRSSHYPPSPASADLIGGYLIGLDGAFLGIVGSGNVARARSLPPDIDVPALIARLRPTGETKQKSDMLGGTFTLDRRYDPILGRTIVRFARRLDDAAGHPFAWLIFNGTSDLDDIMMPRSDDEDVAVVDARGRIVFGRQRDPAMIERAMNGTRASSGGHVVVRRVGTRFVISDRLPESGLTLITTFSWRSVASATAVGVSVTLAAALFAISMLWIAIVTFDLRALRPANRRAIRLIESEAFNRTLIRTAPAGLLLLSAADGETMVRNDAVLAYDDGVSGLPLGKRIWQACRERQRAGADERRFVMQQELAVERAGHDTTYLAAHVVRTKFRGVDVLLCTLTDVTARKLTEDKLREARVAADDANKAKSTFLATMSHEIRTPLNAIIGNLELMGRAELPPTEQRRLKTIVSSSDALLNIINDVLDLSKAESNQMALEHIPFDLRRVLQDVASIFRPLADAKGLSLECHVAAELADGYVGDPTRLRQLVSNLVGNAIKFTEHGGITIDARLARGDARAGCVEIAVRDTGVGIPGEALPTLFDVYMQADASIYRRFGGTGLGLPLCRRIARLMDGELTVESRLGEGSTFVATLPLTDAPAGCLDAASEPDAASVASTSPRRDDVPPLRVLVAEDHPASRALLRDQLDALGHDATIVENGMEAMRAYFAHPFDIVLTDLSMPQLDGFALANFLREQGANVPVIAMTAHATDEDRGRCRQVGVAEVVLKPLSIDSLDAALRRHGSRDGAVAGAVDSGVREVAPVMTGEMRRTLREATLRSLAAIEAALSGDDGEVLRVELHSMRGGFALAGDRAARDACAQMEAAVNTGGAAAFELHWAAFRQEMEHALERIDR

SEQ ID NO: 7412 - protein, 508 aa, Oryza sativa
MATGVSVENINPKVILGPSSIAECIVTNARREINRYLTFFFQHLQQQLQTQPGSLPFDEIVYCNIGNPQSLGQKPITFFREVLALCNHPNLLEREEIKSLFSTDAIARAKKILSMIPGRATGAYSHSQGIKGLRDEIAAGIASRDGFPANADDIFLTNGASPGVHMMMQLLIRNNRDGIMCPIPQYSLYSASLALHGGALVPYYLDESSGWGLEVSKLKNQLEDARSKGITVRALVVINPGNPTGQILDEQQQYELVKFCKDEELVLLADEVYQENIYVTNKKINSFKKIARSMGYNGDDLQLVSLHSVSKGYYGECGKRGGYMEVTGFSTPVREQLYKIASVNLCSNITGQILASLIMDPPKAGDASYDLYEEEKDNILKSLSRRAKAMESAFNSIDGITCNKTEGAMYLFPRIYLPQKAIEAARAVNKAPDVFYALRLLDTTGIVVTPGSGFGQIIRCYLFTCNSEFLTTQVWSFVKGCRDMAREMHDPAAGGEDTFDDLPLQGIP

SEQ ID NO: 7413 - protein, 1032 aa, Unknown
  Burkholderia sp. 383
MQKRPGAPASSHCDMPYSPLQSIRRYQNISVFGGGIVVTILILIACALGMGSIVYGYLDGERHNFLTGMVQTLNEIKVSETSFRNGVTNAQLIWRETGPVPDSVVDAFYDAGERTAIKPYPSVVFGVSKQPADRTEVARYLSLSVLLARICAASSINRGQTLVGYHYSTRASLLGLVPDSGAGGGALATPEGRVQVMEALRIDFGASPVQGRSTTGRPHVHWLPPFIDPISGAARIRLAAQAQVDGEPFAVIVTEYAPEHLLSWQPEHPVDGVFFVTTGDNQLVAASPGVAGDEARTGRLLALDPSRDRTKPEQAAFRDGFVIFHGTLDATGWTLAYALPWTDVVANVAWRASLLLGASLLTIAIMWILLVRFHRRVFASVYARSQRVFDSEALCRSVIETAPIGLGLISRADGHFMLVSPALAEMIARLGSDYRALSAQAVARYDAFIAGGAAGGTLQTDFVLAEADAGAAPLHLEVSACGARYQEIDVLIVAVADVTARRQLVQQLEEAVRAADSANAAKSSFLAAITHEIRTPLNVILGNLELLDRSALDASQHGRVQTLRAAASGLLGLVSDILDFSKIEAGAMTVEAIEFDVIGVIERTLGAFAPVAKAKGLSLFCEIDASDAQRMRGDPTRLGQVLGNLLSNAIKFTASGHVLVRVSVASAGCGDAELSIAVEDTGIGIAGADRHKLFKAFSQVDASITRRYGGTGLGLALCDRLAAAMGGRIDVASVPGTGSRFTLTVPLGVAVMPLGAQPARGARVPVIVVARTEWQRFALPHLRAWGFDVDVYDRPARIPADRRARAAAIVLFGDSDAWSRAELDSLGGDCPVVLATPDGPPQAYRAGRTIRVSSYALGGFKAALAKAMTDTGVPATQRPASTHVEAVRPDAWRVVLAGIDSVSSTLLREQLHVLGCEVQAAHSAEAALDLLATGAWHVLLVDASLPDMPVCSLANAVRALGMGSDVVVVTSHVAPVDRRRYADAGIDCVLTKPVTLAHLRGALADIARRRGAPEQGVGKEQDVARFAHGGTV

SEQ ID NO: 7414 - protein, 403 aa, Chlorococcum littorale
MQMQMKNTAFKATGAKTAPKAVRVPACKASKSQAGRWAAIDAGNDMSDDQQDITRGRDMVDSLFQGPGSGGGTHSAVLSSEDYLSTASRNFNNVEDGFYISPAFLDKMTIHVAKNFMDLPKIKVPLILGIWGGKGQGKTFQCALAYKKLGISPIVMSAGELESGNAGEPAKLIRQRYREASDSVKKGKMCSLFINDLDAGAGRMGMGTQYTVNNQMVNATLMNIADNPTNVQLPGVYKEVQIPRVPIVCTGNDFSTLYAPLIRDGRMEKYYWNPTREDRIGVCMGIFQEDNVNRGEVEVLVDAFPGQSIDFFGALRARVYDDKVREFVKNTGVENLSKRLINSREGKVVFEKPSMNLDILMKYGKFLTNEQENVKRVQLAEEYMMGASLAGDHGTSLPENYTR

SEQ ID NO: 7415 - protein, 392 aa, Tristellateia madagascariensis
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMANMGTIASLVMSVTINEDDDTMDGDQQQMARKLWGLVVCHHTSPRFVPFPLRYACEFLIQVFGVQINKELELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDAVCGMASVSITSRDFLFWFRSHTAKEIKWGGAKHDPDDKDDGRKMHPRSSFKAFLEVVKWRSLPWEDVEMDAI

SEQ ID NO: 7416 - protein, 392 aa, Tristellateia africana
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPQVKVIQDERLPQPLSLCGSTLRSPHGCHAQYMANMGTIASLVMSVTINEDDDTMDGDQQQMARKLWGLVVCHHTSPQFVPFPLRYACEFLIQVFGVQINKEIELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDTVCGMASVSITSRDFLFWFRSHTAKEIKWGGAKHDPDDKDDGRKMHPRSSFKVFLEVVKWRSLPWEDMEMDAI

SEQ ID NO: 7417 - protein, 392 aa, Heladena multiflora
DLEPVNPFDVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMANMGTIASLVMSVTINEDDDTMDGDQQQMARKLWGLVVCHHTSTQFVPFPLRYACEFLIQVFGVQINKEVELAAQAREKHILQIQTTLCDMLLRDAPVAIITQSPNVMDLVKCDGAALYYKNKFRLLGVTPTEAQIRDIAEWLLEYHSGNTGLSTDSLMEAGYPGASVLGDAVCGMAAVSITSRDFLFWFRSHTAKEIKWGGAKHDPDDKDDGRKMHPRSSFKAFLEVVKWRSLPWEDMEMDAI

SEQ ID NO: 7418 - protein, 384 aa, Bunchosia armeniaca
DVPVTAAGALKSYKLAAKAISRLQSLPSGNISLQCDVLVKEVRDLIGYDRVMVYKFHDDEHGEVVSECCRSDLESYLGLHYPATDIPQASRFLFMKNKVRMICDCLAPPVKVIQDERLPQPLSLCGSTLRSPHGCHAQYMENMGTIASLVMSVTINEDDDMMDGDQQQMARTLWGLVVCHHTSPRFVPFPLRYACEFLIQVFGVQINKEVELAAQVREKQILRIQTMLCDMLLRDAPVAIITQSPNVMDLVKCDGAALYYKNKFWLLGVTPTEAQIRDIAEWLLEYHSGNTGLSTDSLMEAGYPGASVLGDAVCGMAAVSITSRDFLFWFRSHTAKEIKWGGAKHDPDDKDDGRKMHPRSSFKAFLEVVKWRSLPWEDIEMDAI

SEQ ID NO: 7419 - protein, 631 aa, Alkaliphilus metalliredigenes
MGKKMISQQDVYLFHEGTNYYGYKSLGAHVTVEGGQKGTRFTAWVPNAKEVRVAGDFNHWQGQQHPMEKIPDSKLWSVFIGGIQEGTLYKYEILGDNGAFYLKIDPYGFLSEPRPNTASIVCELEDYPWQDQKWQQNKVVENSLHRPVMIYEVHLGSWRRKADDSFCNYREIAHELGDYAVEMGYTHVEVMPIMEHPLDDSWGYQITGYYAVTSRYGNPKDFMYFVDYLHQKGIGVILDWVPGHFCADAHGLRQFDGGNVYEYQDANRAINKEWGTVNFDLGKPEVKSFLISNACFWMEMYHIDGLRVDAVANMLYLDYGREHGDWTANQYGGNENLEAVDFLKQLNKAVFQYFPNHFMIAEESTQWPMVTAPIHVGGLGFNYKWNMGWMNDTLKYMELDPIHRKWSHNLLTFSLMYTYTENFILPLSHDEVVHEKKSLLEKMSGNYWEKFANLRCYYGYLMAHPGKKLLFMGGEFGQFIEWNHNKALDWMLLDHEMHRKLHQYMKDLIHFYKEEASLWQNDYQVEGFQWIDPNDYQQSMITFMRRRADDFTIIICNFTTIPREQYRVGVPFKGNYKEVFNSDSTEYGGSGVKNPRVMKAEKVKWHNQSYSIETSIPPLGVLYIRQEKDEE

SEQ ID NO: 7420 - protein, 392 aa, Thryallis longifolia
DLEPVNPADVPVTAAGALKSYKLAAKAISRLQSLPSGNISLLCDVIVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMANMGTIASLVMSVTINEDDDMMDGDQQQMARKLWGLVVCHHTSPRFVPFPLRYACEFLIQVFGVQINKEVEFAAQVSEKHILRIQTMLCDMLLRDAPVAIITQSPSVMDLVKCDGAALYYKNRFWLLGVTPTEAQIRDIAEWLLEYHSGNTGLSTDSLLEAGYPGASVLGDAVCGMAAVSITSRDFLFWFRSHTAKEIKWGGAKHDPDDKDDGRKMHPRSSFKAFLEVVKWRSLPWEDVEMDAI

SEQ ID NO: 7421 - protein, 210 aa, Lycopersicon esculentum
AHEMSVLCDAEVALIIFSNRGKLYEFCSSSSMLKTLERYQKCNYGAPEPNISTREALEISSQQEYLKLKGRYEALQRSQRNLLGEDLGPLNSKELESLERQLDMSLKQIRSTRTQLMLDQLTDYQRKEHALNEANRTLKQRLMEGSQLNLQWQPNAQDVGYGRQTTQTQGDGFFHPLDCEPTLQIGYQNDPITVGGAGPSVNNYMAGWLP

SEQ ID NO: 7422 - protein, 462 aa, Arabidopsis thaliana
MSEEQPHANLAVPAFKTEKEPITQTRNGQSSVWRFGGSDKAAKASTVTLRGVIYMLFDNCGKDVNKTILPLGHGDPSVYPCFRTCIEAEDAVVDVLRSGKGNSYGPGAGILPARRAVADYMNRDLPHKLTPEDIFLTAGCNQGIEIVFESLARPNANILLPRPGFPHYDARAAYSGLEVRKFDLLPEKEWEIDLEGIEAIADENTVAMVVINPNNPCGNVYSHDHLKKVAETARKLGIMVISDEVYDRTIFGDNPFVSMGKFASIVPVLTLAGISKGWVVPGWKIGWIALNDPEGVFETTKVLQSIKQNLDVTPDPATIIQAALPAILEKADKNFFAKKNKILKHNVDLVCDRLKDIPCVVCPKKPESCTYLLTKLELSLMDNIKDDIDFCVKLAREENLVFLPGDALGLKNWVRITIGVEAHMLEDALERLKGFCTRHAKKTETETESLQALKLSDNNLEM

SEQ ID NO: 7423 - protein, 450 aa, Bacillus circulans
MSIHMFPSDFKWGVATAAYQIEGAYNEDGRGMSIWDTFAHTPGKVKNGDNGNVACDSYHRVEEDVQLLKDLGVKVYRFSISWPRVLPQGTGEVNRAGLDYYHRLVDELLANGIEPFCTLYHWDLPQALQDQGGWGSRITIDAFAEYAELMFKELGGKIKQWITFNEPWCMAFLSNYLGVHAPGNKDLQLAIDVSHHLLVAHGRAVTLFRELGISGEIGIAPNTSWAVPYRRTKEDMEACLRVNGWSGDWYLDPIYFGEYPKFMLDWYENLGYKPPIVDGDMELIHQPIDFIGINYYTSSMNRYNPGEAGGMLSSEAISMGAPKTDIGWEIYAEGLYDLLRYTADKYGNPTLYITENGACYNDGLSLDGRIHDQRRIDYLAMHLIQASRAIEDGINLKGYMEWSLMDNFEWAEGYGMRFGLVHVDYDTLVRTPKDSFYWYKGVISRGWLDL

SEQ ID NO: 7424 - protein, 214 aa, Michelia figo
  misc_feature (210)..(210): Xaa can be any naturally occurring amino acid
RPCAEMSMLCDAEVALIVFSSRGKLYEFGSAGVNKTLERYQRCCYTFQDANITDRDTQGWYQEVSKLKAKCDSLQRSQRHLLGEDLGPLSVKELQKLERQLESALTQTRQRKTQIMLEHMEALREKERQLGDINKELKNKLEAKGQGAFRAMQASWESGPLVGNNGFPMHPSQSAAIECEPTLQIGYHSFAAPEASIPRTVVAESNFMPXGMLC

SEQ ID NO: 7425 - protein, 102 aa, Oryza sativa
MSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANA

SEQ ID NO: 7426 - protein, 568 aa, Zea mays
  misc_feature (200)..(200): Xaa can be any naturally occurring amino acid
  misc_feature (364)..(364): Xaa can be any naturally occurring amino acid
MAPLLAAAMNHAAAHPGLRSHLVGPNNESFSRHHLPSSSPQSSKRRCNLSFTTRSARVGSQNGVQMLSPSEIPQRDWFPSDFTFGAATSAYQIEGAWNEDGKGESNWDHFCHNHPERILDGSNSDIGANSYHMYKTDVRLLKEMGMDAYRFSISWPRILPKGTKEGGINPDGIKYYRNLINLLLENGIEPYVTIFHWDVXPQALEEKYGGFLDKSHKSIVEDYTYFAKVCFDNFGDKVKNWLTFNEPQTFTSFSYGTGVFAPGRCSPGLDCAYPTGNSLVEPYTAGHNILLAHAEAVDLYNKHYKRDDTRIGLAFDVMGRVPYGTSFLDKQAEERSWDINLGWFLEPVVRGDYPFSMRSLAREXRLPFFKDEQKEKLAGSYNMLGLNYYTSRFSKNIDISPNYSPVLNTDDAYASQEVNGPDGKPIGPPMGNPWIYMYPEGLKDLLMIMKNKYGNPPIYITENGIGDVDTKETPLPMEAALNDYKRLDYIQRHIATLKESIDLGSNVQGYFAWSLLDNFEWFAGFTERYGIVYVDRNNNCTRYMKESAKWLKEFNTAKKPSKKILTPA

SEQ ID NO: 7427 - protein, 492 aa, Glycine max
MDPYKHRPSSAFNSPFWTTNSGAPIWNNNSSLTVGARGPILLEDYHLVEKLANFDRERIPERVVHARGASAKGFFEVTHDISHLTCADFLRAPGVQTPVIVRFSTVIHERGSPETLRDPRGFAVKFYTREGNFDLVGNNLPVFFVRDGMKFPDMVHALKPNPKNHIQENWRILDFFSHFPESLHMFTFLFDDLGVPQDYRHMDGFGVNTYTLINKAGKAVYVKFHWKTTSGIKCLLEEEAIKVGGANHSHATQDLHDSIAAGNYPEWKLFVQTIDPEHEDKFDFDPLDVTKTWPEDIIPLQPVGRLVLNKNIDNFFAENEQLAFCPAIVVPGVYYSDDKMLQTRIFSYADSQRHRLGPNYLQLPANAPKCAHHNNHHEGFMNFIHRDEEVNYFPSRYDPVRHAERFPIPPAICSGRREKCGIEKENNFKQPGERYRSWAPDRQDRFARRWVDALSDPRVTHEIRSVWISYWSQADRSLGQKIASHLSTRPNI

SEQ ID NO: 7428 - protein, 370 aa, Unknown
  Mesorhizobium sp. BNC1
MSSKLFTPMRVGSLQLDNRIVIAPMCQYSAENGCMTDWHTIHLGGLALSGAALLTIEATAVTPEGRISYADVGLYSDENEAAMRRVLETVRRWSDMPIAIQLAHAGRKASSEIPWKGGGQIRPGLPGGWQTEAPSAVPFKESENPPIALDRAGLARVRDAFAEATRRSARLGLDAVQIHAAHGYLLHEFLSPLSNRRDDEYGGSLENRMRFPLEVFDAVRAAFPAEQPVTVRVSGTDWAEGGWTIEDTVAFAKALEARGCGAIHVSSGGLSAAQRIPIGPNYQVPLARAVKAAVRMPVVAVGLITEFEQAEAIIGTGDADFVALARTILYDPHWPWHAAAHLGARVKAPKQYLRSQPRRYKDLFAVRADD

SEQ ID NO: 7429 - protein, 390 aa, Echinopterys eglandulosa
DLEPVNPADVPVTAAGSLKSYKLAAKAISRLQSLPSGNISLLCDVLVKEVRELTGYDRVMVYKFLEDEHGDVVSECRRSDLESYLGLHYPATDIPQASRFLFMKNKVRMICDCLAPPVKVIQDERLPQPLSLCGSALRSPHGCHAQYMMGTIASLVMSVTINEDDDTMDGDQQQMARKLWGLVVCHHTSPRFVPFPLRYACEFLIQVFGVQINKEVGLAGQVREKHILRIQTMLCDMLLRDAPVAIITQSPNVMDLVMCDGAALYYKNKFWLLGVTPTEAQIRDIAEWLLKYHSQNTGLSTDSLMEAGYPGASVLGDAVCGMAAVSLTSKDFLFWFRSHTAEGIKWGGATHDPDDKDDGRKMHPRLSFKAFLEVVKWRSLPWEDVEMDAI

SEQ ID NO: 7430 - protein, 392 aa, Dicella nucifera
DLEPVNPADVPVTAAGALKSYNLASKAISRLQSLPSGNISLLCDVLVKEVRDLTGYDRVMVYKFHEDEHGDVVSECRRSDLESYLGLHYPATDIPQASRFLFMKNKVRMICDCLAPPVKVIQDERLPQPLSLCGSTLRSPHGCHAQYMTNMGTIASLVMSVTINEEDETMDGDQQQMTRKLWGLVVCHHTSPRFVPFPLRYACEFLIQVFGVQINKEVELAAQVRENHILQIQTMLCDMLLRDAPVAIITQSPNVMDLVKCDGAALYFKNKTWLLGVTPTEKQIRDIAEWLLEYHSGNTGLSTDSLMEAGYPGASVLGDAVCGMAAVSITSRDFLFWFRSHTAKEIKWGGAKHDPDDKDDGRKMHPRSSFKAFLEVVKWRSIPWEDIEMDAI

SEQ ID NO: 7431 - protein, 450 aa, Thermoanaerobacter brockii
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 7432 - protein, 466 aa, Brassica napus
MRNLYFLVLFPLSILILVDASLHVKYLPGLEGPLPFELETGYVSVGESGDVELFYYFVKSESNPDKDPLMIWLTGGPGCSSICGLLFANGPLAFKGDEYNGTLPPLELTSFSWTKVANILYLESPAGSGYSYAKTRRAAETSDTKQIHQIDQFLRSWFVDHPEFISNSFYVGGDSYSGKIVPGVVQQISLGNEKGLTPLINIKGYVLGNPAVRTNLEPNHRVSFAHRMGLISDELHESLERNCGGKFFNVDPSNAKCSNGLLAYHQCISEIYIEQILLPNCKVDYVLADISQTLPNIRTSRRRELKEFSRNDSSSLPPPSCFTYRYFLSAFWANDENVRRALGVKKGFGKWSRCNTQNIPYTYDIHNAIPYHVNNSRKGFRALIYSGDHDMMIPFSSTEAWIKSLNYSIVDDWRPWMMNSNQVAGYTRTYANKMTFATIKGGGHTAEYNPDQCSLMFKRWIDGESL

SEQ ID NO: 7433 - protein, 392 aa, Heteropterys thyrsoidea
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVECDGAALYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDVEMDAI

SEQ ID NO: 7434 - protein, 381 aa, Heteropterys leona
ETPAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDETLPQPLSLCGSTLRSPHGCHAQYMTNMGTIASLVMSVTINEDDDMMDGDQQQMTRKLWGLVVCHHASPRFVPFPLRYACEFLIQVFGVQITKEVELAAQVREKHILQIQTMLCDMLLRDAPVAIITQSPNVMDLVKCDGAALYFKNKTWLLGVTPTEEQIRDIAEWLLEYHGGNTGVSTDSLMEAGYPGASILGDAVCGMAAVSITSRDFLFWFRCHTAKEIKWGGAKHDPDDKDDLRKMHPRSSFKAFLEVVKWRSMPWEDIEMDAI

SEQ ID NO: 7435 - protein, 482 aa, Yarrowia lipolytica
MVKNVDQVDLSQVDTIASGRDVNYKVKYTSGVKMSQGAYDDKGRHISEQPFTWANWHQHINWLNFILVIALPLSSFAAAPFVSFNWKTAAFAVGYYMCTGLGITAGYHRMWAHRAYKAALPVRIILALFGGGAVEGSIRWWASSHRVHHRWTDSNKDPYDARKGFWFSHFGWMLLVPNPKNKGRTDISDLNNDWVVRLQHKYYVYVLVFMAIVLPTLVCGFGWGDWKGGLVYAGIMRYTFVQQVTFCVNSLAHWIGEQPFDDRRTPRDHALTALVTFGEGYHNFHHEFPSDYRNALIWYQYDPTKWLIWTLKQVGLAWDLQTFSQNAIEQGLVQQRQKKLDKWRNNLNWGIPIEQLPVIEFEEFQEQAKTRDLVLISGIVHDVSAFVEHHPGGKALIMSAVGKDGTAVFNGGVYRHSNAGHNLLATMRVSVIRGGMEVEVWKTAQNEKKDQNIVSDESGNRIHRAGLQATRVENPGMSGMAA

SEQ ID NO: 7436 - protein, 337 aa, Thiomicrospira crunogena
MLTPILFSTQERLSMKRLDQVLAADGVNAELELVIKDVMVACKDIAYKLGQGELAGILGATEDENVQGETQKMLDVISNDLLKDILVANPYVRGVGSEEEDYTIAGNADGKYLVTFDPLDGSSNIDVNLSVGTIFSVLEAQDDQSGDNQEVFLQNGRKQVAAGYVLYGPSSLLVMTTGNGVNLFTLDTNIGEFVLTKEALQIPEDTAEFAINMSNQRFWEPEMKQYIDDCLLGEEGPLAKRYNMRWVASMVAEVHRILIRGGIFMYPYDNRDPSKAGKLRLMYEGNPMSMIVEQAGGASSTGRMDIMDVAPQGIHDRVPVVLGSKNEVAKVVAYHTK

SEQ ID NO: 7437 - protein, 392 aa, Tetrapterys microphylla
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQGERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDVVCGMAAVSITSRDFLFWFRSHTANEIKWGGAKHDPDDKDDGRKMHPRSSFKAFLEVVKWRSMPWEDVEMDAI

SEQ ID NO: 7438 - protein, 822 aa, Zea mays
LCLVSPSSSPTPLPPPRRSRSHADRAAPPGIAGGGNVRLSVLSVQCKARRSGVRKVKSKFATAATVQEDKTMATAKGDVDHLPIYDLDPKLEIFKDHFRYRMKRFLEQKGSIEENEGSLESFSKGYLKFGINTNEDGTVYREWAPAAQEAELIGDFNDWNGANHKMEKDKFGVWSIKIDHVKGKPAIPHNSKVKFRFLHGGVWVDRIPALIRYATVDASKFGAPYDGVHWDPPASERYTFKHPRPSKPAAPRIYEAHVGMSGEKPAVSTYREFADNVLPRIRANNYNTVQLMAVMEHSYYASFGYHVTNFFAVSSRSGTPEDLKYLVDKAHSLGLRVLMDVVHSHASNNVTDGLNGYDVGQSTQESYFHAGDRGYHKLWDSRLFNYANWEVLRFLLSNLRYWLDEFMFDGFRFDGVTSMLYHHHGINVGFTGNYQEYFSLDTAVDAVVYMMLANHLMHKLLPEATVVAEDVSGMPVLCRPVDEGGVGFDYRLAMAIPDRWIDYLKNKDDSEWSMGEIAHTLTNRRYTEKCIAYAESHDQSIVGDKTIAFLLMDKEMYTGMSDLQPASPTIDRGIALQKMIHFITMALGGDGYLNFMGNEFGHPEWIDFPREGNNWSYDKCRRQWSLVDTDHLRYKYMNAFDQAMNALDERFSFLSSSKQIVSDMNDEEKVIVFERGDLVFVFNFHPKKTYEGYKVGCDLPGKYRVALDSDALVFGGHGRVGHDVDHFTSPEGVPGVPETNFNNRPNSFKVLSPPRTCVAYYRVDEAGAGRRLHAKAETGKTSPAESIDVKASRASSKEDKEATAGGKKGWKFARQPSDQDTK

SEQ ID NO: 7439 - protein, 206 aa, Michelia figo
  misc_feature (107)..(107): Xaa can be any naturally occurring amino acid
  misc_feature (204)..(204): Xaa can be any naturally occurring amino acid
VQLKRMENKINRQVTFSKRRNGLLKKAYELSVLCDAEVALIIFSSRGKLYEFGSAGTNKTLERYQRCCYTPQDVVVSDRETQGWYQEVSKLKAKYESLQRSQRHLLXEDLGPLSVKELQHLERQLEVALSQARQRKTQIMIEQMEELRKKERQLGDINKQLKIKLEAEGQGPFRCIQGSWESGAMVGNNTFSMNAPQAAPLDAXSP

SEQ ID NO: 7440 - protein, 208 aa, Michelia figo
  misc_feature (5)..(5): Xaa can be any naturally occurring amino acid
GLVKXAHEISVLCDAEVAVIVFSTKGKLYEYSTDSRMSRILERYERYSYAERELVLSGPESEGSWCLEYGKLKAKVESLQRNLRHFTGEDLDTLSLKELQQLEHQLDAALKHIRSRKNQIMFDSIAELQRKEKSLREQNNMLEKEIQEKEKAMAQQVQWEQQNQSQSSPSFLLPTLNIGTYHRGNEVEEEGARPPARTNSLMPSWMLC

SEQ ID NO: 7441 - protein, 464 aa, Oryza sativa
  misc_feature (106)..(106): Xaa can be any naturally occurring amino acid
MGNSLGCSASGERLVSAARDGDAVEARMLLELSPALARYSTFGGLNSPLHFAAAKGHLDIVTLLLEKGADVNVRNYCGQTALMHACRHGHWEVVQMLLLFRCNVWXTRADYLSGRTALHFAAHDGLVRARLRYINKPADGGVTALHMAALNGAGSTPLHYAAGGGNAECCQLLLSKGASKLTLNCNGWLPIDVARMFGRRFLEPLLSPNSNSSIPAYQPSNYLALPFMSILNIARPDYVLCRIAIISETVKLGREFGLLHTVASVDDSDLCAVCLERSCSVAAEGCCHEFCIKCALYLCSTSNTRVEFTGPPGSIPCPLCRNGIMSFTKLPSTPTEGLKSSSALTFCNPCMLNTRSVDSPATISKAEIRRNRVAAVSSELVCPLTCSPFPSSALPTCRCSDDDPCDAIETQDGSEVQSPQPSHCASMEMDKREQQDLDRTSCSGMFWSRRSCHREEQCNAEINA

SEQ ID NO: 7442 - protein, 239 aa, Phytolacca americana
  misc_feature (235)..(236): Xaa can be any naturally occurring amino acid
VQLRRMENKINRQVTFSKRRSGLVKKAHEISVLCDAELALIIFSPRGKLFEYSTDSSMEKILERYERYFYAERQLASNDPNTEVNWTFDFAKLKAKLELLQRNHRHYLGQDLDSLNIKDLQSLEQQLDNALKHIRTRKNQLMHESISELHKKEKAMQEQNNMLVKKIKEREKAMAEAQGMQWQRQQNEPPEASNFLLPPPLTSWNTAGDAYHGQIAGEVKRNDLDLTLEPVYSCXXGCF

SEQ ID NO: 7443 - protein, 657 aa, Ashbya gossypii
MGNAPSRQLSTSKKKRSGSTSNSADDELPQFTRTDTSQSVKSSRSVRSTRSRKSQSGSVPGTPKTASSDANVIALPEGSSRKNSNSHGNIPALSRSNSQHSFTPHQHINEAQQEQRVSPDQLRAPRAASFSNGTGDLPPSMVQMEPKSPILRHFSSSNHMNTSYNENSLTDDDMDANYGVESNDDSHSHRSRRESRRRSSGSSQRRRSGSSQQHLELPFSAHNASRTSSHSSSHSRKSSLSAIGGGNSVYSTPMASPAVRKDDGMDYFCGADTVYGGSKDVLDGAILEKGQEHDHGVDSGAGDVYGHDIPQDPEEIMSTNDGTMPKKKKSIKPLDIDEMIQKLLDAGYLGKRTRNVCLKNSEIAQICHLAREIFLSQPSLLELSPPVKIVGDVHGQYADLLRLFTKCGFPPSSNYLFLGDYVDRGKQSLETILLLLCYKIKYPENFFLLRGNHECANVTRVYGFYDECKRRCNIKTWKLLIDTFNTLPLAAIVAGKIFCVHGGLSPVLNSMDEIRHVSRPTDVPDFGLINDLLWSDPTDSPNEWEDNERGVSYCYNKVAINKFLNKFGFDLVCRAHMVVEDGYEFFNDRSLVTVFSAPNYCGEFDNWGAVMSVSEGLLCSFELLDPLDSAALKQVMKKGRQERKLANKQQQNLQETN

SEQ ID NO: 7444 - protein, 715 aa, Vibrio fischeri
MQLERAAFSDPFSFLGPQYQSQTTALRVWLPGATSVKVRLSGHVEYQLLSDPRHSGIFVLNESIDMTEVHYELIIDWSGTEQILDDPYQYHDISPTDAQVHTPKEMYNHLGAHLFNVVRDGKQIQGVRYLVFAPNASSASVIGDFNQWDGRRHIMQRIDNGLWALFIPEHAVGTKYKFELKGPNGESLPHKMDPYGAHNEQYPSFASVVYDQTSYQWNDAKWQQRPVTEKQKEALSFYELHAGSWKRNENGDFLTYRELAEQLIPYILDMGYTHIELMPVSEHPFYGSWGYQPIGLFSPTSRFGTPDDFKYFVDQCHQVGIGVVLDWVPAHFPSDSHGLANFDGTSLFNDPDPRRGWHNDWQSFIYNYDQPHVREFLVSNALYWFEHFHIDGLRVDAVASMLYLDYSRNDGEWIPNWEGGNHNHGAIALLKWMNEEVYSHYPNAMTIAEESTAFPGVSAPTFAGGLGFGFKWNMGWMHDSLNYIREDPIHRKYHHDTITFPLVYAFSENFILSLSHDEVVYGKGSILDKMPGDEWQKTANLRAYMGYMYGQPGKKLNFMGAEIAQSAEWDHDGQLQWFLTQFERHSGMQSLVRDLNKLYTTEPALYQKDCEPAGFEWRLQDEAEMSVLAHERLGDNGERILVVSNFTPAPREDFRLGMPVAGQYELILNSDAHFYGGSDYSVISEASTEKVESQGLAQSIVITLPPLSTVFYRLK

SEQ ID NO: 7445 - protein, 404 aa, Unknown
  Shewanella sp. MR-7
MRPIIKSNKLDTVCYDIRGPVHKEARRLEDEGHRILKLNIGNPAPFGFEAPEEIVRDVILNLPSAQGYCESKGLFSARKAIVQHYQAQGIFGVDIEDIYIGNGVSELIMMAMQGLLNTDDEILIPSPDYPLWTAAANLAGGKAVHYRCDEDADWFPDLDDIKSKISSRTRGIVLINPNNPTGAVYSKELLLQVVELCREHNLILFADEIYDKILYDEAKHIPAASLSDDILTVTFNGLSKAYRAAGFRVGWMMLSGNLKAAKSYIEGLEMLSSMRLCANVPNQHAIQTALGGYQSINELILPSGRLTVQRDTCYELLNQIPGVSVKKPKGALYAFPKLDMKKFNLRDDERLVLDLLREKKILLVHGSAFNWPEPDHLRVVFLPYKEDLTKALTEFGHFLETYKQ

SEQ ID NO: 7446 - protein, 338 aa, Unknown
  uncultured archaeon GZfos34H10
MATYAHNLFLDSNLGDSGLFPGTKAMEDELIRMIGSLLGNENAHGYISTGGTESNIQAIRAIRNRKRKEGLQEMNIIVPKTAHFSFDKIESLLCLEVKKAGLDDELRVDVNLVKELIDDNTISIVGIAGTTEFGQIDPIKELADIAHNSDIFLHVDAAFGGFVIPFLDAEYQFDFSLDAVSSISVDPHKMGMSTIPAGCILFRDESYLADLAVNTPYLTTNEQCSLIGTRSGAPVAATYAVLKYLGRNGLRAIVDECMLLTRMLVRGAKAMDIYPVIEPVMNVVTLRFPDVDRVAKALEARGWQVSTTRAPKALRLVIMPHVTEDTIEMFLNDLACVT

SEQ ID NO: 7447 - protein, 159 aa, Arabidopsis thaliana
MDLGRFPIISILEDMLEVPEDHNNEKTRNNPSRVYMRDAKAMAATPADVIEHPNAYAFVVDMPGIKGDEIKVQVENDNVLVVSGERQRENKENEGVKYVRMERRMGKFMRKFQLPENADLDKISAVCHDGVLKVTVQNFLLRNQRNQRQFKFKLLEFVL

SEQ ID NO: 7448 - protein, 158 aa, Pisum sativum
MSLIPSFFGNRRSNVYDPFSLDVWDPLKDFPFPSSALSASFPRENSAFVSTRVDWKETPEAHVFKADLPGLKKEEVKVEVEDDRVLQISGERSVEKEDKNDEWHRVERSSGKFLRRFRLPENAKMGQVKASMENGVLTVTVPKEEIKKPDVKSIEISG

SEQ ID NO: 7449 - protein, 174 aa, Xanthomonas campestris
MPLNDLQHVPGANAAPADTHGFVFNHTMLRVKDATQSLDFYTRVLGFRLLDARDFADAKFSLYFLALLPEGTAIPDDDAQRRLWMAGIPGVLELTHNHGTETQDGPVYHDGNSDPRGFGHICISVPDIHAACARFDSLNVPYQKRLEDGRMKHLAFIKDPDGYWVEIISNTPLA

SEQ ID NO: 7450 - protein, 490 aa, Glycine max
MDGGGSTPAAPIPNANAPPPFLSKTYDMVEDPSTDAIVSWSATNNSFIVWDPPQFARDLLPKYFKHNNFSSFVRQLNTYGFRKVDPDRWEFANEGFLKGQKHLLRSITRRKPAHGQNHQQPQQPHGQSSSVGACVEVGKFGLEEEVERLKRDKNVLMQELVRLRQQQQTTDNQLQTMVQRLQGMEQRQQQMMSFLAKAVQSPGFFAQFVQQQNDSNRRITEVNKKRRLKQEGMAETEHAATPDGQIIKYQPMVNEAAKAMLRQIMKWDTSCVESLNKNSDNYVIGDASSSSSGMDSSSSSGWTSGVTLKEVSPASVQSSHVPAATGTQGHVPSTVKPEILSVPQAVASEKVMKDGAHDPPSIPVSQADVMIPDLPPITEMVTGNILDIPEENYMATETDEGYMDSSLGAGGSFPIDFEGISPDADIDDLLANPIWDEILQTSVPEDIDTNVAEASKGNEVQPMENGWGKTQHMDHLTEQMGLLSSDAKRV

SEQ ID NO: 7451 - protein, 917 aa, Unknown
  Pseudomonas sp. PCL1171
MLRKMGIKGRVLLLTLLPTSLMALLLGGYFTWMQLSELQTQLLQRGEMIAEQLAPLVAPPLSSKNTDLLERIATQSLEQPDVRTVSFLAPDRSSLAHAGPTMLNQPPIGNSSHLLQRTGNDATRYLLPVFGRHRNLAGELIPDESDRLLGWVEVELSHNGMLLRGYRSLFASLLLIAIGLICTAALALRISRTINSPISQIKLAVAQLKDGNLETRLPPLGSQELDQLASGINRMAETLQNAQEELQHSIDQATEDVRQNLETIEIQNIELDLARKEALEASRIKSEFLANMSHEIRTPLNGILGFTHLLQKSEMSPRQLDYLGTIEKSADNLLGIINEILDFSKIEAGKLVLDSVPFNLRDLLQDTLTILAPAAHAKQLELVSLVYRDTPLALVGDPLRLKQILTNLVSNAIKFTREGTIVARAMIEDEQEDSVQLRISVQDTGIGLSNQDVRALFQAFSQADNSLSRQPGGTGLGLVISKRLIEQMGGEIGVDSTPGEGSEFWISLNLPKTRDDVEDLPAAPLLGRRVAVLENHELARQALQHQLEDCGLEVTPFNSLENLTNGITSAHQTEQAIDLAVLGVTANDIPPERLNQHLWDLEHLSCKVLVLCPTTEQMLFNQSVPNPNSQLQAKPACTRKLRRALADLISPRPSRSEPGEPLSSRAPRVLCVDDNPANLLLVQTLLEDMGAKVLAVESGYAAIDAVKQETFDLVLMDVQMPGMDGRQSTEAIRQWESERHGTPLPVVALTAHAMANEKRALLQSGMDDYLTKPISERQLAQVVLKWTGLALRNQGPERAPDGLAPGVRLQVLDHEEGLRLAANKADLAADMLAMLLASLEADRQAITAAREANDNNALIERVHRLHGATRYCGVPQLRAACQRAETLLKQDDAKAMTALDELDMAIARLASEARVSA

SEQ ID NO: 7452 - protein, 460 aa, Unknown
  Malus x domestica
GQDSSYFLGWQEYEKNPYHEVHNTNGIIQMGLAENQLCFDLLESWLAKNPEAAAFKKNGESIFAELALFQDYHGLPAFKKAMVDFMAEIRGNKVTFDPNHLVLTAGATSANETFIFCLADPGEAVLIPTPYYPGFDRDLKWRTGVEIVPIHCTSSNGFQITETALEEAYQEAEKRNLRVKGVLVTNPSNPLGTTMTRNELYLLLSFVEDKGIHLISDEIYSGTAFSSPSFISVMEVLKDRNCDENSEVWQRVHVVYSLSKDLGLPGFRVGAIYSNDDMVVAAATKMSSFGLVSSQTQHLLSAMLSDKKLTKNYIAENHKRLKQRQKKLVSGLQKSGISCLNGNAGLFCWVDMRHLLRSNTFEAEMELWKKIVYEVHLNISPGSSCHCTEPGWFRVCFANLPERTLDLAMQRLKAFVGEYYNVPEVNGGSQSSHLSHSRRQSLTKWVSRLSFDDRGPIPGR

SEQ ID NO: 7453 - protein, 222 aa, Glycine max
MGSEGPTTPTTTIHVTGFKKFHGVSENPTETIANNLTEYMNKKGLPKGLVIGSCSILETAGQGALVPLYQRLQSAVIAKDTESSNSNRIIWLHFGVNSGATRFAIENQAVNEANFRCPDEMGWKPQKVPIVPSDGGISRTRETSLPVVEITKALAEKGYEVMVSVDAGRFVCNYVYYHSLRFTEQNGIKSLFVHVPLFVTINEETQMQFAASLLEVLASIPQ

SEQ ID NO: 7454 - protein, 162 aa, Triticum aestivum
SLPSPKNFLAPPRRIPPPQPLPRRTNPPPRLPQGRRFPPEVHFGVNSGASRFALENQAVNEATFRCPDELGWKPQRVPIVPSDGSISRTRETTLPVKELTKSLRKTGYDVMPSDDAGRFVCNYVYYHSLRFAEQHGIKSLFVHVPLFSTVDEEVQIHFVASS

SEQ ID NO: 7455 - protein, 452 aa, Oryza sativa
MAPTAEVAAAPVQEQEKCNGGGGGGFRGAAVRCHPALSTEKKASIRGVVGELLGAAAAAAGAGEERRRSLISLGVGDASSHACFRRGGEFAADAVADAARSGVFDCYAPSCGFPAARRAVADHLSAGARHRTRDADVFMTAGGTGAITAIATVLGGAPGANVLLPRPGFAPYEAACELAGAEPRFYDLLPRRGWEADLAGVRAMADGATAAIVVINPNNPCGAVYSAQHLFQIAETARELGIPIIADEVYAHMVFGGSKFVPMATFAHITPVITIGALSKKFMLPGWRLGWLAFCDPNGALKHVRNATEMLLNVTSGPASIVQAAVPKILSNEHNEFHRNVVNLLESAADALYRRVNQIEALQCYSKPHGSMFMMVEVNTSLLFGVEDDMDFARELIKEESVLVLPGSVIGLKNWIRIFFGAPTSVILEACDRIEAFCQKRAVQVKLLKKKF

SEQ ID NO: 7456 - protein, 481 aa, Chromobacterium violaceum
MRKHTLTTAAGAPVVDNQNVQTAGPRGPMLLQDVWYLEKLAHFDREVIPERRMHAKGSGAFGTFTVTHDITRYTRAALFSDIGKKTDLFLRFSTVAGERGAADAERDIRGFAVKFYTEEGNWDLVGNNTPVFFLRDPLKFPDLNRAVKRNPYTNMRDANANWDFWTLLPEALHQVTIVMSDRGIPASYRHMHGFGSHTFSLINAKGERHWVKFHFHTQQGIRNLSDAEAEKLVGQDRESAQRDLLECIDRGDFPRWTLYIQVMTEAQADACPFNPFDLTKVWSHKDYPLIEVGVLELNRNPQNYFADVEQAAFNPANVVPGISFSPDRMLQGRLFAYGDAERYRLGVNHHLIPVNAPRCPFHNSYHRDGAMRVDSNAGATIGYEPNSQGKWQQQPAYDEPPLALQGNAYHYDFRADDDDYYSQPGALFRLMTPAQQQALFDNTARAMGGVDEAIKRRHIANCAKADPAYGAGVAKALGLSV

SEQ ID NO: 7457 - protein, 392 aa, Mascagnia anisopetala
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLDYHSGNTGLSTDSLMEAGYPGASVLGDAVCGMAAVSISSRDFLFWFRSHTAKEIKWGGAKHDPDVKDDGRKMHPRSSFKAFLEVVKWRSMPWEDIEMDAI

SEQ ID NO: 7458 - protein, 482 aa, Pseudomonas fluorescens
MSQTKTLTTASGAPVADNQNSRSAGPRGPLLLDDFHLIEKLAHFNRENIPERRVHAKGSGAYGTFTVSRDITEYTSAKLFEAVGKKTPTFLRFSTVGGERGSADTERDPRGFALKFYTEEGNWDIVGNNTPVFFIRDPLKFPDFIHTQKRLPQSNLKSAQMMWDFWSHSPEALHQVTILFSDRGIPDGYRHMHGFGSHTYSLINAKGERHWVKWHYKTKQGIKNLAPADAARLAGTDPDYAQRDLFNAIERGEFPKWSVCIQVMTEAQAAAHYENPFDVTKTWSQKEFPLIEVGELELNRNPLNYFAEVEQAAFGPSNMVPGVGLSPDRMLQGRVFAYADAHRYRVGTNHQQLPVNAPLSPVNSYQRDGSMAFGSNGGAAPNYEPNSYGDAPKQAPRYAEPALALSGAADRYDHREDADYYSHAGALFRLMNDEQKALLINNIVGAMAGVAADVVDRQLQHFYKADPAYGEGIAKALGVSLK

SEQ ID NO: 7459 - protein, 392 aa, Mascagnia chasei
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVEVIQDERLAQPLSLCGSTLRSPHGCHAHYMTNMGTIASLVMAVTINEDDDMMDGDQQQMTRKLWGLVVCHHTSPRFVPFPLRYACEFLIQVFGVQIHKEVELAAQVREKHILQIQTMLCDMLLRDAPVAIIMQSPNVMDLVKCDGAALYFKKKTWLLGVTPTEEQIRDIAEWLLEYHSGNTGLSTDSLMEAGYPGSSALGDAVCGMAAVSITSRDFLFWFRSHTAKEIKWGGAKHDPDVKDDGRKMHPRSSFKAFLEVVKWRSMPWEDIEMDAI

SEQ ID NO: 7460 - protein, 548 aa, Escherichia coli
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTVAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 7461 - protein, 366 aa, Pseudomonas fluorescens
MTDQNLFTPYTLGALALANRIVLAPLTRNRAGAGFVPSEFAATYYSQRASAGLLISEATQISQQGQGYQDTPGIYTQAQIDGWRTVTDAVHAQGAKIFVQLWHVGRVSHVDLQENGAAPVAPSALRAATKVFVNNRFEDASEPRALDISELPGIVADFRQAAANAIAAGFDGVEIHGANGYLLDQFLKDSANVRTDAYGGSIENRARLLLEVTAAVVNEIGADRTGVRLSPVSPANGVSSSNPQAQFNYVVDQLDALDVVYLHMVEGATGGPRDVAPLDFTALRQRFKNTYIANNGYDLELATSRLAEDQADLIAFGRPFIGNPDLVERLKTGAALSAFNPATLYGGGAAGYIDYPTLVDSSASAS

SEQ ID NO: 7462 - protein, 392 aa, Mascagnia bracteosa
DLEPVNPADVPVTAAGALKSYKLAAKAISRLQSLPSGNISLLCDVLVKEVRDLTRYDRVMVYKFHEDEHGEVVSECRRSDLESYHGLHYPATDIPQASRFLFMKNKVRMICDCLAPPVKVIQDKRLPQPLSLCGSTLRSPHGCHAQYMTNMGTIASLVMSVTVNEEDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDGRKMHPRSSFKAFLEVVKWRSMPWDDVEMDAI

SEQ ID NO: 7463 - protein, 275 aa, Unknown
  uncultured bacterium
  misc_feature (32)..(32): Xaa can be any naturally occurring amino acid
  misc_feature (197)..(197): Xaa can be any naturally occurring amino acid
  misc_feature (237)..(237): Xaa can be any naturally occurring amino acid
  misc_feature (241)..(241): Xaa can be any naturally occurring amino acid
MSAEQPRLILNSGQSMPQLGLGAYKVNQDIAXQLVQHALEIGYRRIDTAALYDNEAEVGAAVRKSGLAREEVFVTSKIWNDRHGYHEAKEAIQESIDRLNIDYVDMMLIHWPCPKQDKFVETWHAFEEVLETGLVKGIGVSNFNQPHLEKLLQHSNITPAINQVELHPQLAQNGLREFNERHGIRTEAWAPLGRARXMQHPLLVEIABSLGKSVAQVIIRWHLQIGNLVIPKSSNPXRLAXNFDVFDFELSHHNMSIIATLNTETRIATNPDDMN

SEQ ID NO: 7464 - protein, 393 aa, Mascagnia stannea
VIEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVEVIQDERLPQPLSLCGSTLRSPHGCHAQYMTNMGTIASLVMSVTINEDDDMMDGDQQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDGVCGMAAVSITSRDFLFWFRSHTAKEIKWGGAKHDPGDKDDGRKMHPRSSFKAFLEVVKWRSMPWEDVEMDAI

SEQ ID NO: 7465 - protein, 392 aa, Hiptage benghalensis
DLEPVNPADVPVTAAGALKSYKLASKAISRLQSLPSGNISLLCDVLVKEVRDLTGYDRVMVYKFHEDEHGEVVSECRRSDLGSYLGLHYPATDIPQASRFLFMKNKVRMICDCLAPPVKVIQDERLPQPLSLCGSTLRSPHGCHAQYMTDMGTIASLVMSVTINEDDDMMDGDQQQMARKLWGLVVCHHTSPRFVPFPLRYACEFLIQVFGVQINKEVELAAQVREKHILQIQTMLCDMLLRDAPVAIITQSPNVMDLVKRDGAALYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDGRKMHPRSSFKAFLEVVKWRSMPWEDVEMDAI

SEQ ID NO: 7466 - protein, 258 aa, Zea mays
  misc_feature (167)..(167): Xaa can be any naturally occurring amino acid
  misc_feature (223)..(223): Xaa can be any naturally occurring amino acid
MAGAGAGGWKKRVGRYEVGRTIGRGTFAKVKFAVDADTGAAFAIKVLDKETIFTHRMLHQIKREISIMKIVRHPNIVRLNEVLAGRTKIYIVLELVTGGELFDRIVRHGKLRENEARKYFQQLIDAIDYCHSKGVYHRDLKPQNLLLDSRGNLKLSDFGLSTLSQNXLVHTTCGTPNYVAPEVLSSNGYDGCAADIWSCGVILYVLMAGYLPFEENDLPHLYXKGAKSLIQRILDPNPRTPIVCVKLSTRTSSYISLY

SEQ ID NO: 7467 - protein, 456 aa, Glycine max
MPEIGQAAVAAAADDTALFGKYELGRILGCGAFAKVHYARNVQTGQSVAVKIINKKKLAGTGLAGNVKREITIMSKLHHPHIVRLHEVLATKTKIFFIMDFVRGGELFGKISKGRFAEDLSRKYFHQLISAVGYCHSRGVFHRDLKPENLLLDENGDLRVSDFGLSAVRDQIRPDGLLHTLCGTPAYVAPEILGKKGYDGAKVDVWSCGVVLFVLAAGYLPFNDPNLMVMYRKIYKGEFRCPRWMSPELRRFISKLLDTNPETRITVDGMTRDPWFKKGYKELKFHEEDYHASGSGSFFGPKDERVVNLNAFDLISFSSGLDLSGMFGGEWGERLVTREPPERVLEAAEEAGAAAGMAVRWKKECGVELEGFNGRFGIGVEVYRLTAELAVVEVRKRGGDAAVRGVWEERLKPLLLGGATTSYSNSSEDEQQHQEEEQQHQEEKQEQEPESKVACE

SEQ ID NO: 7468 - protein, 226 aa, Phytolacca americana
GLVKKAHEISILCDADVALIVFSTKGKLFQYATGSCMEKILERYERYSYAERQLITPDPESHLSWTLEHAKLKARVEILQKNQRNYMGEELDTLSLKELQTLEHQLDSALKQIRSKKNQLMYESISQLQKKDKALQEQNKSLSKEVKEKEKEKEKTMTQQAQWDNQNQDINSSSCLMSDQALPSLNIGMNYQTESGSSSVENEAIQQQNRNNTTIALMPHWMLSHL

SEQ ID NO: 7469 - protein, 273 aa, Unknown
  uncultured bacterium
MASPLVTLNDGRLMPQLGLGVYKVNQDIAVQLVQTAIEIGYRRVDTAALYDNEAEVGAAIRKSGLDREEIFVTSKIWNDRHGYHEAKDAIQESVDRLNIGYVDMMLIHWPCPKQDKFVETWHAFEEVLETGLVKSIGVSNFHQHHLEKLLAAANVVPAINQVELHPQLAQNSLRHFNKQHNIKTEAWAPLGRAKFLENPLLVEIAESLGKSVAQVIIRWHLQLQNLVIPKSSNPDRLAENFDVFDFELSQHQMGIIATLNTETRIATNPDDMN

SEQ ID NO: 7470 - protein, 785 aa, Candida albicans
MNTNLLFIPLKQSSVLDLGDELRQVITNNYFQPASSFNSDLIYITQLRNQVAQIKNVNDELGKTSQDDSILLEYLQVLNALQNKFSDDCVEFAWFDTLAYGPQGPYRYRSLKIEKLNVIYQIGTLYSQIAISESRHTDIGLKRACHYFQLSAGCFMFINNFLIETIKNKNDPLVLSIPLSMQSPTIQCLEYLMLAQAQETIWQKTINNNSMKDSVVARLSIQTSEYYSKALDFGNSSDLIKLEWINHMKVKKLHFLAAAHLRSSTIAADSFQYGEQVAHLRVASQAVDQALKSKKYVNSLVLEDLQGLADVIKVRLRTAEKDNDLVYLKIVPQEKELKTIIGVSMVKSIIPEAFEQKPESNTEIFKELLPYVIIHVAQAMRERQDEYVQTKFHTPISSLNNMLVKFLIDRDLPSSIDSIQQPENIPDSVIHHSQEILKTGGVDFIDKAFKELDKLKLECNHLLQECETRIDLDRSEDDMLRRKQGSTRWTRKSTDDAAQELIKKVDKMKQYLLQANNGDGFVLKKFYDIKPALDVYSSGYKALSQYIPNSQYIELPEQLSIVISDLRSCLARANTLESERKEFLQTLEIRSRDNSILPKLITEYNSNRSKYQTENGEFNFNAFESVYEKHMKLFDSDIKYIARTRDSQMTLEHEIDSINQKFVQEFKSVQNSSNEKRQQVLQYLETAYEKFLEIINNLTEGSKFYTDFIEKGSAVLQECEEYLYRRRVESRDLELAISNSFQQQQQVQEQNEQLSVPRNYSNDKLISPKTSKPGLWNPNSDIQFS

SEQ ID NO: 7471 - protein, 236 aa, Unknown
  Frankia sp. EAN1pec
MSDRLYFRQLLSGRDFAVGDPAATQMVNFVYLIGDRGTGEAVVVDPAYRVGDLLDVLAADDMRLTGALVTHHHADHVGGTAFGIELEGIRELLERTSVPIHLQRDEAEWVRRGTGVGAAELVEHGDDDVVTVGAVDIRLLHTPGHTPGSQCFLVDGRLVAGDTLFLEGCGRMDFPGGDAAAMYDSLRRLGALPDDVTVYPGHRYSAESAAELGVVRKMNYVFRPTSSRQWLAMLGA

SEQ ID NO: 7472 - protein, 631 aa, Ashbya gossypii
MSQLSAVPLKMTLQVDMQAQLAAIIDSTFYQVSSVFIDDLAAVNDMRNRSLMEADASVSNLEALLEYCKTLFALIAKFPDRQIEFTWFETLGHKAYGKTSNLWKFELFNVIYNIGAVKSLLASSMGNDELKEACRYLQESAGCFQYILSAMERELESVIDEKTIRAVLNLMLAQAQECCWARALRDAMKHSPIARLALQVSNFYEEAHRYARISPVIRTKLVKYINEKSFYFAAVAHYRHALHFEEKQQYGNAVRSLNEAQEKIKGAGWGPEVLPFEKELNDTLNTLQRDNDLIYLQHIPSQCPVINPVSMVKPILIDLLSTGTQKIHLFRNLLPIDVIESSAAFNIRQDKYVEDYVKSPLVALNKLLHNSLPENEALPGMKHLTEEEFDIYAKTLAGLNEFSSQLGERLTVIKSLIDGATTRLPAEANHHADQDNSKDIVEEYNKRIVTLQGYLRQGEEITRETTQIFETVDRDLLTTQLQLAATNNPTMRKVEALTKERYDYIAEVEKKSLQNRILPSLVSNYKETGSLDFEPIFQEHLKMFKKDIEYVQLGKKRNAELIAELNAEEGEESGKIKRLSPRDIQIQDFKHSLHLLEQVKENIEEGQVFYEDLKESIGVLHEDVTDFLNKS

SEQ ID NO: 7473 - protein, 275 aa, Unknown
  uncultured bacterium
MSAEQPRLILNSGQSMPQLGLGAYKVNQDITVQLVQHALEIGYRRIDTAAIYDNEAEVGAAVRKSGLAREEVFVTSKIWNDRHGYHEAKEAIQESIDRLNIDYVDMMLIHWPCPKQDKFVETWHAFEEVLETGLVKGIGVSNFNQPHLEKLLQHSNITPAINQVELHPQLAQNGLRELNERHGIRTEAWAPLGRARFMQHPLLIEIAESLGKSVAQVIIRWHLQIGNLVIPKSSNPDRLAENFDVFDFELSHHNMSIIATLNTETRIATNPDDMN

SEQ ID NO: 7474 - protein, 539 aa, Corynebacterium diphtheriae
MAKLIAFNQEAREGILKGVDALANAVKVTLGPRGRNVVLQKAFGSPTVTNDGVTIAREIDLSDPFENLGAQLVKSVAVKTNDIAGDGTTTATLLAQAVVTEGLRNVAAGANPIELNRGIAAGSEFVVGKLRERATDVSSAADIANVATVSSRDPEVGDMVAAAMEKVGKDGVVTVEESQSIESYLDVTEGVSFDKGFLSPYFITDTDTQHAVLEQPAILLVRNKISSLPDFLPVLEKALEASKPILIIAEDVEGEPLQTLVVNSIRKTLRAVAVKAPYFGERRKAFMDDLAVVTGATVIDPEVGVNLNEAGAEVFGTARRVTVTKDETIIVDGAGTAEAVENRRAQIRREIENTDSAWDREKAEERLAKLSGGVAVIKVGAATETEVSERKLRVEDAINAARAAAQEGVIAGGGSALVQISKELREFAQEFEGDAKIGVIALANALAKPTYWIADNAGLDGAVVVSKVSELPNGEGFNAATLEYGNLIEQGIIDPVKVTHSAVVNATSVARMVLTTEASVVEKPAAPAPEAGHHHHHHH

SEQ ID NO: 7475 - protein, 238 aa, Pachysandra terminalis
VQLRRMENKINRQVTFAKRRNGLLKKAYELSVLCDAEVALIIFSARGKLYEFCSSSSMQNTLERYQKCSYGPLEPSQPAKETQSSYLEYMRLKARVEGLQRSQRNLFGENLGPLSTKELEQLEHQLEMSLNQIRSTKTQFMLDQLSDLQRKEQMLQEANRSLKRKLEESNAENSLGPSWESGGHGVPFGHQPAQSEGFFQPLECNSTLQIGYNHVGADQMSITVPPQNVNGFVPGWMV

SEQ ID NO: 7476 - protein, 238 aa, Peperomia caperata
  misc_feature (207)..(207): Xaa can be any naturally occurring amino acid
  misc_feature (238)..(238): Xaa can be any naturally occurring amino acid
VQLKRMENKINRQVTFSKRRTGLLKKAHEISVLCDAEVALIVFSTKGKLYEYATNSSSMPGILDRYERHSFTDKEFFIKEGEPPEGAWTLEYAKLKARYELLQKNYRHYLGEDLGSLSGKELQQLEGQLDASLKNVRSRRTQALFHTISDLQKKEKSLLEQNSVMIKKLQDLEKAEKAQQSQLEMQNHERTQNQPPLILLPPPALSXGSFRQENGPSVEGEAAPRVAQKNSLLPPWMX

SEQ ID NO: 7477 - protein, 170 aa, Triticum aestivum
AYLGELQNKFVQKSRLVPVRNSRDIVDPRVRSFTKLPSTPTEGLKSSSALTFCNPCILNTRSVDSPATVCKSEIRRNRVAALSSELVCPLTCSPFPSSALPTCRCSDDDPCGSTETLDGSEVQSPRPSHSTSTELDKRGEQDVDRTTCSGMFWSRRSCQREQQCNAEINA

SEQ ID NO: 7478 - protein, 205 aa, Schizosaccharomyces pombe
MAGKKKHLLKVIILGESGVGKTSIMNQYVNRKFSKDYKATIGADFLTKEVLVDDKVVTLQLWDTAGQERFQSLGVAFYRGADCCVLVYDVNNSKSFETLDSWRDEFLIQASPSNPETFPFILLGNKVDVEEQKRMVSKSKALAFCQARGEIPYFETSAKEAINVQEAFETVAKLALENMDSDDIAADFTDPIHLDMESQKTSCYC

SEQ ID NO: 7479 - protein, 481 aa, Arabidopsis thaliana
  misc_feature (7)..(7): Xaa can be any naturally occurring amino acid
MALKALXYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGVFHLRTTILPAEDEMPEIMDSFKKFNDEFMTQYDNNFGYSKM

SEQ ID NO: 7480 - protein, 513 aa, Burkholderia vietnamiensis
MRMKLKNIGLIAAGLATGVFATLQISASAEQTATAPLPLDQLRLFAEVFGQIKREYVEPVDDKKLLTAAIKGMVSSLDPHSSFLDKTDYDELQEQTKGRFAGLGIEISQEDGLVKVISPIEDTPAFRAGIRPGDLITRINDKPVRGMTLDKAVKQMRGEPGTKVTLTIFRKSDDRTFPVTVTRAIIKVQSVKMKMLDPGYAYIRITSFQERTTPDLAAKLQDIARQQPNLKGLILDLRNNGGGLLQSAVGVAGAFLPPDSVVVSTNGQIPDSKQVYRDTYDNYRLPSFDGDPLKNLPPIFKTVPMVVLTNAYSASASEIVAGALQDSKRAQIMGKTTFGKGSVQTVRPMTADTALRLTTAYYYTPSGRSIQNKGITPDVPVDQYADGDPDDVLVTREVDYTNHLANTQDPNEKKEQEEREQRRMDQLRLLEEQNDKKTPEQRQKDRDRKPIEFGSADDFMMQQALNKLEGKPVQESKSLLAESTTKSPAGKAASAAKASGAKAAAPKPASAPQ

SEQ ID NO: 7481 - protein, 392 aa, Callaeum septentrionale
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGTALYFKNKTWLLGVTPTEEQIRDIAEWLLEYHSGNTGLSTDSLMEAGYPGASVLGDAVCGMAAVSITSRDFLFWFRSHTAKEIKWGGAKHDPDEKDDGRKMHPRSSFKAFLEVVKWRSMPWEDIEMDAI

SEQ ID NO: 7482 - protein, 392 aa, Mascagnia hippocrateoides
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHASPRFVPFPLRYACEFLIQVFGVQINKEVELAAQVREKHILQIQTMLCDMLLRDAPVAIITQSPNVMDLVKCDGAALYFKNKIWLLGVTPTEEQIRDIAEWLLEYHSGNTGLSTDSLMEAGYPGASVLGDAVCGMAAVSITSRDFLFWFRSHTAKEVKWGGAKHDPHDKDDGRKMHPRSSFKAFLEVVKWRSMPWEDIEMDAI

SEQ ID NO: 7483 - protein, 371 aa, Arabidopsis thaliana
MASENLNDKISVFKKLKAKSDNKICFDCNAKNPTWASVTYGIFLCIDCSAVHRSLGVHISFVRSTNLDSWSSEQLKMMIYGGNNRAQVFFKQYGWSDGGKTEAKYTSRAADLYKQILAKEVAKSKAEEELDLPPSPPDSTQVPNGLSSIKTSEALKESNTLKQQEKPDVVPVSPRISRSVKKPLGAKKTGKTGGLGARKLTTKSSGTLYDQKPEESVIIQATSPVSAKSARSSFSSRFDYADNVQNREDYMSPQVVSHVAPPKSSGFFEEELEMNGGRFQKKPITSSSKLQIQETDEARKKFTNAKSISSAQYFGNDNNSADLEAKSSLKKFSQSLVLICLETVMEISLLISLRVIFSTAYLSRHNKTYHH

SEQ ID NO: 7484 - protein, 392 aa, Hiraea fagifolia
DLEPVDPADVPVTAAGALKSYKLAAKAISRLQSLPSGNISLLCDVLVKEVRDLTGYDRVMVYKFHEDEHGEVVSECRRPDLESYLGLHYPATDIPQASRFLFMKNKVRMICDCLAPPVKVIQDKRLPQPLSLCGSTLRSPHGCHAQYMTNMRTIASLVMSVTINEDDDTMDGDQQQMTGKLWGLVVCHHTSPRFVPFPLRYACEFLIQVFGVQINKEVELAAQVREKHILQIQTMLCDMLLRDAPVAIITQSPNVMDLVKCDGAALYFKNKIWLLGVTPKEEQIRDIAEWLLEYHSGNTGLSTDSLMEAGYPGASVLGDAVCGMAAVSITSRDFLFWFRSHTAKEIKWGGAKHDPGDKDDGRKMHPRSSFKAFLEVVKWRSMPWEDVEMDAI

SEQ ID NO: 7485 - protein, 273 aa, Unknown
  uncultured bacterium
MASPLVTLNDGRLMPQLGLGVYKVNQDIAVQLVQTAIEIGYRRVDTAALYDNEAEVGAAIRKSGLEREEIFVTSKIWNDRHGYHEAKEAIQESVDRLNIGYVDMMLIHWPCPKQDKFVETWHAFEEVLETGLVKSIGVSNFHQHHLEKLLAAATVVPAINQVELHPQLAQNSLRHFNKQHNIKTEAWAPLGRAKFLENPLLVEIAESLGKSVAQVIIRWHLQLQNLVIPKSSNPDRLAENFDVFDFELSQHQMGIIATLNTETRIATNPDDMN

SEQ ID NO: 7486 - protein, 392 aa, Ectopopterys soejartoi
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCMAPPVEVIQDERLPQPLSLCGSTLRSPHGCHAQYMTNMGTTASLVMSVTINEDDHMMDGDQQQMTKKLWGLVVCHHTNPRFVPFPLRDACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASALGDAVCGMAAVSITSRDFLFWFRSHTAKEIKWGGAKHDPDDKDDGRKMHPRSSFKAFLEVVKWRSMPWEDVEMDAI

SEQ ID NO: 7487 - protein, 562 aa, Costus speciosus
MAAQLGLPLVSCHRGASQAASSSAHLVPGASAIMQAGNRRQKMRAPALRDRVVFARVVPVDGSVGFAGSSTEQETAVESATPTAVPSKVVLGRSSFPRGFIFGAASAAYQVEGAWNEGGRGPSIWDTFTHDHPEKIADHSNGDKATDSYKKYKEDVKLLKDLGLDSYRFSISWSRILPKGTLQGGINQEGIQYYNDLINELLKNGIRPMVTLFHWDVPQALEDSYKGFRSSEIVNDFKDYADICFKEFGDRVKHWITLNEPWSLSTMGYAFGRHAPGRCSTWYGCPAGDSANEPYEVTHNLLLAHANAVKIYRDNYKATQNGEIGITLNSLWYEPYSKSHEDVEAATRALDFMFGWYMDPLVNGDYPFIMRALVRDRLPFFTHAESELIKGSYDFIGINYYTSNYAQHAPVTEDHTPDNSYFDSYVNQSGEKNGVPIGPLQGSWIYFYPRGLKELLLYVKRRYCNPKIYITENGTAEVEKEKGVPLHDPERKEYLTYHLAQVLQAIREGVRVKGHFTWALTDNFEWDKGYTERFGLIYIDYDKDFNRQPKDSTKWFSKFLRT

SEQ ID NO: 7488 - protein, 392 aa, Stigmaphyllon paralias
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDTMDGDQQQMTRKLWGLVVCHHTSPRFVPFPLRYACEFLIQVFGVQINKEVELAAQIREKHILQIQTMLCDMLLRDAPVAIITQSPNVMDLVKCDGAALYFKNKTWLLGVTPTEEQIRDIAQWLLEYHSGNTGLSTDSLMEAGYPGASALRDAVCGMAAVSITSRDFLFWFRSHTAKEVKWGGAKHEPDDKDDLRKMHPRSSFKAFLEVVKWRSMPWEDVEMDAI

SEQ ID NO: 7489 - protein, 266 aa, Bordetella parapertussis
MQTAPPLSAVVPLPAFSDNYIWALAHEGQAAVVDPGDAAPVLRWLRATGATLCAILLTHHHPDHVGGVLELVQATGATVYGPAGETLPHCDVRLAEGDRVTLPELALALEVLDVPGHTAGHIAYTGRAAGVERVLFCGDTLFAGGCGRLFEGTPAQMLDSLEKLSALPADTQVCCAHEYTLANLRWALAVEPANRTLQQWYQRAQELRNEGTPTLPSTIGQERETNPFLRTPHAAVAHAAAVWSGRSLATPVEVFAALRQWKNNFK

SEQ ID NO: 7490 - protein, 206 aa, Peperomia caperata
SVLCDAEVAVIVFSTKGKLYEYATDAGMARILDRYEKHTFSNRELELTNLESEGAWSLEYGKLKARFELLQKSHRHYLGEDLGALNMKELQHIEHQLDSALRHVRSRKNQILSDTISDLQTKEKLIHEQNKILQKRIQEKEREITGQPQWEIVPSRQENQNPQPTLFPIPLHTLSIGYCKEDGKAIELGLENEPRPLSQKMPPWML

SEQ ID NO: 7491 - protein, 447 aa, Deinococcus radiodurans
MTPAAYCGSMNRNRIALVAGTLALTAAVAAAQMGGYTSQTLANTPEGKSLVQVLNDLNRYYLYPVNQDKVLRGAITGALASLDDEFTYYTEPEDNAVAEQDLSGSFGGIGVTLVAANSDGSGGKVDNVFKDNPAFKGGVHIGDVFLKIGDKDVTGAKLNDIVKLVRGPIGSEVDVTFGRNGKPYTVKLKRDKVNVISVEKTILPGNIGYVALNTFYNEQASAQFRAAIADMKKANVQKLILDLRDNGGGLLSAGVDVADQFLQSGPIVSLRERGGQPEVYGSARKQATDYTGKLVLLVNKNSASASEVVGGALQDNKRATIIGEQTFGKGVAQVPITLPDGGKVAIVNSAWITPKGREIHKKGITPDIVVKDTRFPVPLNFSGSGVAPGTTLTLTVGDQPVKVTADKDGKFTYVGEIKRRDRSDVQGQAVVDVEHDAILKKALETLK

SEQ ID NO: 7492 - protein, 429 aa, Prochlorococcus marinus
MTTFSGLLVSNHSKATILENNYKEVIDHVWQIVYRDFLDSSGKFERSNWINLRKEFLAKKYSDNNEAYDAIRDMLSNLDDPYTRFLDPKEFNQMRIDTSGELTGVGIQIAKDNESDSIIIISPIEGTPAYEAGIKAKDIILSIDNVSTKGLNIEDAVKLIRGRRGTKVKLEILRNGNSFYKSLLRERIELKSVTSKINKTKDGLLIGYVRLKQFNANASREMKDTLKDLEIKKVSGYVLDLRSNPGGLLESSIDISRQFIDKGIIVSTLSKDGLRETKRGNGKALTKKPLIVLVNEGSASASEIVSGAIRDNNRGKLVGKKTFGKGLVQSMRTLVDGSGLTVTVAKYLTPNGTDINKFGITPDIEVKMNSNPILQREIGTKRDRQYRAGEKELLKIIKKTKLVSQFQPDSANVLAVFKNNENNFVYSLN

SEQ ID NO: 7493 - protein, 1118 aa, Cyrtosia septentrionalis
  misc_feature (1003)..(1003): Xaa can be any naturally occurring amino acid
MSFSRPSQSSSASSRSRQSARIIAQTTVDAKLDAEFDAMGTCFDYSQSIRAPPDEQRSEKVTAYLQHIQRGKLIQPFGCLLALDEKTFKVLAFSENAPEMLTMVSFTVPSVGDHPTIVIGTDVRNLFTSPSTAALQKALGFAEVSLLNPILVHCKSSGRPFYAIVHRVTGCLIVDFEPVKPNDVPMTAAGALQSYKLAAKAISKLQSLPSGSMEKLCNTVIEEVFELTGYDRVMVYKFHEDDHGEVFAEITKPGLESYFGLHYPATDIPQAARFLFMKNKVRMICDCHAKHVKVYQDKKLPFDISFCGSTLRAPHSCHLQYMENMNSIASLVMAVVVNEGEEDGGNEAEENSPPHRRKRLWGLVVCHNESPRFVPFPLRYACEFLMQVFAIHVNKEFELENLVKEKKIMRTQTMLCDMLLREFVPLGIITQTPNIMDLVKCDGAAFLYQDKIWRLGVTPSEPQIYDIVHWLSACHMDSTGLSTDNLHEAGYPGISSLGDVVCGMAVARITSKDMLFWFRSPAAASIRWGGAKHDAADKDDGRRMHPRSSFKAFLEVAKVRSLPWGDHEMNAIHSLQLILRDTLNGIENKAIIDPQLNELKLEGMVEVVTNEMVRLIETATVPILAVDADGLINGWNMKIAQLTGLSDDEARGKHLLTIVEDSSIDVVKRMLLLALQGIEEQNVQFQVKTSGVRRDDGPLILVVNACVSRDIHSNVVGACFVAQDVTGQKFILDKFTKIEGDYKAIVQNPCPLIPPIFGTDEFGWCSEWNLAMTKLSGWKRDEVMDKMLLGEVFGINTSCCRMKSQDALVNFSILISNAFSGQETEKSPFSFMNRSGKHVDCLLSVSRKVDVEGNLTGIFCFVLATGHELQQSQPLVQQETVKRMKALAYIRNEIRNPLSGIMYTRKMLVGTNLDEEQSLLLSTGAKCHNQLNRILEDLNLEDIMNSCLELEMNEFNLKDVVLTAVSQVMLPSEGKGVNVVYDLPDGLLSEYVYGDSLRLQQIXADFLLVCVKYSPDGAQVEITANLKKNTLGKSLQLIHVEIRITHAGNGVAEELLSEMFGSKEETSEEGMSLMVCRKLLRLMNGDVCYLREANKSVFILSAELACASKQPKDVKAAV

SEQ ID NO: 7494 - protein, 438 aa, Campylobacter lari
MKTKRNLIIAASICSLVTASFIFTNLQAKNPTPSEAEKKIEALSKLTRTMSIIEQYYVDDVNYTDLVDKSIAGLLTNLDAHSSFLDEKGYKELKEQTNGEFGGLGFTITQKDGAITVVAPIEGSPADKAGIKTDDIILRINNESTLGMTLNEAVSKMRGEPKTKVTLTIYRKGDAKPFDVNLKRDIIKVDSVYTKLIENENLLYLRVTNFDKNVVDEASKAIKKHSNVKGIILDLRTNPGGILNQAVGLVNLFVDKGVIVSQKGKIESENVEFKANPSKKITNAPLVVLVNGGSASASEIVSGALQDFKRAIIVGEKTFGKGSVQLILPMDEKGKEGLRLTIAKYYLPSGRTIQAVGVSPDIEVFPGKVSKEENHGFEIKESDLKKHLQAELDKIGHQEKKKDNKEDKNIITKEQINNDIQLKTAIDAIKILNITKGE

SEQ ID NO: 7495 - protein, 320 aa, Neurospora crassa
MATKTFKLNTGANIPALGLANPSPPPPSIGTWQGESTQVKDAVVAALKSGYRLIDTAYCYGNEEHVGAGLKEAFDQGIVKREDVFVVTKLWATYTSRAEEGLEKSLRNLGLEYVDLFLVHWPLLMNPEGNDDRFPKLPNGERDILRDYSHVQIWKNMEKLVGSGRTKAIGVSNYSKRYLEELLPHAKIVPAVNQIENHPQLPQQEIVDFCKEKGIHIMAYSPFGSTGSPVTSAEPVIKIAEKHGVKPTTVLLSYHLYRGSTVLPKSTNPERIEANAKLIELDAEDQKLLNDYSEGLVKEGKVQRYVYPPFGVDFGFPDKS

SEQ ID NO: 7496 - protein, 210 aa, Unknown
  Petunia x hybrida
AHEMSMLCDAEVALIIFSNRGKLYEFCSSSSMLKTLERYQKCNYGAPETNISTREALEISSQQEYLKLKARYEALQRSQRNLLGEDLGPLNSKELESLERQLDMSLKQIRSTRTQLMLDQLQDLQRKEHALNEANRTLKQRLMEGSTLNLQWQQNAQDVGYGRQATQTQGDGFFHPLECEPTLQIGYQNDPITVGGAGPSVNNYMAGWLP

SEQ ID NO: 7497 - protein, 66 aa, Glycine soja
ETRHPVYRGVRRRDSGKWVCEVREPNKKSRIWLGTFPTAEMAARAHDVAAIALRGRSACLNFADSA

SEQ ID NO: 7498 - protein, 479 aa, Arabidopsis thaliana
MENKPSVLTDKYDVGRLLGQGTFAKVYYGRSILTNQSVAIKMIDKEKVMKVGLIEQIKREISVMRIARHPNVVELYEVMATKTRIYFVMEYCKGGELFNKVAKGKLRDDVAWKYFYQLINAVDFCHSREVYHRDIKPENLLLDDNENLKVSDFGLSALADCKRQDGLLHTTCGTPAYVAPEVINRKGYDGTKADIWSCGVVLFVLLAGYLPFHDSNLMEMYRKIGKADFKAPSWFAPEVRRLLCKMLDPNPETRITIARIRESSWFRKGLHMKQKKMEKRVKEINSVEAGTAGTNENGAGPSENGAGPSENGDRVTEENHTDEPTNLNAFDLIALSAGFDLAGLFGDDNKRESRFTSQKPASVIISKLEEVAQRLKLSIRKREAGLFKLERLKEGRKGILSMDAEIFQVTPNFHLVEVKKSNGDTLEYQKLVAEDLRPALSDIVWVWQGEKDELTSQQETEYQQQQQQEQQEQEEPLKF

SEQ ID NO: 7499 - protein, 143 aa, Wolinella succinogenes
MFLTRFDPLRDLKEIERRFLTPFGEGGEGGAKSNLRGFAPVVNTREEEKGYFIEVDLPGVQKEDIHIDVKENTLSITGERKLKEEVKEENYYKVESFFGKFQRSFTLPENVDSDAITAQSKDGVLEIFIPKTAPKDAKRIAIS

SEQ ID NO: 7500 - protein, 404 aa, Solibacter usitatus
MSSRTKYFVVSTSTCLTVLLLIGSVLGRSASPDDTYKHMGVFADVVSRIKSEYVEEPDMKSVTLGALNGMLEAIDPFASYLNADQYRDYLKNKDVKRADVGLILSKKFGYVGVVGTITGSPAAKANFTTGDMIESIGGVATRDMPLAYANMLLQGESGTTVDLSVVRVRHPEPTSVKLTRAVFALPSVESRVIGDKVGYINIDALSPALVKEVAANVQKLQKDGAQKLVLDLRNCATGSPEDGIALANLFMNKGRITYLVGQKVARQNFEADPAKAISSLPLAILTNRGTADAAEVAAAALLDNKRAQVVGERTYGDAAVRRAITMEDGGAIILSVAKYYSPDGGKAIQDTGVTPNNVVSDADAQIDVDDNGEPVPDAAAEKGPEKKVEDDAVVKKALEVLAKG

SEQ ID NO: 7501 - protein, 392 aa, Unknown
  Lasiocarpus sp. Anderson 13834
DLEPVNPADVPVTAAGALKSYKLAAKAISRLQSLPGGNISLLCDVLVKEVRDLTGYDRVMVYKFHEDEHGEVVSECRRSDLESYLGLHYPAIDIPQASRFLFMKNKVRMICDCLAPPVKVIQDKRLSQPLSLCGSTLRSPHGCHAQYMANMGTIASLVMSVTVNEDDDMIDGDQQQMARKLRGLVVCHHTSPRFVPFPLRYACEFLIQVFGVQINKEVELAAQVREKHILRIQTMLCDMLLRDAPVAIITQSPNVMDLVKCDGAALYYKNKFWLLGVTPTEAQIRDIAEWLLEYHSGNTGLSTDSLMEAGYPGASVLGDAVCGMAAVSITSRDFLFWFRSHTAKEIKWGGAKHDPEDKDDGRKMHPRSSFKAFLEVVKWRSLPWEDVEMDAI

SEQ ID NO: 7502 - protein, 392 aa, Ptilochaeta nudipes
DLEPVNPVDVPVTAAGALKSYKLAAKAISRLQSLPGGNISLLCDVLVKEVRDLTGYDRVMVYKFHEDEHGEVVSECRRSDLESYLGLHYPATDIPQASRFLFMKNKVRMICDCLAPPVKVIQDERLSQPLSLCGSTLRSPHGCHAQYMANMGTIASLVMSVTVNEDDDMMDGDQQQMARKLWGLVVCHHTRPRFVPFPLRYACEFLIQVFGVQINKEVELAAQVREKHILRIQTMLCDMLLRDAPVAIITQSPNVMDLVKCDGAALYYKNKFWLLGVTPTEAQIREVAEWLLEYHSGNTGLSTDSLMEAGYPGASVLGDAVCGMAAASITSRDFLLWFRSHTAKEIKWGGAKHDPEDKDDGRKMHPRSSFKAFLEVVKWRSLPWEDVEMDAI

SEQ ID NO: 7503 - protein, 466 aa, Triticum aestivum
IARRHSPAGSVRGSGSGPAGRRRGAAMEDAAEGKTNVLQGRYELGRVLGHGNFGRVHAARDLRTGRGVAVKVVAKDKVERAGMVEQIKREIAVMKMVSHPNIVELHEVLATRTKIYLALELVRGGELFARISRAGRLREDVARRYFRQLISAVDFCHGRGVYHRDLKPENLLLDEAGNLKVADFGLSALAGHARPDGLLHTACGTPAYVAPEVLGGNGYDGAKADIWSCGVILYVLLVGALPFQDENLMSMYRKMQRGGFLCPSWVSKDARKLIGRLLDPNPSSRITIASLVESPWFKKTSPIPSPLLEPVPPAAARGNGEDKDEPPEALNAFHLISLSAGFDLSPLFDQEPATGRGTRGGVMRFATREPASGVISRLEGLATGGAMRVTKSGARGGRLEGAERGRKGRLGVAAEFFSVAPSVLVVDVKKDGGDTMEYRSFCSDELRPALKDIVWAAAAAAAAFPR

SEQ ID NO: 7504 - protein, 392 aa, Ptilochaeta bahiensis
DLEPVNPADVPVTAAGALKSYKLAAKAISRLQSLPGGNISLLCDVLVKEVRDLTGYDRVMVYKFHEDEHGEVVSECRGSDLESYLGLHYPATDIPQASRFLFMKNKVRMICDCLAPPVKVIQDKRLSQPLSLCGSTLRSPHGCHAQYMANMGTIASLVMSVTVNEDDDMMDGDQQQMARKLWGLVVCHHTSPRFVPFPLRYACEFLIQVFGVQINKKVDLAAQVREKHILRIQTMLCDMLFRNAPVAIITQSPNVMDLVKCDGAALYYKNKFWLLGVTPTEAQIREIAEWLLEYHSGNTGLSTDSLMEAGYPGASVLGDAVCGMAAVSITSRDFLFWFRSHTAKEIKWGGAKHDPEDKDDGRKMHPRSSFKAFLEVVKWRSLPWEDVEMDAI

SEQ ID NO: 7505 - protein, 392 aa, Dinemandra ericoides
DLEPVNPADVPVTAAGALKSYKLAAKAISRLQSLPSGNIPLLCDVLVKEVRDLTGYDRVMVYKFHEDEHGEVVSECRRSDMESYLGLHYPATDIPQASRFLFMKNKVRMICDCLSPPVEVIQDERLPQPLSLCGSTLRSPHGCHAQYMANMGTIASLVMSVTVNEDDDMMDGDQQRMARKLWGLVVCHHTSPRFVPFPLRYACEFLIQVFGVQINKEVDLAAQVREKHILRIQTMLCDMLLRDAPVAIITQSPNVMDLVKCDGAALYYKNKFWLLGVTPTEAQIRDIAEWLLEYHRGNTGLSTDSLMEAGYPGASVLGDAVCRMAAVSITSRDFLFWFRSHTAKEIKWGGAKHDPGDKDDGRKMHPRSSFKAFLEVVKWRSLPWEDMEMDAI

SEQ ID NO: 7506 - protein, 573 aa, Arabidopsis thaliana
MKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSKRVKPEEEEERDMKKSRGFDERELFLLKMRFSN

SEQ ID NO: 7507 - protein, 392 aa, Mcvaughia bahiana
DLEPVNPADVPVTAAGALKPYKLAAKAISRLQSLPSGNISLLCDVLVKEVRDLTGYDRVMVYKFHEDEHGEVVTECRRSDLESYLDLHYPATDIPQASRFLFMKNKVRMICDCLAPPVKVIQDKRLSQPLSLCGSTLRSPHGCHAQYMANMGAVASLVMSVTINEDDDTVDGDQQQMARKLWGLVVCHHTSPRFVPFPLRYACEFLIQVFGVQITKEVELAAQVREKHILRIQTLLCDMLLRDAPVAIITQSPNVMDLVKCDGAALYYRKKFWLLGVTPTEAQIRDIAEWLLEYHSGNTGLSTDSLLEVGYPGASALGEVVCGMAAVSITSRDFLFWFRSHTAKEIKWGGAKHDPDDKDDSRKMHPRSSFKAFLEVVEWRSLPWEDVEMDAI

SEQ ID NO: 7508 - protein, 197 aa, Lycopersicon esculentum
SVLCDAEVALVVFSNRGRLYEYANNSVKATIERYKKACSDSSNTGSVSEANAQYYQQEASKLRAQIGNLMNQNRNMMGEALAGMKLKELKNLEQRIEKGISKIRSKKNELLFAEIEYMQKREVDLHNNNQYLRAKIAETERAQHQHQQMNLMPGSSSNYHELVPPPQQFDTRNYLQVNGLQTNNHYPRQDQPPIQLV

SEQ ID NO: 7509 - protein, 495 aa, Bordetella parapertussis
MAGPIIRHQYREVCMSTRKFRGFGLVAIGAVAGILLSVGVSAVAQRGSPLPLDELRQLSNVFAAIKNNYVEAVDDKTLIGNAISGMVSNLDPHSAYLDADAFREMQTATQGEFGGLGIEVGAEDGFVKVISPIEDTPAARAGIQAGDLIIKIDDTPTKGMSLNDAVKLMRGAPKSPITLTIMRADRPQPIVVKIVRDIIKVRSVRSKMLDNNVAYLRIAQFQEKTGPDLARHLKELGAKGAPKSLVLDLRNDPGGLLTSAIGVAGAFLPPDALVVSTDGRTPDSRHKYRTTPSEYARGEGNYLNDLPGWVKTVPMVVLVNVGSASASEIVAGALQDHKRAKVLGIRTFGKGSVQVILPLSESTAVKLTTSRYFTPSGRSIQATGIEPDYVVADTADGDLFRLPREADLQRHLSNQQSPDAEVKSNNDDNTEVAGKAFEFGGKDDFQLQQALNLLAGKPVQKGSARAQAKADIKPSEGKTQRITITPTGVEPAKSK

SEQ ID NO: 7510 - protein, 352 aa, Cucumis sativus
MGSGNGFYSTSEFNLDAKWLIDPKHLFVGPKIGEGAHAKVYEGKYKNQIVAIKMVGKGDTPERMARREARFAREVAMLSKVRHKNLVKFIGACKEPMMVIVTELLTGGTLRKFLLNLRPRSLELDVAIGFALDIARAMECLHSHGIIHRDLKPENLILTADHKTIKLADFGLAREESVTEMMTAETGTYRWMAPELYSTVTLKHGDKKHYNHKVDAYSFAIVLWELILNRLPFEGMSNLQPAYAAAFKNMRPSAENLPEDLALIVTSCWREDPNTRPNFSQIIQMLLQSLSRISPRSPVIPPRICASENVVMPPESPCTNSLMAVRHGSGEAPHGMIEETPTTSFFCFNKCY

SEQ ID NO: 7511 - protein, 113 aa, Candida glabrata
MSSSVPYDPYVTPEQDETNEQSQSKAAALKAEIDDTVGIMRDNINKVAERGERLTSIEDKADNLAISAQGFKRGANRVRKQMWYKDLKMKFCLFVVIICLLVAIVVPIAVHFS

SEQ ID NO: 7512 - protein, 215 aa, Papaver nudicaule
  misc_feature (36)..(36): Xaa can be any naturally occurring amino acid
  misc_feature (168)..(168): Xaa can be any naturally occurring amino acid
RHEMSMLCDAEVALIIFSNRGKLYEFCSSNSMFKTXERYQKCNYGQPEPNVSARESLEHASHQEYLKLKARVEALQRSQRNLLGEDLGPLSGKELEFLEKQLDSSLKQIRSTRTQYMLDQLTDLQRREQMLSDANKTLRRRLEEGAQASQQQWDMQHGVGYSRQQQSXHHQAADHNQGFFHPLECEPTLQIGYQQDQITVAQGAPMGSYMPGWLA

SEQ ID NO: 7513 - protein, 282 aa, Campylobacter lari
MQELINDIQKAVIEISQELRYLKDFDYTSSQNATGDNQLKLDVKSDEIITRILGQNKNIKSLISEEKQEQLLINENEKYIVAYDPLDGSSLVDVNFAIGSIFAIYENEAKAKNLKAAIYAIYGVRLELVVCFEKPMLYRLNENDEFVFVKELKLNEKGKLNACGGTQKNWSSTHGAFIKALFDEGYRLRYSGAMVSDLHQILLKGGGLFSYPATSDAPNGKLRAYFEVFPFAFIFEKANGLSTNGENDSLLDLEFEKIHASTPCFLGSKYEIEKLKQAYKGL

SEQ ID NO: 7514 - protein, 150 aa, Brassica napus
MAEEIRFFELNTGAKIPSVGLGTWQSDPGLVGNAVEAAVKIGYRHIDCAQIYGNEKEIGLVLKKLFDDGVVKREEIFITSKLWCTDHDPQDVPVALNRTLQDLQLDYVDLYLIHWPVSLKKGSTDLKPENILPTDIPNTWKAMEALFDAG

SEQ ID NO: 7515 - protein, 474 aa, Escherichia coli
MSVFPEGFLWGGALAANQSEGAFREGGKGLTTVDMIPHGEHRMAVKLGLEKRFQLRDDEFYPSHEATGFYHRYKEDIALMAEMGFKVFRTSIAWSRPFPQGDELTPNQQGIAFYRSVFEECKKYGIEPLVTLCHFDVPMQLVTEYGSWRNRKLVEFFSRYARTCFEAFDGLVKYWLTFNEINIMLHSPFSGAGLVFEEGENQDQVKYQAAHHQLVASALATKIAHEVNPQNQVGCMLAGGNFYPYSCKPEDVWAALEKDRENLFFIDVQARGAYPAYSARVFREKGVTIDKAPGDDEILKNTVDFVSFSYYASRCASAEMNTNNSSAANVVKSLRNPYLQVSDWGWGIDPLGLRITMNMMYDRYQKPLFLVENGLGAKDELAANGEINDDYRISYLREHIRAMGEAIADGIPLMGYTTWGCIDLVSASTGEMSKRYGFVFVDRDDAGNGTLTRTRKKSFWWYKKVIASNGEDLE

SEQ ID NO: 7516 - protein, 210 aa, Papaver somniferum
SVLCDAEVALIVFSTKGKLFEYSTDACMDAILERYERQCCVEEELVGTDQESQGNWSLEHAKLKAKVEVLQRTQRHMMGEDLESFNVKELQNLEHQLDTSLKHIRSKKNQLLYASISELQRKEKALQEQNTILGKKIKEKEQEMGRLDQQQQSNQAQNSCSQAQNSAQNSPTFLLSQELPSLTICTGTYEPAARPIAIQTVMPPWMLRHL

SEQ ID NO: 7517 - protein, 366 aa, Corynebacterium efficiens
MGTHDTDHPLYSSVTLGNVELNNRIVMAPLTRIRANTDGTPTEMMREYYAQRADFGMIITEGTWPIREGRTWGQQPGIETAEHVTAWRGITDAVHERGGKIIMQIMHGGRISHPELTGTGRTVAPSAIAAPDPIRISTGKVDPVIPHELGLDELATVIDQFVAGARNAMAAGMDGVQIHGANGYLLHEFLAPTTNLRGDAYGASPEKRASFVAEVVTAVAREIGAGNTGLRLSPQHNIQGAIETDDADVLATYTALARSLKHLGLAHVELVHHEPEGELIQTLRREFGAPLIVNTGFSRFTQREVAEELVDKQAADAVSVGRLALANPDLVRRWQLDGPLNEPNPETFYVGGEKGYTDYPVMEYSL

SEQ ID NO: 7518 - protein, 481 aa, Bacteroides thetaiotaomicron
MEDLNFRKGDAKTDVFGSDRMLQPSPVERIPDGPTTPEVAYQMVKDETFAQTQPRLNLATFVTTYMDDYATKLMNEAININYIDETEYPRIAVMNGKCINIVANLWNSPEKDTWKTGALAIGSSEACMLGGVAAWLRWRKKRQAQGKPFDKPNFVISTGFQVVWEKFAQLWQIEMREVPLTLEKTTLDPEEALKMCDENTICVVPIQGVTWTGLNDDVEALDKALDAYNAKTGYDIPIHVDAASGGFILPFLYPDTKWDFRLKWVLSISVSGHKFGLVYPGLGWVCWKGKEYLPEEMSFSVNYLGANITQVGLNFSRPAAQILGQYYQFIRLGFQGYKEVQYNSLQIAKYIHGEIAKMAPFVNYSENVVNPLFIWYLKPEYAKSAKWTLYDLQDKLSQHGWMVPAYTLPSKLEDYVVMRVVVRQGFSRDMADMLLGDIKNAIAELEKLDFPTPTRMAQEKNLPVEAKMFNHGGRRHKTVKK

SEQ ID NO: 7519 - protein, 95 aa, Narcissus pseudonarcissus
KQKIKEITLKLVQHGQLSETNVYNWFQNRRARSKRKQATVLPNNNEPEAEAEFDSPPSERIVKSNDNNIELSSDSKSPISPDQMSLYENMLCSPS

SEQ ID NO: 7520 - protein, 205 aa, Neurospora crassa
MSSRKKVLLKVIILGDSGVGKTSLMNQYVNKKFSASYKATIGADFLTREVLVDDRQVTMQLWDTAGQERFQSLGVAFYRGADCCVLVYDVNNSKSFDALDSWRDEFLIQASPRDPDNFPFVVLGNKIDMEESKRVISTKRAMTFCQSKGNIPYFETSAKEAINVEQAFEVIARNALMQEESEEFSGDFQDPINIHIENDRDGCAC

SEQ ID NO: 7521 - protein, 514 aa, Arabidopsis thaliana
MSGVVRSSPGSSQPPPPPPHHPPSSPVPVTSTPVIPPIRRHLAFASTKPPFHPSDDYHRFNPSSLSNNNDRSFVHGCGVVDREEDAVVVRSPIFPSEIGLEIRGCFGDFDCYLLLLSLIQKLRSVRLSSIRVNFCRLFSFAMSRKRKATMDMVVAPSNNGFTSSGFTNIPSSPCQTPRKGGRVNIKSKAKGNKSTPQTPISTNAVRSFYEISFMSRVTSLLTKKFVNLIKQAKDGMLDLNKAAETLEVQKRRIYDITNVLEGIDLIEKPFKNRILWKGVDACPGDEDADVSVLQLQAEIENLALEEQALDNQIRWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVENDESDYWLLSNAEISMTDIWKTDSGIDWDYGIADVSTPPPGMGEIAPTAVDSTPR

SEQ ID NO: 7522 - protein, 371 aa, Unknown
  Burkholderia sp. 383
MTQDPLFQPLRFGALTLPNRIVMPPMTRSRASQPGDEANELMAAYYAQRASAGLIVSEGTYVAPLGKGYAWTPGIHTPSQVAGWRKVTDAVHAAHGRIFAQLWHVGRLSHTSLLGGRQPVSSSPLQAKGVNVFVAGEDGSTPGFVQASEPRVLTIDEIREIVDQYRTAARHAIEAGFDGVELHGANGYLVNQFIDSNANTRTDAYGGSLENRLRFLREVTQALIDGTGDASRVGIRLAPLTTLNGCVDDDPETTYLAAATLLGKLGVGYLHIAEADWDDAPLMPVEFKQQLRAAYPGVLIYAGAYTAERARDAIAAGWADLIAFGRPFVANPDLPERLRTGAALAPHDRNTLFGGGERGLTDYPTLAQAAA

SEQ ID NO: 7523 - protein, 268 aa, Unknown
  Burkholderia sp. 383
MSKIPAFGLGTFRLKGQVVIDSVRNGLEVGYRAIDTAQIYGNEAEVGEAIAASGVAREDLFLTTKIWVDNYAPDKLVPSLEESLRKLRTDHVDLTLIHWPAPDNGVALDTFMTALADAKAQGLTRRIGISNFNIALTKQAIAAVGKDAIATNQIELSPYLQNRKLVEFLNAEGIHVTSYMTLAYGKVLGDPVIGAIAQRHDATPAQVALAWALQLGYSVIPSSTKRENLASNLLAQSLRLTDEDMAQIAALERNGREVDPAGLAPKWD

SEQ ID NO: 7524 - protein, 484 aa, Synechococcus elongatus
MAAPILFWHRRDLRLSDNIGLAAARAQSAQLIGLFCLDPQILQSADMAPARVAYLQGCLQELQQRYQQAGSRLLLLQGDPQHLIPQLAQQLQAEAVYWNQDIEPYGRDRDGQVAAALKTAGIRAVQLWDQLLHSPDQILSGSGNPYSVYGPFWKNWQAQPKPTPVATPTELVDLSPEQLTAIAPLLLSELPTLKQLGFDWDGGFPVEPGETAAIARLQEFCDRAIADYDPQRNFPAEAGTSGLSPALKFGAIGIRQAWRAASAAHALSRSDEARNSIRVWQQELAWREFYQHALYHFPSLADGPYRSLWQQFPWENREALFTAWTQAQTGYPIVDAAMRQLTETGWMHNRCWMIVASFLTKDLIIDWRRGEQFFMQHLVDGDLAANNGGWQWSASSGMDPKPLRIFNPASQAKKFDATATYIKRWLPELRHVHPKDLISGEITPIGRRGYPAPIVNHNLRQKQFKALYNQLKAAIAEPEAEPDS

SEQ ID NO: 7525 - protein, 231 aa, Brassica napus
  misc_feature (106)..(106): Xaa can be any naturally occurring amino acid
MGRGKIEIKRIENSTNRQVTFCKRRNGLLKKAYELSVLCDAEVALIVFSTRGRLYEYANNNIRSTIERYKKASDNTNTHSVQEINAAYYQQESAKLRQQIQTIQNXSNRHLMGDSLSALSVKELKQVENRLEKAISRIRSKKHELLLAEIENLHKREIKLDNESIYLRTKIAEVERFQQHHHQMVSGTEMTAIEALASRNYFAHNIMTIGSGSGAGHGCSYFDPDKKTHLG

SEQ ID NO: 7526 - protein, 392 aa, Burdachia sphaerocarpa
DLEPVNPADVPVTAAGALKSYKLAAKAISRLQSLPSGNISLLCDVLVKEVRDLTGYDRVMVYKFHDDEHGEVVSECRRSDMESYLGLHYPATDIPQASRFLFMKNKVRMICDCLAPPVKVIQDERLPQPLSLCGSTLRSPHGCHAQYMVNMGAIASLIMSVTINEDDDTIDGDEQQMARKLWGLVVCHHTSPRFVPFPLRYACEFLIQVFGVQITKEVELAAQVREKHILRIQTLLCDMLLRDAPVAIITQSPNVMDLVKCDGAALYYKKKFWLLGVTPTEAQIRDIAEWPVEYHSGNTGLSTDSLMEAGYSGASSLGDAVCGMAAVSITSRDFLFWFRSHTAKEIKWGGAKHDPADKDDGRKLHPRSSFKAFLEVVKWRSLPWEDMEMDAI

SEQ ID NO: 7527 - protein, 392 aa, Glandonia macrocarpa
DLEPVNPADVPVTAAGALKSYKLAAKAISRLQSLPSGNISLLCDVLVKEVRDLTGYDRVMVYKFHEDEHGEVVSECHRSDLESYLGLHYPATDIPQASRFLFMKNKVRMICDCLAPPVKVIQDERLPQPLSLCGSTLRSPHGCHAQYMANMGAIASLVMSVTINEDDDMIDGDEQQMARKLWGLVVCHHTSPRFVPFPLRYACEFLIQVFGVQITKEVELAAQVREKHIFRIQTLLCDMLLRDAPVAIITQSPNVLDLVKCDGAALYYKKKFWLLGITPTEAQIRDIAEWLLEYHSGNTGLSTDSLMEAGYPGASSLGDAVCGMAAVSITSRDFLFWFRSHTAKEIRWGGAKHDPDDKDDGRKMHPRSSFKAFLEVVKWRSLPWEDVEMDAI

SEQ ID NO: 7528 - protein, 392 aa, Barnebya dispar
DLEPVNPADVPVTAAGALKSYKFAAKAISRLQSLPSGNIFLLCDVLVKEVRDLTGYDRVMVYKFHEDEHGEVVSECRRSDLESYLGLHYPATDIPQVSRFLFMKNKLRMICDCLAPPVKVIQDENLPQPLSLCGSTLRSPHGCHAQYMTNMGTIASLVMSVTINEDDDMKDCEQPQMPRKLWGLVVCHHTSPRFIPFPLRYACEFLIQVFGVQINKEVELAAQVREKHILRIQTLLCDMLLRDAPVAIITQSPNVMDLVRCDGAALYYKNEFWLLGVTPTEAQIRDIAEWLLECHSGNTGLSTDSLMEAGYPGASVLGDAVCGMAAISITSRDFLFWFRSHTAKEIKWGGAKHDPDDKDDGRKMHPRSSFKAFLEVVKWRSLPWEDIEMDAI

SEQ ID NO: 7529 - protein, 359 aa, Fagus sylvatica
MDKYEVVKDLGAGNFGVARLLRHKETKELVAMKYIERGLKIDENVAREIINHRSLRHPNIIRFKEVVLTPTHLAIVMEYAAGGELFERICTAGKFSEDEARYFFQQLISGVNYCHSMQICHRDLKLENTLLDGSPAPRLKICDFGYSKSSLLHSRPKSTVGTPAYIAPEVLSRREYDGKLADVWSCGVTLYVMLVGAYPFEDQDDPRNFRKTIQKIMAVQYKVPDYVHISQDCKHLFSRLFVANPSRRITLKEIKNHPWFLKNLPRELTESSQAIYYQRDNPSFSLQSVDEIMKIVGEARNPPPSSKIVRGFSWGPDENEEGNEDIDAEVEEEEEEEDEEDEYDKRVKEVHASGEFHIS

SEQ ID NO: 7530 - protein, 692 aa, Saccharomyces cerevisiae
MGNSSSKSSKKDSHSNSSSRNPRPQVSRTETSHSVKSAKSNKSSRSRRSLPSSSTTNTNSNVPDPSTPSKPNLEVNHQRHSSHTNRYHFPSSSHSHSNSQNELLTTPSSSSTKRPSTSRRSSYNTKAAADLPPSMIQMEPKSPILKTNNSSTHVSKHKSSYSSTYYENALTDDDNDDKDNDISHTKRFSRSSNSRPSSIRSGSVSRRKSDVTHEEPNNGSYSSNNQENYLVQALTRSNSHASSLHSRKSSFGSDGNTAYSTPLNSPGLSKLTDHSGEYFTSNSTSSLNHHSSRDIYPSKHISNDDDIENSSQLSNIHASMENVNDKNNNITDSKKDPNEGFNDIMQSSGNKNAPKKFKKPIDIDETIQKLLDAGYAAKRTKNVCLKNNEILQICIKAREIFLSQPSLLELSPPVKIVGDVHGQYGDLLRLFTKCGFPPSSNYLFLGDYVDRGKQSLETILLLFCYKIKYPENFFLLRGNHECANVTRVYGFYDECKRRCNIKIWKTFIDTFNTLPLAAIVAGKIFCVHGGLSPVLNSMDEIRHVVRPTDVPDFGLINDLLWSDPTDSPNEWEDNERGVSYCYNKVAINKFLNKFGFDLVCRAHMVVEDGYEFFNDRSLVTVFSAPNYCGEFDNWGAVMSVSEGLLCSFELLDPLDSAALKQVMKKGRQERKLANQQQQMMETSITNDNESQQ

SEQ ID NO: 7531 - protein, 477 aa, Prosthecochloris aestuarii
MKRKTVICWFRQDLRLEDNPALFVAAEEGYVLPVYILDDSSPGTWQMGSATRCWLHHSLVSLNRSFDGKLGIFRGEPLEILKTLARQHKAEKIVWNRCYEPWRMKRDQGIKATLQAEGIEVSSFNGSLLWEPHEVLKQNNTPYRVFTPFFRRGCLNALPPRTPLPAPQRMLMADTIDNSISVQDLNLLPSIPWDSQLISHWSVGENSARQSLLRFLDQGLNGYKEGRDFPGQNHVSRLSPALHFGELSPNTVWYEAKRCGSGQDLDHFLSELGWREFAYTLLYHNHDMPEKNLQSAFDAFPWVHNDETLIRWQQGMTGYPLVDAGMRELWQTGYMHNRVRMITGSFLVKNLLLHWHYGQQWFHDCLLDADLANNSAGWQWIAGCGVDAAPYFRVFNPVRQGEKFDPDGTYTLRFVPELAKLPKKYLFNPWEAPKNILQEAGITLGKTYPEPIVDLAISRNRALSAYASIRKKKIQEK

SEQ ID NO: 7532 - protein, 392 aa, Spachea correae
DLEPVNPADVPVSAAGALKSYKLAARAISRLQSLPSGNISLLCDVLVKEVRDLTGYDRVMVYKFHEDEHGEVVSECRRPDLEAYLGLHYPATDIPQASRFLFMKNKVRMICDCLAPPVKVIQDEKLPQSLSLCGSTLRSPHGCHAQYMANMGSIASLVMSVTVNEDDDMVDGDQQRMARKLWGLVVCHHTSPRFVPFPLRYACEFLIQVFGVQINKEVELAAQGREKHIMQTQTLLCDMLLRDAPVAIVTQSPNVMDLVKCDGAALYYRKKFWLLGVTPTEAQIRDIAEWLLEYHSGNTGLSTDSLMEAGYPGTSVLGNAVCGMAAVKITSRDFLFWFRSHTAKEIKWGGAKHDPDDKDDIRKMHPRSSFKAFLEVVKWRSLPWEDMEMDAI

SEQ ID NO: 7533 - protein, 392 aa, Tricomaria usillo
DLEPVNPADVPVTAAGALKSYKLASKAISRLQSLPSGNMSLLCDVLVKEVRDLTGYDRVMVYKFHEDEHGEVVSECRRSDLESYLGLHYPATDVPQASRFLFMKNKVRMICDCLAPPVKVIQDERLPQPLSLGGSTLRSPHGCHSQYMTNMGTIASLVMSVTINEEDERMDGDQQQMTTKLWGLVVCHHTSPRFVPFPLRYACEFLIQVFGVQIDKEVELVAQVREKHILQIQTMLCGMLLRDAPVAIVTQSPNVMDLVKCDGAALYFKSKTWLRGVTPTEEQIKDIAEWLLKYHSGNTGLSTDSLMEAGYPGASVLGDAVCGMAAVGITSRDFLFWFRSHTAKEINWGGAKHDPDDKDDGRKMHPRSSFKAFLEVVKWRSMPWEDMEMDAI

SEQ ID NO: 7534 - protein, 240 aa, Papaver somniferum
VQLRRMENKINRQVTFSKRRSGLLRPCAEMSVLCDAEVALIVFSTKGKLFEYSTDSGMDRILERYERYSYAERELVTTEIDQGNWSLEYSKLKSKIEILQKNQRHFMGEDLQSMSLKELQNLEQQLDVALKQIRSRKNQLMYESISELQKKEKALQEQNNKLGKQLKEKEKEVAAQQQQASQFSQGQSSPSFLLSQSLPSLNIGSGSYQARGGDNGNEEGNRTQTTRTNTATLMPPWMLN

SEQ ID NO: 7535 - protein, 497 aa, Glycine max
  misc_feature (31)..(31): Xaa can be any naturally occurring amino acid
IEFKDKVKNVGASLVKQVANATNDVAGDEYXGREHFNCLAGTTCATVLTRAIFTEGCKSIAAGMNAMDLRRGISMAVDAVVTNLKSRARMISTSEEIAQVGMISANGEREIGELIAKAMEKVGKEGVITISDGKTLYNELEVVEGMKLDRGYISPYFITNDKNQKCELEDPLILIHEKKISSINAIVKVLELALKRQRPLLIIAEDVESDALATLILNKLRAGIKVCAIKAPGFGENRKAGLQDLAVLTGGALITEELGLKLEKVDLDMLGTCKKITVSKDDTVILDGAGDKKALEERCEQIRSAIENSTSDYDKEKLQERLAKLSGGVAVLKIGGASEAEVGEKKDRVTDALNATKAAVEEGIVPGGGVALLYASRELDKLQTANFGQKIGVQIIQNALKTPVLTIASNAGVEGAVVVGKLLEQENHDLGYDAAKGEYVDMVKAGIIDPLKVIRTALVDAASVSSLMTTTEAVVSELPNDNKDTPAMAGGMGGMGY

SEQ ID NO: 7536 - protein, 209 aa, Ranunculus bulbosus
  misc_feature (24)..(24): Xaa can be any naturally occurring amino acid
  misc_feature (65)..(65): Xaa can be any naturally occurring amino acid
  misc_feature (67)..(67): Xaa can be any naturally occurring amino acid
  misc_feature (89)..(89): Xaa can be any naturally occurring amino acid
  misc_feature (136)..(136): Xaa can be any naturally occurring amino acid
  misc_feature (185)..(185): Xaa can be any naturally occurring amino acid
  misc_feature (191)..(191): Xaa can be any naturally occurring amino acid
AHEISVLCDADVALVIFSIKGKLXEYSTNDRMEGILERYERYSYTSTELVAADPESQECLSMEYXKXKSKVEALQRSQRYFMGEDIGSXGVKELQALEQQLDTSLRQIRSRKNQLMAGSITELQKNEKALLEENIXLKKQAKEKELALSLCEQLNPVERSPYVPLPDAVPALNTSEPTNQSSGSXGEEEVXAQPSQTKTLMPPWMLHHL

SEQ ID NO: 7537 - protein, 321 aa, Phaeosphaeria nodorum
MATDPSKYKLNHSMIRIKDPKRSVQFYEFLGMKLINQIKMPEAKFDLYFLAYDSPKAVSHGNHWTDREGIVELTHNYGTEDDPDYKISNGNTEPHKGFGHLCVSVDNIQAACQRLEDAGYKFQKKLTDGRMRHIAFVLDPDGYWVEVIGQKPLEETESVKDTDTSTYRMNHTMIRVKDKDVSLKFYQDVLGMQLKRTSESPNSGFNLYFLGYGAPASDETANGVNPTADHEGLLELTWNYGTEKEADFKYHNGNDEPQGFGHICIAVDDLEAACARFEEKKVNWKKRLTDGRMKSIAFVLDPDNYWIEVVQNEKLKTRSNV

SEQ ID NO: 7538 - protein, 216 aa, Ranunculus bulbosus
  misc_feature (214)..(214): Xaa can be any naturally occurring amino acid
GLVKKAHEISVLCDAEVALIVFSTKGKLFEYSTDSGMDKILERYERYSYAERELVTNDTDSQGNWSLEYTKLKAKVEILQKNQRHFRGEEIGNLGLKELQNLEQQLDTALKLIRARKNQLLFESISEYQKKEKALNEQNNQLEKQLKEKEKELAKRPQWEQPPNQGQTSQSFTLQSHPCLNIGGNYQGGSSGREDEVPQTQARPTILMPPWMVXHL

SEQ ID NO: 7539 - protein, 161 aa, Glycine max
MSLIPNFFGGRRSNVFDPFSLDVWDPFKDFPFPNTLSSASFPEFSRENSAFVSTRVDWKETPEAHVFKADIPGLKKEEVKVQIEDDKVLQISGERNVEKEDRNNTWHRVERSSGKFMRRFRLPENAKVDKVKASMENGVLTVTVPKEEVKKADVKNIQISG

SEQ ID NO: 7540 - protein, 306 aa, Triticum aestivum
  misc_feature (35)..(35): Xaa can be any naturally occurring amino acid
  misc_feature (38)..(38): Xaa can be any naturally occurring amino acid
  misc_feature (103)..(103): Xaa can be any naturally occurring amino acid
  misc_feature (110)..(110): Xaa can be any naturally occurring amino acid
  misc_feature (120)..(120): Xaa can be any naturally occurring amino acid
  misc_feature (128)..(128): Xaa can be any naturally occurring amino acid
  misc_feature (224)..(224): Xaa can be any naturally occurring amino acid
RGRVGRQSVAEARSKGITVRAMGITPPGTPTWSNXKVXQNLKGPFGPSANTGNLGSGFADEGYATGMFTQVGRPFYKSQERLCLTMGPPSKAGRFRRFSFHTXPKGYWGXECGQPGGYFXELTNIPPXKTVDQIYKVASIALSPNVPGQIFMGLMVNPPKPGDISYLKYSAESKSILESLRRRAQIMTDGFNSCRNVVCNFTEGAMYSFPQIRLPQRAMDVAKXAGKAPDVYYCLKLLEATGISTVPGSGFGQKEGVFHLRTTILPAEEDMPAIMSSFKKFGDSFMEQYPPPPEAVKREEDNRIYI

SEQ ID NO: 7541 - protein, 76 aa, Brassica napus
  misc_feature (3)..(3): Xaa can be any naturally occurring amino acid
  misc_feature (8)..(8): Xaa can be any naturally occurring amino acid
RRXRTEEXPAIANDFRVAARKAKEAGSDGVEVHGAHGDLIDQVLKDKGNDRSDQNGGALENRWRFAVEGVKAAGKE

SEQ ID NO: 7542 - protein, 439 aa, Wolinella succinogenes
MSKTKYALTGFGATVLSLSLLFSSSFAQSPSESQSRLEAYNKLRKVIGTVENYYVDEVTINEIINKAIDGLLSNLDAHSSYLNEKKYEELKVQTDGEFGGVGITISMKDGALTIISPIEDTPGDKAGLKSGDIILKIDDKSTLNMTIDDAINLMRGKPKTKVKLTIVRKNEPKPFVVDIIRDVIKVESVYAKRIENSEMLYVRVTSFDKKVGKRVAEELKKASWAKGVVLDLRNNPGGLLNQAVELTDLFINEGVIVSQKGRISSEDAEFKASKNSPFAQIPLAVLINNGSASASEIVAGALQDHKRAILVGENTFGKGSVQVVLPLDKNEGLRLTIARYYLPSGRTIQALGITPDLIVHPGVAPREKKDDFSIKESELKQHLENELEKIGDKKEVKKEVKSDEDNKSVISEENLWNDIQLKSAMDALKTWSIINPAKK

SEQ ID NO: 7543 - protein, 448 aa, Rhodobacter sphaeroides
MRKYMMAALGGTVAGVLLATQVAGPLIAQEQQRSKSVYEQLDLFGDIFERIRAQYVEEVETDKLIEAAINGMLTSLDPHSSYLPPDDFDDMQVQTRGEFGGLGIEVTQEEGFVKVVSPMDGTPADAAGIQSGDFITHVNGESVLGLTLDQAVDMMRGPVGSEILITVVREGTPEPFDVSIVRDTIKLVAARSRVVGNTVVVRLTTFNDQTFSGLKEGLEKEIKALGGEDKINGVVLDLRNNPGGLLTQAIQVSDAFLDKGEIVSTRGRAAGDGERFNATPGDLIDGKPMVVLINGGSASASEIVAGALQDHRRAIVVGTKSFGKGSVQTVIPLRGEGAMRLTTARYYTPSGRSIQALGVAPDIVVNQPPAKPAVPEEEESPATSAARNRSEADLRGVLSNDSMTEDEKKQLEADRARAEESAKLRDEDYQLAYAVDILKGLSAIEVKP

SEQ ID NO: 7544 - protein, 743 aa, Xanthomonas campestris
MSERQGGQEQRTEADGMTTEGISETSQTLQALANGLPADAFAVLGPKPLAEGRRQVRVLAPGAEAMGLIDPRGKLLARMQASAIDGVFEGILAADGPYRLRIVWPDRVQEVEDPYAFAATLDESLLLQIAAGDGQAVRRALGAQHVHCGDVPGVRFAVWAPHAQRVAVVGDFNGWDVRRHPMRQRIGGFWELFLPRVEAGARYKYAVTAADGRVLLKADPVARQTELPPATASVVPSAAAFAWTDAAWMANRDPGAVPAPLSIYEVHAASWRRDGHNQPLDWPTLAEQLIPYVQQLGFTHIELLPITEHPFGGSWGYQPLGLYAPTARHGSPDGFAQFVDACHRAGIGVILDWVSAHFPDDAHGLAQFDGAALYEHADPREGMHRDWNTLIYNYGRPEVTAYLLGSALEWIEHYHLDGLRVDAVASMLYRDYGRAEGEWVPNAHGGRENLEAVAFLRQLNREIATQFPGVLTIAEESTAWPGVTAAISDGGLGFTHKWNMGWMHDTLGYMQRDPAERAQHHSQLTFGLVYAFDERFVLPLSHDEVVHGTGGLLGQMPGDDWRRFANLRAYLALMWAHPGDKLLFMGAEFGQWADWNHDQSLDWHLLDGARHRGMQQLVGDLNAALRRTPALYRGSHRADGFDWSVADDARNSVLAFVRHDPAGGAPLLAVSNLTPQPHHDYHVGVPRAGLWREILNTDSAHYGGSNLGNSGRLATEPVGMHGHAQRLRLTLPPLATIYLQAEK

SEQ ID NO: 7545 - protein, 164 aa, Zea mays
MADDGGSHEGSGGGGGVREQDRFPPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 7546 - protein, 585 aa, Xanthomonas campestris
MNQRNAITPSWGAWPAGEGQVRFALWAPAAKSVDVVFDDSARCALQAGQDGFFSAVIDCAANARYRYSVDGAEPVPDPASRWQPEGVHGPSAVQPTDGYAWQNAQWQGRPWDEAVIYEVHVGTCGGYAGVQAQLPQLAAMGITTIELMPLSAFPGAHNWGYDGVLPYAPVEAYGTPDELKALIDAAHGHGLMVLLDVVYNHFGPDGNYLHSYAAPFFNEDKPTPWGAAIDFRKPPVQRYFLDNALMWLHEYGFDGLRLDAVHAISPNAFLDTLRETVEASLPAGRHVHLVLENEANQASQLQRGYTAQWDDDFHNALHVLLTGEEEGYYAAFADKPTEHLARVLGEGFAYQGEPDPRGHVRGEPSGALPPHKFVVFAQNHDQIGNRARGERLSVLVSPQRLRAALALTALTPMIPLFFMGEPWGAKQPFLFFTDFGPPLDDAVREGRRKEFAHFAAFADEAQRATIPDPNSHTTFAASRAPIADAAHGDGAQWASWFTALLDVRRRWLVPGLAQARAVRASVLADGAVAATWELPGGLWHIAFNVGTQPVPLPPLRGRVAHVENVAADARELPVDGFIAWHEAQA

SEQ ID NO: 7547 - protein, 321 aa, Lyngbya majuscula
MSMPMDVSKKSFKPAKTQKSKTISNDYIKGLQTKHFLLYNVIPTIGTITAIALLWWYPISSVEIGLLIGMWALSMIGMSVGLHRYFAHRAFKTSQTMSVILAILGCMGAQGPVVSWVAVHRRHHEYSDLPGDPHSPNPELLGEGIFGTLRGLWHAHVGWLTNHEYPNPMYYAPELMRDKTISKINRNYVVWIVLGLLIPTILGGIIHGSWIGAVEGLLWGGFVRMFVVDNSILSINSFSHAFGTHPFDSKDQSRNNIWVAIPTFGESWQNNHHTFENSAAIGLKWWQIDLGYCLIWGLEKLGLVWDVKLPTAKMIEAKKLA

SEQ ID NO: 7548 - protein, 1081 aa, Candida albicans
MNPTKKPRLSPMQPSVFEILNDPELYSQHCHSLRETLLDHFNHQATLIDTYEHELEKSKNANKAFQQALSEIGTVVISVAMGDLSKKVEIHTVENDPEILKVKITINTMMDQLQTFANEVTKVATEVANGELGGQAKNDGSVGIWRSLTDNVNIMALNLTNQVREIADVTRAVAKGDLSRKINVHAQGEILQLQRTINTMVDQLRTFAFEVSKVARDVGVLGILGGQALIENVEGIWEELTDNVNAMALNLTTQVRNIANVTTAVAKGDLSKKVTADCKGEILDLKLTINQMVDRLQNFALAVTTLSREVGTLGILGGQANVQDVEGAWKQVTENVNLMATNLTNQVRSIATVTTAVAHGDLSQKIDVHAQGEILQLKNTINKMVDSLQLFASEVSKVAQDVGINGKLGIQAQVSDVDGLWKEITSNVNTMASNLTSQVRAFAQITAAATDGDFTRFITVEASGEMDALKTKINQMVFNLRESLQRNTAAREAAELANSAKSEFLANMSHEIRTPLNGIIGMTQLSLDTELTQYQREMLSIVHNLANSLLTIIDDILDISKIEANRMTVEQIDFSLRGTVFGALKTLAVKAIEKNLDLTYQCDSSFPDNLIGDSFRLRQVILNLAGNAIKFTKEGKVSVSVKKSDKMVLDSKLLLEVCVSDTGIGIEKDKLGLIFDTFCQADGSTTRKFGGTGLGLSISKQLIHLMGGEIWVTSEYGSGSNFYFTVCVSPSNIRYTRQTEQLLPFSSHYVLFVSTEHTQEELDVLRDGIIELGLIPIIVRNIEDATLTEPVKYDIIMIDSIEIAKKLRLLSEVKYIPLVLVHHSIPQLNMRVCIDLGISSYANTPCSITDLASAIIPALESRSISQNSDESVRYKILLAEDNLVNQKLAVRILEKQGHSVEVVENGLEAYEAIKRNKYDVVLMDVQMPVMGGFEATEKIRQWEKKSNPIDSLTFRTPIIALTAHAMLGDREKSLAKGMDDYVSKPLKPKLLMQTINKCIHNINQLKELSRNSRGSDFAKKMTRNTPGSTTRQGSDEGSVEDMIGDTPRQGTVEGGGTSSRPVQRRSATEGSITTISEQIDR

SEQ ID NO: 7549 - protein, 254 aa, Novosphingobium aromaticivorans
MTLEIHQFPCLSDNYGFLVHDSDSGETACIDTPDAEAYLREANARGWRITQIWNTHWHPDHAGGNEAIKAATGCTVVAPEDDAGKIAGVDRAVAHGDTVQLGSFTAEVIDVGGHTMGHCAYHLPEASVAFVGDALFPLGCGRMFEGTPPQFWASLSRIKALPPGTTLYSAHEYTQSNARFALHADPDNAALRAYADGVEARRARGEWTVPTTLAAELAANPFLRADTPGMAARWGGSSPVDTFAALRAAKDTFR

SEQ ID NO: 7550 - protein, 369 aa, Yersinia pseudotuberculosis
MDKLFTPFKVGDTELVNRVVMAPMTRSRATVGDTADELTAKYYQQRASAGLIITEGSQISVQGQGYLFTPGIYNDAQVKGWERVTNAVHNAGGKIYIQLWHVGRISHTGLQNDGQAPVSSVAVKAKNSTCYARDENGQPGLVPVSEPRALSVSEIKDVVQDYVQAAENAIRAGFDGVEIHAANGYLLEQFINGGLNTRQDEYGGADPENRLRFVLEVTDAISQAIGAGKTGIRLAPFGRLFDMHPFEGEEETWLLLAKELSTRSLSYVHLSDQQTLGEQAIPAGFIEKFRAAYDGPLIIAGGFDKQRAEQYLQQGKADLIGFGRPYIANPDLVERMVNDWPLNQVDRATMYGGDEKGYTDYPVWSDTQA

SEQ ID NO: 7551 - protein, 343 aa, Saccharomyces cerevisiae
MSSSVASTENIVENMLHPKTTEIYFSLNNGVRIPALGLGTANPHEKLAETKQAVKLQSKLDNRHIDTAWASREPFVGEAIKELLEDGSIKREDLFITTKVWPVLWDEVDRSLNESLKALGLEYVDLLLQHWPLCFEKIKDPKGISGLVKTPVDDSGKTMYAADGDYLETYKQLEKIYLDPNDHRVRAIGVSNFSIEYLERLIKECRVKPTVNQVETHPHLPQMELRKFCFMHDILLTAYSPLGSHGAPNLKIPLVKKLAEKYNVTGNDLLISYHIRQGTIVIPRSLNPVRISSSIEFASLTKDELQELNDFGEKYPVRFIDEPFAAILPEFTGNGPNLDNLKY

SEQ ID NO: 7552 - protein, 392 aa, Tetrapterys discolor
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNDDDDMMDGDQQQMTRKLWGLVVCHHTSPRFVPFPLRYACEFLIQVFGVQINKEVELTAQVREKHILQIQTMLCDMLLRDAPVAIITQSPNVMDLVKCDGAALYFKKKTWLLGVTPMEEQVRDIAEWLLEYHSGNTGLSTDSLMEAGYPGASDLGDAVCGMAAVSITSRDFLFWFRSHTAKEIKWGGAKHDPDDKDDGRKMHPRSSFKAFLEVVKWRSVPWEDVEMDAI

SEQ ID NO: 7553 - protein, 56 aa, Zea mays
  misc_feature (41)..(41): Xaa can be any naturally occurring amino acid
VKYVFRHAQPKRPKSLRIYETHVGMSSPEPKINTYVNFRDXVLPRIKKLGYNAVQI

SEQ ID NO: 7554 - protein, 392 aa, Stigmaphyllon sagraeanum
DLEPVNPADVPVTAAGALKSYKLAAKAISRLQSLPSGNISLLCDVLVKEVRDLTGYDRVMVYKFHEDEHGEVVSECRRSDLESYLDLHYPATDIPQASRFLFMKNKIRMICDCMAPPVKVIQDETLPQPLSLCGSTLRSPHGCHAQYMTNMGTIASLVMSVTINEDDDTMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDMAQWLLEHHSGNTGLSTDSLMEAGYPGASALGDAVCGMAAVSITSRDFLFWFRSHTAKEVKWGGAKHDPDDKDDLRKMHPRSSFKAFLEVVKWRSMPWEDIEMDAI

SEQ ID NO: 7555 - protein, 743 aa, Bradyrhizobium japonicum
MAMGRTFRIKVRMRRFRRQHPRIAFAIRSFMIFSATFGGAYGFVSGSRSENSGYDPHTFAIGASFLFALACLGLATLSMRLRFVNKRLRKLAAHNEALIDRNWELKEAEERARSLFEQQGDLIVLRDHQNRITFANDAYCALAGQARGALVGTRFDFDVLEQGDSARESSGTRVHDQKIATPLGARWIAWREGYVRLDAGQPAELQSVGRDVTDRTETERALSDARDQADAANRAKSRFLAMASHEIRTPLNGIIGMGGLLLDTTLTPEQATYAKAVKTSGEALMALIEELLDYSKIEAGKLDLEQRPFALSTLIEEITELLAPRAQAKTLEIAAYVDERLPLEVVGDAARLRQVLLNLAGNAIKFTASGGVALIVEPGIRPNEISFLVRDTGIGIAAEAQQRIFREFEQADERVARTYGGTGLGLAISERIVKRMGGRITLASEPGKGSTFEVAVPLAPSEARAGQTAFPSPDLTGKSILLIAEGIEASLIARRLERWGSQTCLVTDATVAEALLPERSWHAVLVDRAIGPAIADRLGGVARAHAPQRLVLLTSSSRHEKQSAAFTGFLVKPLRAASLAARLALTPEVASPELAPEPPVEATSAAPARGLSVLVAEDNEINALLMRSLLTKLGHRVVIAVHGEAALESWLAASSAGTPYDLVLMDIQMPQLDGIEATKRIRAHEAATGGHHTPILALTANTLVEDRYACFEAGMNGFLIKPLDRDKLDEALAGLAASRQLAG

SEQ ID NO: 7556 - protein, 392 aa, Lophopterys floribunda
DLEPVNPADVPVTAAGALKSYKLAAKAISRLQSLPSGNISLLCDVLVKEVRDLTGYDRVMVYKFHEDEHGEVVSECRKSDLESYLGLHYPATDIPQASRFLFIKNKVRMICDCLAPPVKVIQDERLPQPLSLCGSTLRSPHGCHAQYMTNMGTIASLVMSVTINEDDDTMDGDQQQTTRKLWGLVVCHHTNPRFVPFPLRYACEFLIQVFGVQINKEVELAAQVREKHILQIQTMLCDMLLRDAPVAIITQSPNVMDLVKCDGAALYFKNKIWLLGVTPTEEQIRDIAEWLLEYHSGNTGLSTDSLMEAGYPGASVLGDAVCGMAAVSITSRDFLFWFRSHTAKEIKWGGAKHDPDDKDDGRKMHPRSSFKAFLEVVKWRSMPWEDVEMDAI

SEQ ID NO: 7557 - protein, 392 aa, Mionandra camareoides
DLEPVNPADVPVTAAGALKSYKLAAKAISRLQSLPSGNISLLCDVLVKEVRDLTGYDRVMAYKFHEDEHGEVVSECRRSDLESYLGLHYPATDIPQASRFLFMKNKVRMICDCLAPPVKVIQDERLPQPLSLCGSTLRSPHGCHAQYMTNMGTIASLGMSVTVNEDDDTMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLKYHCGNTGLSTDSLMEAGYPGASALGDAVCGMAAVSITSRDFLFWFRSHTAKEIKWGGAKHDPDDKDDLRKMHPGSSFKAFLEVVKWRSMPWKDVEMDAI

SEQ ID NO: 7558 - protein, 392 aa, Aspicarpa brevipes
DLEPVNPADVHVTAAGALKSYKLAAKAISRLQSLPSGNVSLLCDVLVKEVRDLTGYDRVMMYKFHEDEHGEVVSECRRSDLESYLGLHYPATDIPQASKFLFIKNKVRMICDCLAPSVKVIQDERLTQPLSLCGSTLRSPHGCHAQYMTNMGAIASLVMAVTVNEDEDTMDGDQQHMTRKLWGLVVCHHTSPRFVPFPLRYACEFLIQVFGVQVTKEVELAAQVREKHSLQIQTMLCDMLLRDALVAIITQSPNVMDLVKCDGAALYFKNKTWFLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSTPWEDIEMDAI

SEQ ID NO: 7559 - protein, 207 aa, Ranunculus bulbosus
RHEMSGVCDAEVALIVFSTKGKLFEYSTDSGMDKILERYERYSYAERKLGASDTDSQGNWSLEYTKLKAKVEILQKNQRHFRGEDIANMSLKELQNLEQQLDSALKLIRARKNQLTYESISDLQKKEKVLQEQNNQLEKQLKEKEKELAKREQWEQPNQGQTSRSFTPQSPSSLNIGGSYQGNNGGEGFQTQNRPTILMPPWMLSHL

SEQ ID NO: 7560 - protein, 390 aa, Glycine max
MALLTSQPKNPILHRFTTLHCPLPRLHRTVLGLGSFSHNSALSTKKLNFNPTQTKISLQNNPFTYNLAVTAKANANAAFGEGFKEEGASKHRKILLSEVEVKRERRVFFGRKWNSLDFGTAGIVLAMHLLCVFAPFHFNWPAFWVAVALYIVTGLFGITLSFHRNLSHRSFKLPKWLEYFFAYCGVLALQGNPIDWVSTHRYHHQFCDSERDPHSPTEGFWFSHMSWLFDTNSVLERCGEANNVGDLEKQSFYRFLRSTYLAHPFALGALLYAAGGFPFLVWGMGVRIVWVYHITWFVNSACHVWGNQAWNTRDLSRNNWWVALLAFGECWHNNHHAFEYSARHGLEWWQIDMTWYVVRFLQAIGLATDVKLPTESQKQKMAFNSDSIAT

SEQ ID NO: 7561 - protein, 610 aa, Pseudomonas aeruginosa
MCGITGWTDWSRDLGEQRSILERMTRTLAPRGPDAEGLWLSRHALLGHRRLAIIDLENGAQPMLAEAGGRVALTYSGEVYNFRELRAELETLGQVFRTRSDTEVVLRAYLQWGEASFVRLRGIYGFALWDEREQSLWLVRDRFGVKPLYYYPTAGGVLFASEPKAIFANPEANPVLDASGIAELFALTTAPTPGHGLYKGLRQVRPGQALRFDRNGVRELVYWALRAERHEEGAEDSAERAGQLLREAVAEQLVADVPLGSLLSGGLDSSAISAFAVAALDGDARRLPTFSVDFPGEGRGFVPTPWQSSWDEPYAQLAANFLGTPHRTVLVAPEEVLEQDEAVLQARDLPGWGELDASLYLLFRQVREHTTVALSGESADEVFGGYPFFHDPSALAHDGFPWLAGKSGPWQLLRREVAERVAAPEYIRARYREALAEVPRLDGEDAAQRRQREVAYLALSRWLPAMLERKDRMSMAVGLEVRVPFCDHRLVEYVWNLPWALKSVAGESKSLLRRALRGHLPQAILERRKSGFPANPDPRYLALLRERVGRLLDDGRSPLFELVDAGRVRQALEQGTPLPSPRASASPTAGLAYLLNLDRWLTRHGVDISL

SEQ ID NO: 7562 - protein, 215 aa, Ranunculus bulbosus
ALRHEMSVLCDAEVGLIIFSARGKLYEFASAGGMSRTLERYHKNSFSNQDSNLAIDRETQSWYQEVSKLKAKYESLQRSQRHLLGEDLGPLNVKELQNLEKQLEGALAQARSRKTQIMLEQMEALRRKERELGDMNKQLKNKYQLEAEGQGSLRAMQGSWESNALNNYSGHPSHSSSMDCEPTLQIGYHQYVSADGGPIQRNNAGENNFIQGWEL

SEQ ID NO: 7563 - protein, 584 aa, Symbiobacterium thermophilum
MWHEWCMSPWSLRAPKGQASRFMGKHVAEPYDLTMNTTAPGGEPVHTSIATKFMIGVTAALVTVLGVNLGLDIRQQRAQAEEDLREQARMVATQVIAMREFIARNQDRINRDSHGHFEFKYLNPAAVGRGVGQIFAEMSDYQYKQTRLQVRMAENMPDAFEVEALRRFASNPDLAEVVGYTGSGQDRVFRYMVPLKMEASCLPCHGPPAGEPDIAGYPKEGLQVGELAGALSITIPTERFEARLTQSTRSRATVIVLATGLSLALIGFLNHQLVARPLAALAGVTRRIGQGRWEVPEEEVRDLRAHQETSPLVDAIQAMSDELQALYRNLERKVAERTRQLQEAHADLEALHRSQTEFYSAMTHEFRTPLTSIIGFSQLLLSPGGDPLTPGQREHLKDILESAQRLLQLVNDLLDASRLQAGQMPLRIAAVDLGEAVQEALAVVRPLAQQREITVTCHIPADLPLVAADDLRVLQILLNLLSNAIKFTQVGGEVALTAEARSDLVQVSVRDNGPGIPPEDHEVIFQLFRRGSAHERTGGSGLGLALAKLLVELHGGRIWVESRPGCGSTFHFTLPVHGGEPRCP

SEQ ID NO: 7564 - protein, 158 aa, Retama raetam
MSLIPSVFGTGRRTNVFDPFSLDIWDPFQDFPLRTIAPSGFDTETAAVANTRIDWKETPEAHVFKADLPGLKKEEVKVEVEEGRVLQISGERTKEKEDKNDTWHRVECSAGRFLRRFRLPENAKVEQVKASLENGVLTVTVPKEEVKKPDVKPVQITG

SEQ ID NO: 7565 - protein, 232 aa, Syringa vulgaris
  misc_feature (231)..(231): Xaa can be any naturally occurring amino acid
RMENKINRQVTFAKRRNGLLKKAYELSVLCDAEVALIIFSNRGKLYEFCSSSSMLRTLERYEKCNYGAPEPHVSSREALELSSQQEYLKLKARYEALQRSQRNLLGEDLGPLNSKELESLERQLDMSLKQIRSTRTQAMLDTLTDLQRKEHALNEANQSLKQRLMEGNHISLQWNQDPEEVGYGREPTQHQPHGFFHPLECEPTLQIGYQNDPMAAAGPSLNNFMSGWLPXI

SEQ ID NO: 7566 - protein, 1489 aa, Candida glabrata
MSVLIPHQQQRLRASSAAKKAAWNAMNKTVNIVSPHNNVNYVKKPSPKTNSNHLDRVIKSVNDATKRLSEAESINSNNTKSSKRKSRDTVGPWKLGKTLGKGSSGRVRLAKNIENGTLAAIKIVPKRTYNRRMRDQKMKTAGGVSSGTDSKDSSNREDPIKNGTDSALNPYGIEREIVIMKLISHPNVMGLLEVWENKSELYLVLEYVDGGELFDYLVSKGKLSEPEAVHYFTQIIQGVSYCHSFNICHRDLKPENLLLDKKNKVIKIADFGMAALELPNKLLETSCGSPHYASPEIVMGKPYHGGPSDVWSCGIILFALLTGHLPFNDDNIKKLLLKVQAGRFQLPPYLTNDAKDLITRILVTNPEKRLTINEILNHPLIKKYRNPPAHIRKLNLLGRGKSNSDLHVLEYNTPATVCLNSEEDIDQSILKSLQILWHGTPRQRLVERLLVEGATEEKLFYSLLFQYKLKHSKPISATKLQKKIEDVVLENESTKTESKDSSNEPGIDNNNDTSDFTQDGNSSEMVNELHTSAPMLEQKSQFSQHSLKSKETVPISDLPPLPPVIPTFAASSSKAFRRSKSNLSSYLKRPKLENARSRTSLFNSSSNTSITSSSISELNTRPRGNIPLSPSNITLTSLVSSRSLHNSASKKSLKNLQKRTLQNSESKRSLYSQTSISKRSLNLNDYLIGGPSNSAELPPLPKLDSNNEFEMLCDKILNTSALDNILEEEEEDITPSKNTTQTNDVHNEDTIIRKEMHDFEINVNNHQPEFKRQPSDFSVNGPDTSIFSIEPMPEGLGISKKPVRVQPTFNFIIDEDKVDDSIKVKQVSGTGPSNNVLKDISNQINNGKGIENSKLHPTSNNNYKNIRNVTAPEGNFTSKTFSLDPRRNVSQPPKESLFHSLLNNKSSKNAEENTQFESKSKQYNFMNKTAHSEFEKERLNAHRDADRSNDQNVYNETSVLAQSSTIHESPLLSIPSTLLNTSMTFKNLVDMLQENKLDDINETVAKESSAPLRKKSTKLSLAPHSNLVSDLNKRTSGYNTLASVDRSSSDLSYAIDLPTNTNIAEIVYLSGNNKQSSEKNIFMLSNDNNETELFHTDENKTSIKSAVNIFEDPPSDSTSLQTSSSESDSIPKVQRKAVSIETLNASNIITPAADVRVSLYGNNVSNSNTMPRETTEELISRFKLTPEKPQHQVQKRFSSLTQTGRNTDSIALSQSMISMFKDAEENGNNKSVKVLDQVEEENASKLTPTSPKNRVTMLFDDYEAQQNITSDQSNKSSKVIEIPNDSPIKVKVQKASTIFEKEIISAAEADENDHLRIPYESKSKKEIAQVHQQEQKEQQVRKPTESQEKAVQKTTKPSWFSKLIHGFKTTGGSGHTKLIREHSTKMTFEEVHMITVKEFGNNGIDYQLRTLDKKGDREKVEYDCKFVKGNFEFKIKIFNSGFPHQNTIITVKKKGKINSKETTDLFQRFNANIENLIKSAERNIESNPK

SEQ ID NO: 7567 - protein, 277 aa, Brassica oleracea
MNTFPASTEMVGSENESPVTTVVGGDYYPMLAASCPKKPAGRKKFQETRHPIYRGVRLRKSGKWVCEVREPNKKSRIWLGTFKTAEMAARAHDVAALALRGRGACLNYADSAWRLRIPETTCHKDIQKAAAEAALAFEAEKSDVTMEETMAVASQAEVNDTTTDHGMNMEEATAVASQAEVNDTTTDHGVDMEETMVEAVFTEEQSEGFNMAEESTVEAAVVTDELSKGFYMDEEWTYEMPTLLADMAAGMLLPPPSVQWGHNDDLEGDADMNLWSY

SEQ ID NO: 7568 - protein, 207 aa, Syringa vulgaris
ALVQLRRMENKINRQVTFAKRRNGLLKKAYELSVLCDAEVALIIFSNRGKLYEFCSTSNMLKTLERYQKCSYGSLEVNNSTRDLEESSNREYLKLKSKYESLQRHQRHLLGDELGPLNINDLEHLEHQLETSLKHIRSTRTQVMVDQLSDLQAKEKMMVETNTALERKLEEIYAANQLQQSWAGGEQSCAYSQQHLNLRTFFNLWMQ

SEQ ID NO: 7569 - protein, 250 aa, Brassica oleracea
MNSVSTFSELLGSENESPVGGDYCPMLAASCPKKPAGRKKFRETRHPIYRGVRLRKSGKWVCEVREPNKKSRIWLGTFKTAEIAARAHDVAALALRGRGACLNFADSAWRLRIPETTCAKDIQKAAAEAALAFEAEKSDTTTNDHGMNMASQAEVNDTTDHGLDMEETMVEAVFTEEQRDGFYMAEETTVEGVVPEEQMSKGFYMDEEWMFGMPTLLADMAAGMLLPPPSVQWGHNDDFEGDADMNLWNY

SEQ ID NO: 7570 - protein, 720 aa, Xanthomonas campestris
MATRKFTQRSRIREGRPNPLGATWDGLGVNFALYSRNATRVELCLFDERGREQERIALPEYTDEVWHGYLPDARPGQLYGYRVHGPYAPDAGHRFNHNKLLLDPYAKQIVGELKWAPHLFGYIIGHRDKDLSFDRRDSAAFMPKSAVIDPAFTWGQDRPPQTPWNRTVIYEAHVRGLSMLHPAVPPEERGTFSALKTDELIDHISSLGVTAVELLPVHAFVDDQYLLEKGLRNYWGYNTLGFFAPQARYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDSGQLAELATRLTGSADLFNHSGRRPTASVNFVTAHDGFTLRDLVSYETKHNLANGEDGRDGSDHNISSNYGVEGETNDPAIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPNGTEMDEAAWHDPEARALMLRLDGRSPTTGLREIAANVTLLMLINAASTAVSFTLPAMHDEHWRVLVDTARHGGRVVAGGSEWKAPAHSLTLLAVERDRIVSSARIVSEGAR

SEQ ID NO: 7571 - protein, 222 aa, Pinus radiata
MGRGKIEIKRIENTTNRQVTFCKRRNGLLKKAYELSVLCDAEVALIVFSSRGRLYEFANHSVKRTIERYKKTCVDNNHGGAISESNSQYWQQEAGKLRQQIDILQNANRHLMGDGLTALNIKELKQLEVRLEKGISRVRSKKNEMLLEEIDIMQRREHILIQENEILRSKIAECQNSHNTNMLSAPEYDALPAFDSRNFLHANLIDAAHHYAHQEQTTLQLG

SEQ ID NO: 7572 - protein, 415 aa, Oryza sativa
  misc_feature (393)..(393): Xaa can be any naturally occurring amino acid
PLNITRRSLDEWPRAGSDDVGEWPNPTTPGASKAEGAGSAKPGEGLRLDLSSLRSQGRKDQIAFFDKECSKVADHVYLGGDAVAKNRDILRKNGITHVLNCVGFVCPEYFKSDLVYRTLWLQDSPTEDITSILYDVFDYFEDVREQGGRVFVHCCQGVSRSTSLVIAYLMWREGQSFDDAFQLVKAARGIANPNMGFACQLLQCQKRVHAIPLSPNSVLRMYRMAPHSPYAPLHLVPKMLNEPSPAALDSRGAFIVHVLSSIYVWVGMKCDQVMEKDARAAAFQVVRYEKVQGHIKVVREGSEVPEFWDAFSSAPVNSDSNTKISKDQIDSASKTGPGNRRVESYDADFELVYKAITGGVVPAFSSSGAGDETHLPARESTWSSLRRKFISRXSTSPPFLSPSSLSSDSSISSKY

SEQ ID NO: 7573 - protein, 275 aa, Erwinia carotovora
MTQPKVKLADGNIMPQLGLGVWRASSEDTVIAVNEALSIGYRAIDTAAIYKNEEAVGQALSSANLPREEVFITTKLWNGDHTDPQKALEESLRKLRLDYIDLYLIHWPLPQQNTFVDAWRGLIKLQEQGLAKSIGVSNFHIHHLQRLKEETGVLPVIDQVELHPLLQQKQLHAWNATHHIQTESWSPLAQGGEGVFDHPIIRKLAMKYGKTPAQIVIRWHLDSGLVVIPKSVTPARIKENFEVFDFRLDKDELSEITKLDCGKRLGSDPDEPRND

SEQ ID NO: 7574 - protein, 676 aa, Candida albicans
MSKSLIQGVLDLDPWLEPFSQPLINRQIEFQKWHKKLIESEGSLIDFANSYKKYGVHTLPSGEIQIIQYIPDVDEVSIVGDFNNWNKDSHKLRKLNEFGTWELTLKPGSIPIDSKYKIAMKTTTKNGGEWIYRLDPWVHRATFAKQHALYEGHFWEDNYQFKNPRPKKNIAAGGIKIYEAHVGISTPEPTIGSYKNFTQNVLPIIRDLGYNTIQLMAIMEHAYYASFGYQVTSFFAISSRYGTPDELKELIDTAHGMGIQVLLDVVHSHSSKNVDDGLNMFNGTDHYLFHGGSRGNHDLWDSRLFNYTNYETLRFLLSNLKYYIDVFQFDGFRFDGVTSMLYKHHGLSVGFSGGYHEYFGDGVDNEAIVYLMLAHQLMNEISTTQNFNLTSIAEDVSGMPTLCRPISDGGIGFNYRLSMAIPDMWIKILKHLTDEQWDLGNIVHTLTNRRYGEKVIAYCESHDQALVGDKTLAFWLMDKEMYTNMSVLSPLTPIIDRGIALHKLIRLVTFALGGDGYLNFEGNEFGHPEWLDFPRQGNGESYHYARRQFNLINDDLLRYKYLYQFDKKMLQLEITNTGEYVSLKHEGDKVLVFEKGKSVYIFNFNPTQSFVDYRIGVELPGTYKLVLDSDSEDLGGHGRLDHNTKYFTFNEPWNNRSNSLLVYIPTRTAIVLEKVE

SEQ ID NO: 7575 - protein, 392 aa, Diplopterys cabrerana
DLEPVNPADVPVTAAGALKSYKLAAKAISRLQSLPSGNISLLCDVLVKEVRDLTGYDRVMVYKFHEDEHGEVVSECRRSDLEPYLGLHYPATDIPQASRFLFMKNKVRMICDCLAPPVKVIQDDRLPQPLSLCGSTLRSPHGCHAQYMTNMGTIASLVMSVTINEDDDTMDGDQQQMTRKLWGLVVCHHTSPRFVPFPLRYACEFLIQVFGVQINKEVDLAVQMREKHILQIQTMLCDMLLRDAPVAIITQSPNVMDLVKCDGAALYFRNKTWLLGVTPTEEQIRDIAEWLLKYHSGNTGLSTDSLMEAGYPGASALGDAVCGMAAVSITSGDFLFWFRSHTAKEIKWGGAKHDPDDKDDLRKMHPRSPFKAFLEVVKWRSMPWEDVEMDAI

SEQ ID NO: 7576 - protein, 309 aa, Yarrowia lipolytica
MTSIDFTMNNGKTIPAIGLGTWKSTTEEVAGAVECALTEGGYRHIDTAFNYRNEDAVGLGIKRAMEKGVKREDIFVTTKIWVTYHDRVEENLNMSLERLGLDYVDMLLIHWPVPLNPNGNDPVYPLREDGSRDIDESGSQPKTWKQMEAVLKTGKTKSIGVSNFSIPYLEELLKEAEVVPAVNQVELHPLLPQLELMEFCKKNNIIMTAFSPFGSVGGPLLKNELVLKLADKYKTSPGGILTSYHIGNGTVVIPKSVTNSRIIENGKSAVTLSQEDLKALNDLHKTEGIHRTSKPKWGVDLGFPDFDFC

SEQ ID NO: 7577 - protein, 152 aa, Zea mays
MSLVRRSNVFDPFSMDLWDPFDTMFRSIVPSATSTNSETAAFASARIDWKETPEAHVFKADLPGVKKEEVKVEVEDGNVLVISGQRSREKEDKDDKWHRVERSSGQFVRRFRLPENAKVDQVKAGLENGVLTVTVPKAEEKKPEVKAIEISG

SEQ ID NO: 7578 - protein, 561 aa, Triticum aestivum
  misc_feature (122)..(122): Xaa can be any naturally occurring amino acid
  misc_feature (178)..(178): Xaa can be any naturally occurring amino acid
  misc_feature (184)..(184): Xaa can be any naturally occurring amino acid
MRRRGEEVSGTNTKRRCRLWTKLLTWRGGRIWRPQKRGVEKTLKEVTKRLAQIARDVFKRAYGWGPAFRPSSSFDTKTTTTNAGQPVWNDNEALTVGPRGPILLEDYHLLEKIAHFARERIXPERVVHARGASAKGFFECTHDVTGLTWRRLPPPRRGAAHAPSSSRFSTVIHERGSXPETIRXDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVSRAGKAHYVKFHWRPTCGVSCLMDDEATLVGGKNHSHATQDLYDSIDAGNFPEWKLFVQVIDPDDEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRHAEPASFPVPTRPVVGKREKTRIKKENDFVQPGERYRSWAPDRQDRFVRRFADALARPKVSHELRVIWIDFLSKCDKSCGMKVANRLNVKPSM

SEQ ID NO: 7579 - protein, 446 aa, Oryza sativa
MRMGKYEMGRALGEGHFGKVKLARHADTGAAFAIKILDRQRILAMKIDEQIKREIATLKLLKHPNVVRLHEVSASKTKIYMVLEYVNGGELFDKIALKGKLSEKEGRKLFQQLMDAVSYCHEKGVYHRDLKPENVLVDAKGNIKVSDFGLSALPQNQRKDGLLHTTCGSPNYIAPEIQVLLNRGYDGSLSDIWSCGVILYVMLTGNLPFDDQNTVVLYQKILKGDARIPKWLSPGAQDILRKILDPNPITRLDITGIRAHEWFRQDYTPAMPFDDDDDNNISDGNLHMTENQDIETSPAISQINAFQLIGMSSCLDLSGFFEKEDVSERKIRFVSNYSPTSLFEKIESTVTEKGFQVQKNSGKLKVIQVCKEPANPRGHGNLLISAEVFEINESLYVVELKRSSGDCSLYRQLCASLSEDLGICKRQQLLKKDSMRQDLCRYNSSF

SEQ ID NO: 7580 - protein, 397 aa, Rhodopirellula baltica
MLFFRRKRDVGHLLAASHDLFNAPRDQDRSLMSTVVEPKKNRGPGKSKGNADQPNTHVPESTTLELPQTGGKLRLDQPQAEDADGFSSLVAQKAAKKRDLAKPTKADRVRASNISWWAVGWLAMAHIVCLAAPFTFTWTALITALVLHWVAGSLGICLGYHRLLTHTGMKTYNWVRYAFAAIGCFAGEGSPLDWVADHRKHHAHSDLEGDPHSPHDGGIWSHIFWLAFHTHNGDRDAYLTRWVPDLYKDPAMRAFDMLFLPIHIVASFALLGIGYAFGGWELGVSMLVWGMFVRLVAVLHATWMVNSASHMWGYQNYETTDDSRNNWLVAIVAYGEGWHNNHHAYPRMAKHGHKWWEFDITWQAIKLLRAVGLVWDVVDYRTVAEKKARDAKQSAAA

SEQ ID NO: 7581 - protein, 342 aa, Pyrococcus furiosus
MIIIDGSYGEGGGQILRTSIALSAITGEPVKIINIRANRPNPGLRPQHLNAILALKKLANAKVEGAEVGSREVTFIPGELKGGEIRVDIGTAGSITLVLQALLPAMVFAKDTVEFKITGGTDVSWSPPVDYLINVTMFALRKIGIEGEIKLLRRGHYPKGGGIVAGYVKPWIERKELIAEEFENIYKVSGISHATNLPAHVAERQAKAAMEELKVLGVPIEIKKEVSHSLGPGSGIVVWAETECLRLGGDALGKKGKPAEEVGREAAQELLSQVKTKACVDKFLGDQIIPFLAISGGKIKVAEITKHLITNVWVVEQFFGKVFEVKGGVGEKGEVRVVRKAW

SEQ ID NO: 7582 - protein, 799 aa, Zea mays
MAFRVSGAVLGGAVRAPRLTGGGEGSLVFRHTGLFLTRGARVGCSGTHGAMRAAAAARKAVMVPEGENDGLASRADSAQFQSDELEVPDISEETTCGAGVADAQALNRVRVVPPPSDGQKIFQIDPMLQGYKYHLEYRYSLYRRIRSDIDEHEGGLEAFSRSYEKFGFNRSAEGITYREWAPGAFSAALVGDFNNWDPNADRMSKNEFGVWEIFLPNNADGTSPIPHGSRVKVRMDTPSGIKDSIPAWIKYSVQAPGEIPYDGIYYDPPEEVKYVFRHAQPKRPKSLRIYETHVGMSSPEPKINTYVNFRDEVLPRIKKLGYNAVQIMAIQEHSYYGSFGYHVTNFFAPSSRFGTPEELKSLIDRAHELGLLVLMDVVHSHASSNTLDGLNGFDGTDTHYFHSGPRGHHWMWDSRLFNYGNWEVLRFLLSNARWWLEEYKFDGFRFDGVTSMMYTHHGLQVTFTGNFNEYFGFATDVDAVVYLMLVNDLIHGLYPEAVTIGEDVSGMPTFALPVHDGGVGFDYRMHMAVADKWIDLLKQSDETWKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDLGDADYLRYHGMQEFDQAMQHLEQKYEFMTSDHQYISRKHEEDKVIVFEKGDLVFVFNFHCNNSYFDYRIGCRKPGVYKVVLDSDAGLFGGFSRIHHAAEHFTADCSHDNRPYSFSVYTPSRTCVVYAPVE

SEQ ID NO: 7583 - protein, 494 aa, Bacillus anthracis
MPFATPPVCFGKGNSALKRRVAIIGMVVAFLIGAGGMFAGMSLFGVNPAEVTQTISSGNASTAQGNLAKINEAYALIDSRYVEDVKDEKLVEGAIQGMLSTLKDPYSTYMDKETAKQFSESLDPELEGIGAEVNKTDGKLIIVSPIKGSPAEKIGIKPNDQILSVDGNSVKDLSREEAVLKIRGKKGTTVAIEIKRAGVADPIVFKIKREKIPIFTVFSSVKQESGKDIGYMQITSFAENTAKEFKDQLKELEKKNIKGLVIDVRGNPGGYLNSVEEILGEIMTDKKPMLQVEQRNGEKKKFSTELKERKPYPISVLIDNGSASASEILAGALKEGEGYDLIGEKTFGKGTVQQAVPFKDGSNIKLTMFKWLTPDGNWIHKKGIKPTVEVKQPDYYHATPIQIEKTLSYNANDVQVKHAQEMLKSLGYVPGREDGYFSKETESALKAFQNANKMEATGQLDKKTAEAIQTKIIEKIRSGENDLQLQSALKLMAK

SEQ ID NO: 7584 - protein, 479 aa, Vibrio parahaemolyticus
MTNKKLTTAAGCPVAHNQNVMTAGPRGPQLLQDVWFLEKLAHFDREVIPERRMHAKGSGAYGTFTVTHDITKYTRAKIFSEVGKKTELFARFTTVAGERGAADAERDIRGFALKFYTEEGNWDLVGNNTPVFFLRDPLKFPDLNHAVKRDPRTNMRSSTNNWDFWTSLPEAFHQVTIVMSDRGIPASYRHMHGFGSHTFSFINAENERYWVKFHFKTQQGIKNIGDEEAQLLAGKDRESHHRDLYESIERQDFPKWKMYVQIMPELEADEVNFNPFDLTRVWSQKDYPLIPVGEFELNRNPENFYAEVEQSAFNPAAIVPGIGFSPDKMLQGRLFAYGDAQRYRLGVNHHQIPVNAPRCPVHSYHRDGAMRVDGNFGSTLGYEPNYKQEWAEQPDYSEPPLRISGHADHYDHRVDEDYFSQAGDLFRLMNEEQRQALFDNTARAMDGVPDFIKERHVTHAYQADEAYGKGLELALGLAK

SEQ ID NO: 7585 - protein, 588 aa, Thiobacillus denitrificans
MCGIAGELRFDDRAPDAATMTRMLARLARRGPDAEGQHAAGPLRLGHRRLAIIDLSPRSAQPMVDAATGTALVFNGTIYNYPELRAELIALGHAFHSDGDTEVILRAYLEWGERCVERLHGMFAFAIWHRDELFLARDRLGIKPLYYSENAGSLRFASTPQALLAAGEVDTGLDAVALHHLFTLHAVVPAPRTILNGVRKLAPGTTLTVNLRGELRHRSYWSLHAQRPAETRSEAEWTDAIHDALRRAVQKRIEIADVKVGVLLSGGLDSSLLVALLAELGVSDLMTFSVGFEDHPEERGNEFEYSDPVAAMYGTRHHKYLIPNSEVLRRLPEAVGEMSEPMFAQDAVAFYLLAEQVSRTVKVVQSGQGADEVFGGYFWYPRMAAEAEGSALDRFRRHYFDRDHAEFLELADPRYHGPDYTGELIAARLAEPFADEFIDQVLRTDTTMLITDDPVKRVDNMTMAWGLEARVPFLDHTLVELAATMPPAMKLASEGKHVLKRIARGRVPDAVIDRKKGYFPMPALKYVRGEFLDFMRDILDSQACRQRGLYRRAYVEHLLDAPEQHHTRIQGSKLWHLALLEYWLQTHV

SEQ ID NO: 7586 - protein, 120 aa, Zea mays
  misc_feature (73)..(73): Xaa can be any naturally occurring amino acid
  misc_feature (96)..(96): Xaa can be any naturally occurring amino acid
PRVHPTSSHSYARSGTRIHAKSLFDKPHELALLVLMDVAYSHSCINTVDGLNGIDGTNTHYCHRGAPAHHSMXDSRLFTYGIWLVSRFHLSNATWXLADYKSDGCAYSAVTDMILPHEGL

SEQ ID NO: 7587 - protein, 440 aa, Sinorhizobium meliloti
MIRRASLVLVGALMGATAMGVVYSATMPAVAANSSTYRELAIFGDVFERVRAQYVTPPQDDKLIENAINGMLTSLDPHSSYMNSTDAEDMRTQTRGEFGGLGIEVTMEEDLVKVTSPIDDTPAARAGVLAGDFISKIDGQDVRGLKLEEAVDKMRGAVGTPIKLTILRKGAEKPIELTIVRDVIAVRAVKVRVEGDVGYLRVISFTEKTFEDLKKGIEKIQAEVPADKLKGYVLDLRLNPGGLLDQAINVSDAFLERGEVVSTRGRNPDETRRFNATPGDLAGGKPVVVLVNGGSASASEIVAGALQDLKRATVLGTRSFGKGSVQTIIPLGDAGALRLTTALYYTPSGKSIQGTGITPDIKVEQPLPPELLGKVEAQGESDLRGHIPGQEETEEGSGSVAYVPPETKDDIQLNYAFDLLRGKKTDPSFPANPEQAQLKE

SEQ ID NO: 7588 - protein, 450 aa, Zea mays
  misc_feature (417)..(417): Xaa can be any naturally occurring amino acid
MYRAKRAALSPKVKRRVGKYELGRTIGEGTFAKVRFAKNTENGEPVAIKILDKEKVKRHRLVEQIKREICIMKLVRHPNVVRLFEVMGSKARIFIVLEYVTGGELFEIIATNGRLKEDEARKYFQQLINAVDYCHSRGVYHRDLKLENLLLDAAGNLKVSDFGLSALTEQVKADGLLHTTCGTPNYVAPEVIEDGGYDGATADIWSCGVILFVLLAGYLPFEDDNIIALYKKISEAQFSCPSWFSAGAKNMITRILDPNPTTRITISQILEHPWFKKGYKPPVFDEKYQTSLDDVDAAFGDSEDRHVKEETEDQPTSMNAFELISLNQALNLENLFEAKEEYKRETRFTSQCPPKEIITKIEEAAKPLGFDVQKKKYKMRMENPKAGRKGNLNVATEVFQIAPSLHVVELKKAKGDXTLEFQKFYRSLSTQLKDVVWKCDGEVDGNSAAA

SEQ ID NO: 7589 - protein, 239 aa, Magnaporthe grisea
MLCAVEYCHRHKIVHRDLKPENLLLDDNLNVKIADFGLSNIMTDGNFLKTSCGSPNYAAPEVISGKLYAGSEVDVWSCGVILGTYVVPHWMSPGAAALIKKMLVVNPVNRATITEIRQDPWFTTELPEYLQPPIEPFFNTGIDPEKAIRPSDIAPNAPPKVQEKLHAEVTDKISKTMGYGKQDVLDALEAEEPSAIKDAYMIVRENKMMQSNRKFLPVLTGFASSTAGPFRISCALQLT

SEQ ID NO: 7590 - protein, 385 aa, Rhodopirellula baltica
MASNNMNAPASNSSKSALFQPLEIGGLTLRNRIVMAPLTRARAGVERMANEMMAEYYTQRASAGLIISEATVVSEQGIGWPQSPGIYTDEMAESWKVVVDSVHQAGGRIFLQLWHTGRASHSDFHDGELPVAPSAIAIEGDGVHTPSGKKPYEVPRALETSELPGIVEDYRKAAERAKSAGFDGVEVHSANGYLLDEFLQSKSNHREDQYGGSIENRYRLLGEVVDAVTSVWSSDRVGVRLAPNGSFNDMGSPDYIEQFTYVARQLDQYGLAYLHVMDGTGFGFHELGPAMTLADFRKVFSGTLMGNVGYTRESAEEAIVDGAADLIAFGRPFISNPDLVERFENGWPLAEMADMSVWYSHDAEGYTDFPTYQAESKQPESCGVE

SEQ ID NO: 7591 - protein, 192 aa, Triticum aestivum
  misc_feature (157)..(157): Xaa can be any naturally occurring amino acid
  misc_feature (176)..(176): Xaa can be any naturally occurring amino acid
PFLDKEFINVAMSMDPEWKMYDKNLGRIEKWVMRKAFDDEENPYLPKHILYRQKEQFSDGVGYNWIDGLKAFTEQQVTDEMMSNAAQTFPYNTPVNKEAYYYRMIFERLFPQDSARETVPWGPSIACSTPAAIEWVEQWKASNDPSGRFISSHDSAXTTPAAVSWRWWPTAATAPXNGTVNGGNDVAVAIAV

SEQ ID NO: 7592 - protein, 387 aa, Debaryomyces hansenii
MVSDGEFTRTQIFGTVFEITNRYTDLNPVGMGAFGLVCSAIDKLTGQNVAVKKIMKPFLTSVLAKRTYRELKLLKHLRHENLITLDDIFLSPLEDIYFVTELQGTDLHRLLTSRPLEKQFIQYFTYQILRGLKYVHSAGVIHRDLKPSNILINENCDLKICDFGLARIQDPQMTGYVSTRYYRAPEIMLTWQKYDTEVDLWSVGCILSEMIEGKPLFPGKDHVHQFSIITELLGSPPPDVIETICSENTLRFVQSLPHRDPIPFSERFAQCTHVEPEAIDLLAKMLIFDPKKRISALDALSHPYMEPYHDPTDEPVCEVKFDWSFNDADLPVDTWRVMMYSEILDFHQIIGAGANGTTQEQMAQIQQEGIQAPSSQYQQTNQEQKVE

SEQ ID NO: 7593 - protein, 238 aa, Haemophilus influenzae
MLFALPALNDNYIWLYQRENLPLIIVDLPETDKLFAWLEKQNATIEAVLLTHEHDDHTQGVSAFKKRYPTVPIYGPQECEKKGATQIVNEGKILTANYQIDVIPTGGHTKQHVSFLVDNHLFCGDALFSAGCGRVFTGNYALMFEGLQRLNTLPDETIVCPAHEYTLGNLAFAETVLVDKSAVEKSAVEKQRIFVETQRAENKPSLPTTLKLEREINPFLQAKTLEEFTALRKAKDIF

SEQ ID NO: 7594 - protein, 163 aa, Arabidopsis thaliana
HVPSMYPSPNVSAHIFMGLMVNPPKPGDISYDQFARESKGILESLRKRARLMTDGFSSCKNVVCNFTEGAMYSFPQIRLPTGALQAAKQAGKVPDVFYCLKLLEATGISTVPGSGFGQKEGVFHLRTTILPAEDEMPEIMDSFKKFNDEFMTQYDNNFGYSKM

SEQ ID NO: 7595 - protein, 545 aa, Helicobacter pylori
MAKEIKFSDSARNLLFEGVRQLHDAVKVTMGPRGRNVLIQKSYGAPSITKDGVSVAKEIELSCPVANMGAQLVKEDASKTADAAGDGTTTATVLAYSIFKEGLRNITAGANPIEVKRGMDKAPEAIINELKKASKKVGGKEEITQVATISANSDHNIGKLIADAMEKVGKDGVITVEEAKGIEDELDVVEGMQFDRGYLSPYFVTNAEKMTAQLDNAYILLTDKKISSMKDILPLLEKTMKEGKPLLIIAEDIEGEALTTLVVNKLRGVLNIAAVKAPGFGDRRKEMLKDIAVLTGGQVISEELGLSLENAEVEFLGKAKIVIDKDNTTIVDGKGHSHDVKDRVAQIKTQIASTTSDYDKEKLQERLAKLSGGVAVIKVGAASEVEMKEKKDRVDDALSATKAAVEEGIVIGGGAALIRAAQKVHLNLHDDEKVGYEIIMRAIKAPLAQIAINAGYDGGVVVNEVEKHEGHFGFNASNGKYVDMFKEGIIDPLKVERIALQNAVSVSSLLLTTEATVHEIKEEKAAPAMPDMGGMGGMGGMGGMM

SEQ ID NO: 7596 - protein, 163 aa, Zea mays
MDAVMFGLETPLMAALQHLLDVPDGDAGAGGDNKTGGGGATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 7597 - protein, 335 aa, Bacillus cereus
MCGITGWVDYKRSLEGERDVVTKMAETLAKRGPDDNKVWIKGNVAFGHKRLIVVDPEGGKQPMTCLKDETNYAICYNGELYNTEDIRKELLRRGYRFKGHSDTEVLLASYIEWKEECVDHLNGIYAFAVWDEQKEQVFIARDRLGVKPLFYKYDSGRLLFGSELKAILSHPDVKAEVTLEGLSEIFGLGPSRTPGHGIYAGIKELRPGHAMTFSKNGLCIWRYWNVESKKHEDSFEETVEKTRFLLQDAITRQLVSDVPLCTFLSGGVDSSAITAIAAKEYERSGKGQLHTYSIDYEDNDKYFKANAFQPNSDAPFINLMTETFQTNPSSLRHFE

SEQ ID NO: 7598 - protein, 437 aa, Arabidopsis thaliana
MGKECYYLSWILKFHLLLVLIQLVDSGSTIRFLPGFQGPLPFELETGYIGVGEAEKDQMFYYFIKSESNPEKDPLLLWLSGGPFCSSFTALIYENGPIAFKAEEYNGSIPSLVSTTYAWTKVASILYLDQPVGTGFSYSRNPLADIPSDTGVAKPVNEFLHKWLDKHPEFLSNPLYVAGNSYSGIVIPTIVQEISNGNHLDSKPQINLQGFVLGNPATDTDIDLNSRIPFAHGKALISDEHYESLKRSCQGNYISVNPRNTKCLKLLEDFKKCVSGISEEYILKPDCMWLYSCMANLHSLSEYWANEKSVRKALLVNEGTVRKWIRCNTEIAYNKDIRSSVPYHKYISIEGYRSLVFSGDHDMLVPFLGTQAWIRSLNYSIVDDWRPWMVQNQVAGYTRTYANKMTFATVKGGGHTSEYKPVETYIMIKRWLSGQPL

SEQ ID NO: 7599 - protein, 363 aa, Pseudomonas syringae
MSALFEPFKLKDVTLRNRIAIPPMCQYSATEGVINDWHHVHLASMARGGAGLLVVEATAVAPEGRITPGCTGIWNDEQAQAFVPVVKAIKAAGCVPGIQIAHAGRKASANRPWEGDDHIAASNSRGWDTIAPSAIAFGANLPKVPRAMTLDDIARVRQNFVDAARRARDAGFEWIELHFAHGYLGQSFFSEHSNQRTDEYGGSFDNRSRFLLETLAAVREVWPENLPLTARFGVIEYDGRDEQTLAESIELARRFKAGGLDLLSVSVGFSTPDANIPWGPAFMGPIAERVRREADIPVTSAWGFGEPKLAEEAVKSGQLDLVSIGRAHLADPHWAYFAAKELGVEKSAWTLPAPYAHWLERYR

SEQ ID NO: 7600 - protein, 313 aa, Ashbya gossypii
MSTKATLKASTDTVTLNTGAKIPLFGLGTWQSTDDDASSAVAAALKHGYKHIDTASFYKNEELVGKAVKESGIPREELFITTKVWNDQQRDPAGALDLSLKKLGTEYVDLLLMHWPVPFKEPENSTLDAYKVPRGPDGKVTRDEEWDFVKTWHLMQKLLGTGKVKAIGVSNFSINNLEELLNAEGTTVVPAVNQVELHIRLPQLELVEYCQKKGIVVEAYSPLGSSSAPLLKDATVNKVAEKYGVTPAHVLLNYVANRGIVVLPKSVKESRIISNFEYFKMDEEDIKLLNDIHKKEGVQRFVDPDFSPFPLFQ

SEQ ID NO: 7601 - protein, 426 aa, Arabidopsis thaliana
MESPYPKSPEKITGTVLLGKYELGRRLGSGSFAKVHVARSISTGELVAIKIIDKQKTIDSGMEPRIIREIEAMRRLHNHPNVLKIHEVMATKSKIYLVVEYAAGGELFTKLIRFGRLNESAARRYFQQLASALSFCHRDGIAHRDVKPQNLLLDKQGNLKVSDFGLSALPEHRSNNGLLHTACGTPAYTAPEVIAQRGYDGAKADAWSCGVFLFVLLAGYVPFDDANIVAMYRKIHKRDYRFPSWISKPARSIIYKLLDPNPETRMSIEAVMGTVWFQKSLEISEFQSSVFELDRFLEKEAKSSNAITAFDLISLSSGLDLSGLFERRKRKEKRFTARVSAERVVEKAGMIGEKLGFRVEKKEETKVVGLGKGRTAVVVEVVEFAEGLVVADVKVVVEGEEEEEEVESHWSELIVELEEIVLSWHN

SEQ ID NO: 7602 - protein, 493 aa, Saccharomyces cerevisiae
MSNDEGETFATEQTTQQVFQKLGSNMENRVCFDCGNKNPTWTSVPFGVMLCIQCSAVHRNMGVHITFVKSSTLDKWTINNLRRFKLGGNHKARDFFLKNNGKQLLNTANVDAKTKYTSPVAKKYKIHLDKKVQKDMELYPSELVLNGQDSSDSPLDTDSDASRSTSKENSVDDFFSNWQKPSSNSSSKLNVNTGSLAPKNNTTGSTPKTTVTKTRSSILTASRKKPVLNSQDKKKHSILSSSRKPTRLTAKKVDKSQAEDLFDQFKKEAQQEKEDEFTNSSSSTKIRQNDYDSQFMNNSKGNNNNSIDDINTQPDEFNDFLNDTSNSFDTTRKEQQDTLTPKFAKLGFGMTMNDANDLAKQQKESQKIAQGPRYTGRIAERYGTQKAISSDQLFGRGSFDEAANREAHDKLKTFDNATSISSSSYFGEDKEVDEFGNPINSSGSGAGNFDGRNSNNGFIDFNASADDELQMLRDVVEQGAEKLGSYLRDYLRK

SEQ ID NO: 7603 - protein, 557 aa, Cryptococcus neoformans
MALSQHVDADKLIEECKDHPIKRHLSHKAALYDIPYTSRYEVEDEVPRYRLPSKGVNGRATYQLLHDELMLDGNPNMNLASFVHTWVPDECNRLVQENINKNLVDQDEYPAAQQIHERCISMLSHLWHAPKEATAMGTATTGSSEAIMLGGLALKRRWQEKMKAAGKDIHNPGPNIVMGAEAQVALEKFARYFEVEARLVPIKPESSYVMDPKDVLKYVDENTIGVFVILGSTYTGAFESVKDVAQELDKYEAETGISVPIHVDAASGGFVAPFAYPHYQWDFQIPRVHSINASGHKYGMSTVGVGWIIWRSMEYLPKELIFELHYLGATDYSFNLNFSRPAHPILAQMFTFLNLGFEGYKRIMDKNLTVARLISRALEHSGYFICLSKIHHPKALTESSSSAEQSNILPAVADAANTVLHGKKTTVDDAEYYCEGLPVVSFMFTDEIKKKYPGVKQAWIQMQLRSIGWIVPNYPLAPDCEKTEILRVVVRESLSGDLARKLIHDILQVTEDLLNDAGPSYSMSTATRRHENLDHGKLDNIDAVHIKQHTSTYSKPC

SEQ ID NO: 7604 - protein, 666 aa, Vibrio cholerae
MKAEGGFVLKDGRNLRFTHYQLAVDWAGTEQLLDDPYQYHGLYAEYEDLHTPKQMYHHMGAQFVTLERDGKMVSGVRFLVYAPHAAACSLIGAFNHWDGRRHPMQRLDYGIWGIFIPGLPEGTQYKFELKGPHGEGLPHKADPWGFYAEQYPSFASVTYDHRRYQWQDTAWQQRPVTEKRKQALSFYELHVGSWKRGENGEFLNYRELADQLVPYLVEMGYTHVELMPVAEHPFYGSWGYQPVGLFAPTSRYGSPDDFKYFVDLCHQAGIGVVLDWVPAHFPSDSHGLANFDGTPLFHDPDPRRGWHQDWNSYIYDLGREHVRRFLVANALYWFEMFHIDGIRVDAVASMLYLDYSRSHDQWIPNVDGGRENYDAIATFKWMNEEVYKHFPNAMTIAEESTAFPGVSAPTFMGGLGFGFKWNMGWMHDSLSYIKEDPVHRKYHHNTLTFPLIYAFSENYVLSLSHDEVVYGKRSLMYKMPGDEWQQTANLRAYLGYMYGQPGKKLNFMGTELGQTAEWDHDGQLQWFLTQFERHAGIQRLVRDLNHLYQAQTALHQLDCDPRGFEWRLQDNADLSVIAHERMDEAGNRVLVITNFTPVPQQEFRLGVPKTGKYRLLLNTDAKQYNGSDYPVLQDVSTEAISSEGLDQSLLLSVPPLATLFYQWSAK

SEQ ID NO: 7605 - protein, 366 aa, Vibrio parahaemolyticus
MTDALFQPIQLGSLSLKNRIVMPPMTRSRASQPGNVANDMMATYYAQRAEAGLIVAEGTQISPMGQGYAWTPGIYSPEQIAGWKKVTDAVHEKGGVIFAQLWHVGRVTHPDNIGGEQPISSSALKAENVKVFIDNGTDEPGFVDVVEPREMTKQDIKNVIEEYRQAALNAIKAGFDGVELHAANGYLVNQFIDSEANNRTDEYGGSIENRLRFLGEVVEAMTQAIGAERVGVRLAPFTSLNGTVDSTPVDTYTAAAALLDKLNVVYIHIAEVDWDDAPDTPHDFKTAVRKAYKGTLIYAGRYNAEKAQHAIESGLADMIGFGRPFVANPDLPSRIKHGYPLAEHDPATLFGGGEKGLVDYPAYHAG

SEQ ID NO: 7606 - protein, 498 aa, Cryptococcus neoformans
MTEKTPTYTLSEGCPIADATTAQRLGSCPVKGLMLMQDTQLIETLAHFSRERIPERTVHASAVGAWGEFEVTHDNSDITSAAFLNGIGKKSKVLMRISTVGPEAGTAETVRDVRGWSMKIFTEEGNQDFVFNSIPVFFIRDPIKFPSVNRSHKRHPAKHTADSSMFWDFHNNNPEGTHAIMMYFSNRGLPYSLRQINSYSGHTYKLTKSDGSFVYVKLHFKSNQGVKGMTQAEGVRTAGEAPDFHTTDMWDAIERGDYPTWTLYAQVMKPEEAENYRWNIFDMTKVWPHKDFPLRPLGKLTLNRNPENYFSDIEQAAFSPSTMVPGVAPSGDPMLQARMFAYPDAARYRLGVNYQQLPCNRPVSEVYAPYQRDGAMRYMTNYGGDPNYVRSSLKEVNFKGQLGAKGHSTGGNEKHNEWVGRVAAYTSEVTDEDYVQARMFWEVLGKAGDQEDLITNVSCHLSKAIPSVQKGAVEIFAKVNVDLAKSIEDRLAELNKGK

SEQ ID NO: 7607 - protein, 283 aa, Kluyveromyces lactis
MIKQSIRKMHVKAIKMRWLTGGVNYSYLLSTQDKKKSWLIDPAETLEVMNDLGSDEAKSIEALVNTHHHYDHAGGNVSTLAALNEKGNNISRVIAGSQRSPIANDIPDNLHEYTLGNLKILCIRTPCHTQDSTCYYVRDPETKEQAIFTGDTLFTGGCGRFFEGTAEEMDDALNFRLLGNTGDTSNWKNVKVYPGHEYTAGNVSFIRNYIYLKKSDNDHFNKLESFTKEHEVTTGHFTIADELSFNPFMRLDDPIVRRQVGDSQGCWTRAQVMDKLRNMKNKA

SEQ ID NO: 7608 - protein, 484 aa, Oryza sativa
MFGGGGGGRKPLDYEELNENVKKVQYAVRGELYLRASELQKEGKKIIFTNVGNPHALGQKPLTFPRQVVALCQAPFLLDDPNVGLIFPADAIARAKHYLAMAPGGLGAYSDSRGIPGIRKEVAEFIERRDGYPSDPELIYLTDGASKGVMQMLNTIIRNERDGILVPVPQYPLYSAAISPFGGSLVPYYLEEEANWGLDFVNLRQTVASARSKGITVRAMVIINPGNPTGQCLSEGNIKELLKFCFHENLVLLADEVYQQNIYQDERPFISARKVLFDMGPPMSREVQLVSFHTVSKGYWGECGQRGGYFEMTNLPPKTVDEIYKVASIALSPNVPGQIFMGLMVNPPKPGDISYLKFSAESKSILESLRRRARLMTDGFNSCRNVVCNFTEGAMYSFPQIRLPPKAIDAAKRAGKAADVFYCLKLLEATGISTVPGSGFGQKEGVFHLRTTILPAEEDMPAIMTSFKKFNDTFMDQYDGYSRM

SEQ ID NO: 7609 - protein, 544 aa, Chlamydophila caviae
MAAKNIKYNEDARKKIHKGVKTLAEAVKVTLGPKGRHVVIDKSFGSPQVTKDGVTVAKEIELEDKHENMGAQMVKEVASKTADKAGDGTTTATVLAEAIYSEGLRNVTAGANPMDLKRGIDKAVKVVVDEIKKISKPVQHHKEIAQVATISANNDAEIGNLIAEAMEKVGKNGSITVEEAKGFETVLDVVEGMNFNRGYLSSYFSTNPETQECVLEEALVLIYDKKISGIKDFLPVLQQVAESGRPLLIIAEDIEGEALATLVVNRLRAGFRVCAVKAPGFGDRRKAMLEDIAILTGGQLISEELGMKLENTTLAMLGKAKKVIVSKEDTTIVEGLGSKEDIESRCESIKKQIEDSTSDYDKEKLQERLAKLSGGVAVIRVGAATEIEMKEKKDRVDDAQHATLAAVEEGILPGGGTALVRCIPTLEAFIPILTNEDEQIGARIVLKALSAPLKQIAANAGKEGAIICQQVLSRSSSEGYDALRDAYTDMIEAGILDPTKVTRCALESAASVAGLLLTTEALIADIPEEKSSSAPAMPGAGMDY

SEQ ID NO: 7610 - protein, 435 aa, Arabidopsis thaliana
MKSTPKLLLLLLFIINHHVDSGSIVKFLPGFEGPLPFELETGYIGIGEEEDVQLFYYFIKSERNPKEDPLLLWLSGGPGCSSITGLLFENGPLALKSKVYNGSVPSLVSTTYSWTKTANIIFLDQPIGAGFSYSRIPLIDTPSDTGEVKNIHEFLQKWLSKHPQFSSNPFYASGDSYSGMIVPALVQEISKGNYICCKPPINLQGYILGNPITYFEVDQNYRIPFSHGMALISDELYESIRRDCKGNYFNVDPRNTKCLKLVEEYHKCTDELNEFNILSPDCDTTSPDCFLYPYYLLGYWINDESVRDALHVNKSSIGKWERCTYQNRIPYNKDINNSIPYHMNNSISGYRSLIYSGDHDLVVPFLATQAWIKSLNYSIIHEWRPWMIKDQIAGYTRTYSNKMTFATVKGSGHTAEYKPNETFIMFQRWISGHDL

SEQ ID NO: 7611 - protein, 312 aa, Zea mays
MAESFVLNTGSRIPSVGLGVWQIQPDAANDAIYAAVKAGYRHIDCAAAYNNEKEVGLALKKLFEDGVVKRDDLFITSKLWAANHAPEDVEEGIDTTLQDLQLDYLDLYLIHGPIRIKKGTSTMTPENFLPTDIPATWAAMEKLYDSGKARAIGVSNFSCKKLHDLLAVARVPPAVNQVECHPVWQQDKLRKLCQSNGVHLSAFSPLGSPGSPWINGPSVLKNPIVVSVADKLQKTPAQVALRWGIQMGHSVLPKSANESRIKENIDIFGWSIPEDLMAKFSEIKQVRLLTAEFVVHPQAGYNTLEDFWDGEI

SEQ ID NO: 7612 - protein, 294 aa, Gloeobacter violaceus
MAGYFIPDRFRDRIILHIAKNYAALPKVQTPLILGIHGPKGEGKSFMVDRVLQELQANVIVISSSELESPDAGEPGRLIRLRYREAAELVKVRGRVAAIVIHDIDAGAGFWSATTQYTVNTQLVNAALMAIADNPTNVQLPGSYDPTPLPRIPFVVTGNDFSKLYAPLVRDGRMSKFSWEPTFAEKSEIVAHLFAEDGAALGRYDLERLIQRFGAQPVDFFAAIRSRAYDDMLLQQVKAWGLENVSRNLVNHGGQPPRFEAVRLDLDRCLRWGEQIMSDQQAIESGLVEAYTRR

SEQ ID NO: 7613 - protein, 488 aa, Bacillus cereus
MNPNNRLTTNQGAPVGDNQNSRTAGRRGPVLLEDYHLVEKLAHFDRERIPERVVHARGAGAHGVFVTKNSMKQYTKAAFLQNEGTETPVFVRFSTVIHGQGSPETARDPRGFAVKFYTEEGNYDIVGNHLPVFFIRDAIKFPDMVHSLKPAPDTNIQTPDRYWDFMTLSPESTHMMTWVFSDYGTPASYREMEGFGVHSFKWINEEGKIVYIKYHWKPQQGVRNLNAKEVQEVQGKDFNHATRDLFDAIEKGNHPKWDLHVQVMQLDEMDSLDFDPLDPTKVWPEDRFPLIEVGTMTLNRNPKNFFAEVEQVAFSPSATVNGIEPSEDKLLQGRLFSYPDTQRYRLGANYLQIPVNCPYAAVHNQQRDGAMQVNQNPSTINYEPSRHAENPVEDPAYRDSTMKVEGYVSREKIEKPNDFKQAGERYRSFSKEEQDNLIANLTNDLKDVNERTKLLAVCNFFRADQEYGMRLAQALNVDITQYVGNAPK

SEQ ID NO: 7614 - protein, 404 aa, Streptococcus pyogenes
MKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISMSLQALLDNGDEVLVPMPDYPLWTACVSLGGGKAVHYLCDEEAGWYPDIADIKSKITSRTKAIVVINPNNPTGALYLKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 7615 - protein, 413 aa, Ralstonia solanacearum
MKTIQKSAKLNNVCYDIRGPVLEKAKQMEEEGHQIIKLNIGNLAPFGFDAPEEIQQDMIRNLPNSAGYSDSKGIFAARKAVMHYTQQQGIKNVTLDDIYLGNGASELIALATNALLDAGDELLLPAPDYPLWTAMTSLSGGTPVHYLCDESNGWMPDLDDIRAKITPNTKGIVVINPNNPTGALYSDALLHDIIAIAREHGLVIFADEVYDKVLFDDNRHTAMASLSEDVLTVTFNSLSKSYRSCGYRAGWMVVSGDKRPAKDYIEGLNMLSSMRLCANVPGQWAIQTALGGYQSINDLVAPGGRMRRQRDLAYELITAIPGVSCVKPKAALYMFPRLDPSVYPIDDDQTFIRQLLEEERVLLVQGTGFNWHSPDHFRIVFLPHEDDLREAIGRIARFLERYRQRHGTGIRAA

SEQ ID NO: 7616 - protein, 220 aa, Oryza sativa
MALDGKPPVPPPSTPPMDSWACGGRRSKRRGGGGGSSGSSGSSGGGGGGESEEEYLAACLLMLAHGVRDEAEVVGVAAATAKPQHGYECSVCGKVYGSYQALGGHKTSHRKPPSPAAEPAAGEEPSSGGVAGEAKVHRCSICLRTFPSGQALGGHKRLHYEGGAVGDAVKEKNSLKTKAAVATAVLKDFDLNLPAAATTAGDEAESSPPEAKRARLLLLV

SEQ ID NO: 7617 - protein, 56 aa, Zea mays
VKYVFRHAQPKRPKSLRIYETHVGMSSPEPKINTYVNFRDEVLPRIKKLGYNAVQI

SEQ ID NO: 7618 - protein, 270 aa, Brassica napus
  misc_feature (229)..(229): Xaa can be any naturally occurring amino acid
MGRGKVELKRIENKINRQVTFAKRRNGLLKKAYELSVLCDAEIALLIFSNRGKLYEFCSSPSGMTKTVEKYRKHSYATMDPNQSAKDLQEKYQDYLMLKSKVESLQHSQRHLLGEEIAGMGVNELEQLEHQVDASLKQIRSRKAGAMLDQLSDLKTKEEMLLETNRDLRRKLEESDAALTQSMWGAASAGEHSHQQQQQYHQQQPQQQHQQGMSSYQANPPSQENGFFXRPLHGNVALQMSHYNPGVTNASNSATTSQNVINGFFPGWML

SEQ ID NO: 7619 - protein, 545 aa, Campylobacter jejuni
MAKEIIFSDEARNKLYEGVKKLNDAVKVTMGPRGRNVLIQKSFGAPSITKDGVSVAKEVELKDSLENMGASLVREVASKTADQAGDGTTTATVLAHAIFKEGLRNITAGANPIEVKRGMDKACEAIVAELKKLSREVKDKKEIAQVATISANSDEKIGNLIADAMEKVGKDGVITVEEAKSINDELNVVEGMQFDRGYLSPYFITNAEKMTVELSSPYILLFDKKITNLKDLLPVLEQIQKTGKPLLIIAEDIEGEALATLVVNKLRGVLNISAVKAPGFGDRRKAMLEDIAILTGGEVISEELGRTLESATIQDLGQASSVIIDKDNTTIVNGAGEKANIDARVNQIKAQIAETTSDYDREKLQERLAKLSGGVAVIKVGAATETEMKEKKDRVDDALSATKAAVEEGIVIGGGAALIKAKAKIKLDLQGDEAIGAAIVERALRAPLRQIAENAGFDAGVVVNSVENAKDENTGFDAAKGEYVNMLESGIIDPVKVERVALLNAVSVASMLLTTEATISEIKEDKPTMPDMSGMGGMGGMGGMM

SEQ ID NO: 7620 - protein, 279 aa, Pediococcus pentosaceus
MINSLNDRIMLNNGTAIPGLGLGVFQIPDADTAQVVANGIKNGYRLIDTAQIYGNEAGTGAGIKAGLTATGLKRADLFVTSKVWNDHLSYDETIAAFESSLKKLGLDYLDLYLIHWPGDNAFQDAWRALETLYKQGKIKAIGVSNFQIHHLQALAEFAEITPVINQIETHPQLSQLEMREYAAKHDIKVQAWSPLMQGKILDNAVLAKIAQKYNKSVAQIVLRWDVQQNILLVVKSVRAERMLSNAQIFDFELAPEDMDQINALNENLRVGPNPDEFDF

SEQ ID NO: 7621 - protein, 131 aa, Brassica napus
MVQTKKFRGVRQRHWGSWVAEIRHPLLKRRIWLGTFETAEEAARAYDEAAVLMSGRNAKTNFPLKNNSTIDTSESKTDISSSSSSSSSSSSSSLSSILSAKLRKCCKSPSPSLTCLRLDTTSSHIGVWQKR

SEQ ID NO: 7622 - protein, 554 aa, Unknown
  Shewanella sp. MR-7
MCSIFSILDIQSDAKELRQVALEMSKLMRHRGPDWSGIYASDKAILAHERLAIVDIEHGAQPLLTEDGSLILAVNGEIYNHKELKAQLGDKYSYQTNSDCEVILALYQEYGTEFLDKLNGIFAFVLYDKAKDAYLIGRDHMGIIPLYTGRDAAGNFYVASEMKALMPVCKTVAEFQPGQYLYSTTGEPVQYYTRDWQSFDAVKDNAASQEELREALEAAVKRQLMSDVPYGVLLSGGLDSSVISAITQTFAKRRIEDDDQSGAWWPQLHSFAVGLKGAPDLAAAKKVADAIGTIHHEINFTFQEGLDAIKEVIYHLETYDVTTIRAATPMYLMARKIKAMGIKMVLSGEGADELFGGYLYFHKAPNAQAFHEELVRKLDKLHLFDCLRANKAMAAWGLEARVPFLDKEFMDVAMRINPEAKMSKDGRIEKHILRQAFEHKLPKEVAWRQKEQFSDGVGYSWIDGLKAHAAEQVDDLQLANAKFRFPYNTPETKEAYFYRCFFEEHYPLASAAETVPGGKSVACSTPEALAWDESLRGIIDPSGRAVRSVHAASY

SEQ ID NO: 7623 - protein, 130 aa, Vitis vinifera
DSSNTGSVSEANAQFYQQEASKLRRQIRDIQNLNRHILGEALSSLNFKELKNLETRLEKGISRIRSKKNELLFAEIEYMQKREIELQNSNLFLRAQIAENERAQQQMNLMPGSQYESVPQQPYDSQNLLP

SEQ ID NO: 7624 - protein, 156 aa, Brassica napus
MSMIPSFFGNNRRGGSSFFDPFSLDVWDPFKDFPSSSSFSRENSAIVNARVDWRETPDAHVFKADLPGMKKEEVKVEIEDDSVLKISGERHVEKEDKNDTWHRVERSSGQFTRKFRLPENVKMDQVKAAMENGVLTVTVPKAEMKKPDVKSIQISG

SEQ ID NO: 7625 - protein, 585 aa, Xanthomonas axonopodis
MNQRDAITPAWGAWPAGEGQVRFALWAPEAKNVDVVFANGARSALQAGQDGFFSALIDCAADARYRYSVDGGEPVPDPASRWQPEGVHGPSAVQPTDGYAWQNTQWQGRPWDEAVIYEVHVGTCGGYAGVQAQLPQLAAMGITAVELMPLSAFPGAHNWGYDGVLPYAPVEAYGTPDELKALIDAAHGHGLMVLLDVVYNHFGPDGNYLHSYAAPFFNEDKPTPWGAAIDFRKPPVQRYFLDNALMWLHEYGFDGLRLDAVHAISPNAFLDTLRETIEASLPAGRHVHLVLENEANQASQLQRGYTAQWDDDFHNALHVLLTGEEEGYYAAFADKPTEHLARVLGEGFAYQGEPDPRGHVRGEPSGALPPHKFVVFAQNHDQIGNRARGERLTVLVSPQRLRAALALTALTPMIPLFFMGEPWGAKQPFLFFTDFGPPLDEAVREGRRREFAHFAAFADEAQRATIPDPNSHATFAASRSPIADAAHGDGAQWASWFKALLDVRRQWLVPGLAQARAVRASVLADGAVTATWELPGGLWHIAFNVGTQPVPLPPLRGRVAHVENVAADARQLPVDGFIAWHEAQA

SEQ ID NO: 7626 - protein, 437 aa, Arabidopsis thaliana
MGSTLKHLLLLLLVLIRHVDSAAIVKSLPGLEGRLPFELETGYIGIGEEEDIQLFYYFIKSENNPKEDPLLLWLDGGPGCSSLGGLLFENGPVALKSAVYNGSNPSLFSTTYSWTKMANIIYLDQPVGSGFSYSRTPIGKSSDTSEVKRIHEFLQKWLSKHPQFFSNPFYVTGDSYSGMIVPALVQEISKGNYICCKHLINLQGYVLGNPITYAEHEKNYRIPFSHGMSLISDELYESLKRNCKGNYENVDPRNTKCVRLVEEYHKCTDKINTQHILIPDCDKKGHGITSPDCYYYLYFLIECWANNERVREALHVTKGTKGQWQRCNWTIPYDNNIISSVPYHMDNSINGYRSLIYSGDHDITMPFQATQAWIKSLNYSIVDDWRPWMINDQIAGYTRTYSNKMTFATVKGGGHTAEYLPNESSIMFQRWISGQPL

SEQ ID NO: 7627 - protein, 437 aa, Arabidopsis thaliana
MSLILKFMLLILLVSSHHVRSGSIVKFLPGFKGPLPFELETGYIGIGEEENVQFFYYFIKSDKNPQEDPLIIWLNGGPGCSCLSGLFFENGPLALKNKVYNGSVPSLVSTTYSWTKTANIIFLDQPVGSGFSYSKTPIERTSDTSEVKKIHEFLQKWLIKHPQFLSNPFYVVGDSYSGMIVPALVHEISKGNYICCNPPINLQGYVLGNPITHIEFEQNFRIPYAHGMSLISDELYESLKRICKGNYFSVDPSNKKCLKLVEEYHKCTDNINSHHTLIANCDDSNTQHISPDCYYYPYHLVECWANNESVREALHVDKGSIGEWIRDHRGIPYKSDIRSSIPYHMNNSINGYRSLIFSGDHDITMPFQATQAWIKSLNYSIIDDWRPWMIKGQIAGYTRTYSNKMTFATVKGGGHTAEYLPEESSIMFQRWISGQPL

SEQ ID NO: 7628 - protein, 650 aa, Pseudomonas putida
MQTAFPLLFEPLQIRGKRLKNRIMSTGHDTCLPTDNLVNDKLIAYQRDRAAGGVGLIVLQVAGVHDSARYTSHVLMATDDACIDGYRQLAEACHAHGTVVLSQLFHPGREIMESADGLLAVAYSASAVPNERFRVMPRALDQAMIDEIVQGYASAARRLHQAGLDGVEVVASHGYLPAQFLNPRVNVRSDGYNGDLDQRLRFLREVLAAVRAATDEQFIIGLRISADERDSQGLSEDESLAAAMALQGQLDYLHIVAGTSASLGGAVHIVPPMAIEPAYLAREAGTFKQQLAIPLFVTGRINQPQEAELILARGQADVCGMTRALICDPSMPAKTERGQVEDVRACIACNQACIGHFHRGLPISCIQRPETGRELQYGHLTPTSSPKRIMIAGGGPAGMKAAAVAAARGHQVTLYEAGPQLGGQVLLAQLLPRRSEFGGASTNLQREMALAGVEVVRNTRVDRALVERERPDLVIAATGATPYWPAFERTGELQVVDAWQLLRNEVKPGRSVLVIDWRCDWIGPGIAERLVREGHQVQLAVNGTHCGESLPLYVRDQLAGELHRLGIPVTPYARLYGSDDNTVYLQHTASGDPMIFEGIDTLVLCMGHQPQDRLATELAGVVDVRRIGDCLAPRTAEEAIHDGLTVAWAL

SEQ ID NO: 7629 - protein, 720 aa, Xanthomonas axonopodis
MATRKFTQRSRIREGRPNPLGATWDGLGVNFALYSRNATRVELCLFDERGREQERIALPEYTDEVWHGYLPDARPGQLYGYRVHGPYAPDAGHRFNHNKLLLDPYAKQIVGELKWAPHLFGYTIGHRDKDLSFDRRDSAAFMPKSAVIDPAFTWGQDRPPQTPWNRTVIYEAHVRGLSMLHPAVPPEERGTFSALKTDELIDHISSLGVTAVELLPVHAFVDDQYLLEKGLRNYWGYNTLGFFAPQARYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDGGQLAELATRLTGSADLFDHSGRRPTASVNFVTAHDGFTLRDLVSYEGKHNLANGEDGRDGSDHNISSNYGVEGETNDPAIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPNGTEMDEAGWHDPEARALMLRLDGRSPTTGLREIAANVTLLMLINAASTAVSFTLPAMHDEHWRVLVDTARHGGRVVAGGSEWKAPAHSLTLLAVERDRIVSSARIVSEGAR

SEQ ID NO: 7630 - protein, 1040 aa, Cryptococcus neoformans
MSRVPSGSQQPQYTQQPLYHPSSVHSQSASVQQTHQQYHPHAGQPMAFQGDPHAYSYDRQSQINTWQANPGAAGSMEYHSAVAGSSRGADPYQPYSQPHRSSPSQPVTAGRTQPASAQQYTPWAPVQASATTTPSSRGGGVKLEDLMSNDSRADGKSQPLSSIPLSVSASFDTRSQFSAGPQGASTEKEKDKERDKATQQQGPSEFIKKLYKMLEEEQAQYGSSRAKKGEKGKRGSVGWGANGTSFVVWDMNDFTTKILPQTFRHSNFSSFVRQLNKYGFSKIKHVDAGTGSIKENIWEFQHPNFQAGGKSDLESIKRKPVAPKKTNNQEGDENSPRYVGLSNEDQSRMHLMEDRINILEDALAKSRSEADEARMREMAMMGLVRDMIGHIAASESEAIGSPAATTGHSPRVLHLLKSLDNLARAYPPEMYHSNIARQPTTMPYTPAQPQSHQSFLNAAYNPAFSGSSVGGAAQAQASPHTDGTGSRGSLSGPSTGEIKPPASSSRLRAASNAGVVPPGSVNASVPVASQPSGNPPAGPVAHVEDPAEDVIEIPNQMQDMYGGESVSIAPLFVETPAWLTEGTTIPLTMYRKQSDGQALKAVYQAFAAGGKLPAGEGQDEDGNAIASGSSTSAAEIMAGSSQMGLQQSYDAGPSTSTGIPLPMDGSPSSESSSRKGKGKKSRGTSLKEQRESKLKPHWAQTPRILVVEDDIVYRTLSKKFLQKFGCETETVENAQGAVDKMNGTKYDLVLMDIFFGPNMDGRKATSLIRQFNNYTPIISMTSNAQPQDVDSYYQSGMNDILAKPFTKNHLFTILDKHLVHLRHAQLYERLIPLGVGVPPLSDQHVQEALAVSAATLQNTNGQLQLENGQTAEAQNEQQDSNGELELGIRNPLAGSGWSDEAYQLVLAQFLQTGVMPDITTISAVSSSPNPNGFDGTIGTSIVFGESSGFSRKRSIEAINDDNWDGQAQTPASAQAQVQAQTQNTIMQGDQQQGMSLQMPTNVGMGMDVNMGNMPESGMMNQDMSNDSDGRETKRARGMAG

SEQ ID NO: 7631 - protein, 466 aa, Lactobacillus brevis
MENTRMKQMRRSNQSSGPALNCHDLPKYKLAKHALEPRPREADRLVRDQLLDEGNSRLNLATFCQTYMEPEAVELMKDTLEKNAIDKSEYPRTAEIENRCVNIIANLWHAPEAESFTGTSTIGSSEACMLAGLAMKFAWRKRAKANGLDLTAHQPNIVISAGYQVCWEKFCVYWDIDMHVVPMDDDHMSLNVDHVLDYVDDYTIGIVGIMGITYTGQYDDLARLDAVVERYNRTTKFPVYIHVDAASGGFYTPFIEPELKWDFRLNNVISINASGHKYGLVYPGVGWVIWRDQQYLPKELVFKVSYLGGELPTMAINFSHSASQLIGQYYNFIRFGFDGYREIQEKTHDVARYLAKSLTKLGGFSLINDGHELPLICYELTADSDREWTLYDLSDRLLMKGWQVPTYPLPKNMTDRVIQRIVVRADFGMSMAHDFIDDLTQAIHDLDQAHIVFHSDPQPKKYGFTH

SEQ ID NO: 7632 - protein, 376 aa, Arabidopsis thaliana
MSAESCFGSSGDQSSSKGVATHGGSYVQYNVYGNLFEVSRKYVPPLRPIGRGAYGIVCAATNSETGEEVAIKKIGNAFDNIIDAKRTLREIKLLKHMDHENVIAVKDIIKPPQRENFNDVYIVYELMDTDLHQIIRSNQPLTDDHCRFFLYQLLRGLKYVHSANVLHRDLKPSNLLLNANCDLKLGDFGLARTKSETDFMTEYVVTRWYRAPELLLNCSEYTAAIDIWSVGCILGETMTREPLFPGKDYVHQLRLITELIGSPDDSSLGFLRSDNARRYVRQLPQYPRQNFAARFPNMSAGAVDLLEKMLVFDPSRRITVDEALCHPYLAPLHDINEEPVCVRPFNFDFEQPTLTEENIKELIYRETVKFNPQDSV

SEQ ID NO: 7633 - protein, 1550 aa, Anabaena variabilis
MKAQLPDNEVQRIAALLEYKILDTQSEAAFDDITRLASYICGTPIALISLIDQNRQWFKSKVGLERRETPRDEAFCTYTILESDVFIVPDATTDERFATNPLVISDPKIRFYAGVPLTNPEGYSLGTLCVIDYIPRNLSPEQIEALQILGRQVIKQLELRRNLANLVLVNNQHKQAQKIRHPFFKKIAGGFGLASVILVLLGLASYQSEIELIHSSNQVQITQESINNLEKLLSQIKDAETGQRGYILTGKDLYLQPYQTALTNIDQKFAELKNTTVDQVQQQRLVILKPLITAKITELKQTIKLRQNQGFQTALQVIQSDKGQTLMDDIRKVMREMETEEKVRLQQQLQAVKASGQKVIVILAIAIVSGLIILAVVYYLIYCEVIARQSMENILNEERNFISAVLDTVSALVIVLDSQGRIVRFNQACEVITGYSFDEVRGRHFWNLFLLPEDVESSKASFAKFPTDSRVSGIQESENYWVTKDGSRRLIAWSRTILQNHEGSVEYIIGTGIDITERKRADKHLTIQYAITRVLAESTTITEATPQILQAICETLKWDVCEIWMVNQQGNFLSFFDLWDQTSLEMQEFKTQSQPITFASGIGLPGQIWASGQPIWLTDIADDASFLRNQLAAQVGLRGAFGFPIRSGQKILGVITCFSHQVQPHDPDLAKIMDSIGEQVGQFIHRKQAEEELQRQNLRSQLFTEITLKIRQSLQIEEILQITVKEVQKILQTDRVLIYQLLPDGSGSLIIEAVVAGWAAIKGQNITDFYLQTEYQQQYCLQQYRLRHLEAIANLDLAEIQQSHLELLRKFGVKANLVIPILVKDELCGLLIVHQCANSRQWTSFETHLLRQIADQVGIAVAQAQLLEVETRQRQELEVARSQAELASHAKSAFLANMSHEIRTPMNAVLGMTGLMLETLLNQEQRDFMETIRISGDALLTLINEILDLSKLEAGEMALENLNFNLSTCVEEVLDLLAPQAHSKGLEIAALIYRHVPIQLQGDASRLRQILMNLIGNAIKFTSFGEVVMRVELRSETPTTAIIHFAVTDSGLGITLEDQHKLFTPFTQVDASTTRKYGGTGLGLAICKQLVTLMGGEIGVESQLGKGSKFWFEIPFAKQLQPVSFVEDCGLLNNRRLLVVDDHATNRKIIYHQVSRWGMQVDQADRAVAALGMIVEACQQNKPYDVILIDMQMPEMDGMALGKQIKANSAIPPTPLIMLTSTNQRDEVQQAIKIGFAAYLVKPVKSSRLLDTIMSVLKTPSQLEAEKLEVKSQELEKNNLDHSRNRNFTATQAQNSVSTKTRILLAEDNLVNQKVALKQLQSLGYTADVAANGKEVLQLLKQIPYDLILMDCQMPILDGLETTKEIHRWAESSFASGRRPVIIAMTANAMKEDKQMCLDVGMDDYLSKPVMKEQLATALEYWCQLILNARQAVEFDIHSLPIDWEHLHQLSENDTEFELHLLQIFVEDVRARLELAKEAIANTDFQKMAQQVHQLKGASTNLGATAMYLAAERLEQLANNQERRGSMELITEIEESVNQIQAFLTRSQVV

SEQ ID NO: 7634 - protein, 115 aa, Zea mays
  misc_feature (38)..(38): Xaa can be any naturally occurring amino acid
  misc_feature (71)..(71): Xaa can be any naturally occurring amino acid
  misc_feature (89)..(89): Xaa can be any naturally occurring amino acid
LGPSRPAGFNSSPKLLCGISPEGAMYLFPPIRVPPRAXEAARRVGRSADGFYCLKLLEATGISTGPASAFXGEKEGVFHLRTTILPAEXDLPAMMARFEKLNDCLMEEDEGYSMM

SEQ ID NO: 7635 - protein, 415 aa, Yarrowia lipolytica
MEDDKTTATPPTEFVWKLYMMLEEGNDNTVFWTPDGRSFVISDTIEFSKTTLPRHFRHKNFSSFVRQLNKYDFHKVKSTNDDGEPVYGENGWEFKHPNFLQFDTSGIDSIRRKLPEKRRAEGPSGYRELEDELHDLKRKHESLQKHFTSLSEDFSNAIGKLSGLQESLKKKEETMNHVFSMLAEFEYRFERLGMSQDDTASFDHIKRRRTDPSAAAQAQAQAQAQAQAQAQAQAQAQATTNYDDHMWPSTTHTWLPLHPPQVRRDSNGKAHPDGHADNTAESTEIHQNGEVQKILIASDDSDCVKICSTLLQKAGQVVEVIPDGVDAVEFLQTSASHVGLVLMETVLPRLDGCSAVELIRSMNRQVPIIMINDGSVNPKLEFLLQSGYVNEVLARPFNKDDFFKAVSPHVSLASY

SEQ ID NO: 7636 - protein, 683 aa, Unknown
  Shewanella sp. ANA-3
MRKLTLATSIATVFVGFSAWAVPPTIQISELPTLKQEAQHKVASKRVTDLYTRSHYHRFALDDAFSAQIFDRYLQQLDYRRNVLTQADVDSFKPYTNQFDDMLSSGDLDPAYKMFDLVQKRRYEGFVYALSLLDKEMDFTVPGDAYEYDREDAAWPKDQAEINELWRQRVKYDALNLKLTGKKWPEIVDILQKRYNNAIKRLTQTNSEDVFQAVMNAFSRSIEPHTSYLSPRNAERFQMEMNLSLEGIGAQLQLEDDYTVIKSLIAGGPAASSEKLSPEDKIVGVGQEGGEIVDVIGWRLDDVVDLIKGPKGSKVILQILPKKGGSNAKPFNLTLVRDKIRLEDRAATSKIIEPKDGEYANRKVGVIQIPGFYMNLSQDVEKELVKLNEAKVEGVVIDLRGNGGGALTEAVLLTGLFIDMGPVVQVRDADGRVSAHRDNDGKTTYAGPLTIMVDRYSASASEIFAAALQDYDRALIVGESSFGKGTVQQHKSLGRIYDMYEKPIGHVQYTIQKFYRINGGSTQLKGVTPNIAYPSALEPGEYGEAEEKNALPWDKVPMAQYGTLNDITPELVASLEKKHLARIQNDVEFNYINQDIADFKKHHKEKTVSLVESERIASREADEKKVLDRTNERRVAHGLAAVKSMEDIKDKDDVEAPDAFLDETAYITLDMADAKKLANAGTK

SEQ ID NO: 7637 - protein, 259 aa, Rubrivivax gelatinosus
MPALVSIKAFADNYIWLFRVGNRAWVVDPGESAGVLGYLDKHHLILEGILLTHHHDDHTGGVEHLRSVRNARVYGPARERLPEPVIRLLHGDEVDALGVRFRVIDVPGHTAGHIAYYAEDFDGRPLLFCGDTLFSGGCGRLFEGTPAQMFASLDRLAGLPGDTLVCCAHEYTVGNLRFANAVEPGNRDVVEHLDRCLALRARDEPTLPSSIKQERLINPFLRCQDPAVANAARRRAAVGHAMDDVAVFAALRAWKDRFA

SEQ ID NO: 7638 - protein, 547 aa, Haemophilus ducreyi
MAIKDVKFGNDARVKMLKGVNILADAVKVTLGPKGRNVVLDKAYGAPTITKDGVSVAREIELEDKFENMGAQMVKEVASKANDVAGDGTTTATVLAQSIVSEGLRAVAAGMNPMDLKRGIDKAVAAVVEELKAISKPCETSKEIEQVGTISANSDETVGKLIAQAMEKVGKEGVITVEDGTGLDDALDVVEGMQFDRGYLSPYFINKPEAGTVELDNPYIILVDKKISNIREILPVLEAVAKAGKPLLIIAEDVEGEALATLVVNTMRGIVKVAAVKAPGFGDRRKAMLQDIAILTAGTVISEEIGMELEKATLEELGQAKRVVITKDNTTIIDGIGDEAQIKARVVQIRQQIEDSTSDYDKEKLQERVAKLAGGVAVIKVGAATEVAMKEKKDRVDDALHATRAAVEEGIVPGGGVALVRAANKVSATLTGDNEEQNVGIKLALRAMEAPLRQIVENSGEDASVVARDVKDGSGNFGYNATTEEYGDMLEMGILDPTKVTRSALQFAVSIAGLMITTECMITDLPKEDKLDAQAAMGGMGGMGGMM

SEQ ID NO: 7639 - protein, 435 aa, Saccharomyces cerevisiae
MTTNEEFIRTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 7640 - protein, 194 aa, Pyrus pyrifolia
MGQQSLIYSFVARGTVILAEYTEFTGNFTSIASQCLQKLPATNNKFTYNCDGHTFNYLVDNGFTYCVVAVEAVGRQVPIAFLERIKEDFTGRYGGGKAATAVANSLNKEFGSKLKEHMQYCVDHPEEISKLSKVKAQVSEVKGVMMENIEKVLDRGEKIELLVDKTENLRSQAQDFRQQGTQMRRKMWLQNMKL

SEQ ID NO: 7641 - protein, 278 aa, Corynebacterium sp.
MTVPSIVLNDGNSIPQLGYGVYKVPPADTQRAVEEALEVGYRHIDTAAIYGNEEGVGAAIAASGIARDDLFITTKLWNDRHDGDEPAAAIAESLAKLALDQVDLYLVHWPTPAADNYVHAWEKMIELRAAGLTRSIGVSNHLVPHLERIVAATGVVPAVNQIELHPAYQQREITDWAAAHDVKIESWGPLGQGKYDLFGAEPVTAAAAAHGKTPAQAVLRWHLQKGFVVFPGSVRREHLEENLDVFDFDLTDTEIAAIDAMDPGDGSGRVSGHPDEVD

SEQ ID NO: 7642 - protein, 205 aa, Oryza sativa; identical to SEQ ID NO: 164

SEQ ID NO: 7643 - protein, 492 aa, Zantedeschia aethiopica
MDPCKYRPSSSYDASFTTTNAGGPVWNDDVALTVGSRGPILLEDYHLIEKVAHFARERIPERVVHARGASAKGFFECTHDVTHLTFADFLRAPGVQTPVIVRFSTVIHERGSPETIRDPRGFAVKFYTREGNWDLLGNNFPVFFIRDGIKFPDVIHAFKPNPKSNVQEYWRVLDFLSHLPESLHTFCFLYDDVGVPLNYRHMEGFGVNTYTFINKAGKTNYVKFHWKPTCGVKCMLEDEAVVVGGKNHSHATQDLYDSIAAGNYPEWKLFVQVMDPDEEDKYDFDPLDDTKTWPEDLLPLQPVGRLVLNRNIDNFFNENEQLAFSPGIIVPGIYYSDDKMLQCRTFAYGDTQRYRLGPNYLMLPVNAPKCAHKNSHYDGLMNFMHRDEEVNYYPSRHDRLRNAERFPINNRPIIGKREKCTIEKQNDFKQPGERYRSWAPDRQERFVRRWVEALAHPKVTFEIRTIWVSYLSKCDASLGQKVANRLNMKPSM

SEQ ID NO: 7644 - protein, 46 aa, Pseudotsuga menziesii
LRRFRLPDNAKVEEIKAAMENGVLTVTVPKQPEPQPPQPKSIEISG

SEQ ID NO: 7645 - protein, 538 aa, Zea mays
EFGSRAHGISVQSFNGDLLYEPWDVYDENGQAFTTFNKYWEKCMNLPIEISQYLAPTRLVAAPGLANVRCCSIDDLGLESSKDVESSNALLSRAWSPGWRNAENMLEEFVSYGLLEYSEHGMKVGGSTTSLLSPYLHFGELSVRMIYQLVKMRQVKWQNEGKSEAEESVRLFLRSIGFREYSRYLCFNYPFTHERSFLGNLKHYPWLLDEGRFKSWRQGMTGYPLVDAGMRELWATGWTHNRIRVIVSSFAVKFLQIPWIWGMKYFWDVLLDADLESDILGWQYISGSLPDGHELSRLDNPEVQGQKYDPDGEYVRTWIPELARMPTEWIHSPWAAPNSILQVAGVELGFNYPKPIVELHMARECLDDAISTMWQLDTAAKLAELDGEVVDDNLNNIRNFDIPKVVLNKKLSPSTSSMEHRVLSTNGKDEKSQPTEVKALYKQIIRDDMMNDSNMDDTCSTANLKVTRKRSSNDSAFNVPSCSSSLVMESRIHHNEPSSVLYSGYFQKTADRDGTSKVEDNDSEDSGTSISRPSKKAA

SEQ ID NO: 7646 - protein, 102 aa, Glycine max
AFAVSGHKYGLVYAGIGWVIWRSKEDLPEELIFHINYLGADQPTFTLNFSKGSSQVIAQYYQLIRLGYEGYKMVMENCYDNMAVLKERLEKIRKVEIIFQDI

SEQ ID NO: 7647 - protein, 572 aa, Saccharomyces cerevisiae
MCGIFAAFKHEDIHNFKPKALQLSKKIRHRGPDWSGNAVMNSTIFVHERLAIVGLDSGAQPITSADGEYMLGVNGEIYNHIQLREMCSDYKFQTFSDCEPIIPLYLEHDIDAPKYLDGMFAFCLYDSKKDRIVAARDPIGVVTLYMGRSSQSPETVYFASELKCLTDVCDSIISFPPGHVYDSETDKITRYFTPDWLDEKRIPSTPVDYHAIRHSLEKAVRKRLMAEVPYGVLLSGGLDSSLIAAIAARETEKANADANEDNNVDEKQLAGIDDQGHLHTSGWSRLHSFAIGLPNAPDLQAARKVAKFIGSIHHEHTFTLQEGLDALDDVIYHLETYDVTTIRASTPMFLLSRKIKAQGVKMVLSGEGSDEIFGGYLYFAQAPSAAEFHTESVQRVKNLHLADCLRANKSTMAWGLEARVPFLDKDFLQLCMNIDPNEKMIKPKEGRIEKYILRKAFDTTDEPDVKPYLPEEILWRQKEQFSDGVGYSWIDGLRDTAERAISDAMFANPKADWGDDIPTTKEAYWYRLKFDAWFPQKTAADTVMRWIPKADWGCAEDPSGRYAKIHEKHVSA

SEQ ID NO: 7648 - protein, 538 aa, Staphylococcus aureus
MVKQLKFSEDARQAMLRGVDQLANAVKVTIGPKGRNVVLDKEFTAPLITNDGVTIAKEIELEDPYENMGAKLVQEVANKTNEIAGDGTTTATVLAQAMIQEGLKNVTSGANPVGLRQGIDKAVKVAVEALHENSQKVENKNEIAQVGAISAADEEIGRYISEAMEKVGNDGVITIEESNGLNTELEVVEGMQFDRGYQSPYMVTDSDKMVAELERPYILVTDKKISSFQDILPLLEQVVQSNRPILIVADEVEGDALTNIVLNRMRGTFTAVAVKAPGFGDRRKAMLEDLAILTGAQVITDDLGLDLKDASIDMLGTASKVEVTKDNTTVVDGDGDENSIDARVSQLKSQIEETESDFDREKLQERLAKLAGGVAVIKVGAASETELKERKLRIEDALNSTRAAVEEGIVAGGGTALVNVYQKVSEIEAEGDIETGVNIVLKALTAPVRQIAENAGLEGSVIVERLKNAEPGVGFNAATNEWVNMLEAGIVDPTKVTRSALQHAASVAAMFLTTEAVVASIPEKNNDQPNMGGMPGMM

SEQ ID NO: 7649 - protein, 250 aa, Arabidopsis thaliana
MIVPPLVQEIGKGNYQINLQGYILGNPITDTESEQNYQIPYAHGMALISDELYKSMERICKGNYVKVDSLNTKCYKLIKDYQKCIHKLNKYHILLPDCDITSPDCFLYRYTLITFWANNKSVREALQVNKGSIGKWVQCNYKNISYNYDIKSSVAYHMKNSIDGYRSLIYNGDHDMMVPFLATQAWIRSLNYSITDDWKPWMINDQIAGYTRSYSNKMTFATIKGSGHTAEYKPKETSIMFKRWISAQPL

SEQ ID NO: 7650 - protein, 728 aa, Salmonella typhimurium
MSSRIDRDVINALIAGHFADPFSVLGMHQTQAGLEVRALLPDATDVWVIEPKTGRKVGKLECLDARGFFCGVLPRRKNFFRYQLAVTWHGQQNLIDDPYRFGPLIQEMDAWLLSEGTHLRPYETLGAHADTMDGVTGTRFSVWAPNARRVSVVGQFNYWDGRRHPMRLRKESGIWELFIPGAHNGQLYKFELLDANGNLRIKADPYAFEAQMRPETASMICGLPEKVTPGEERQKANQFDAPISIYEVHLGSWRRHTDNNFWLSYRELADQLVPYAKWMGFTHLELLPVNEHPFDGSWGYQPTGLYAPTRRFGTRDDFRYFINAAHAAGLNVILDWVPGHFPSDEFSLAEFDGTHLYEHSDPREGYHQDWNTLIYNYGRREVSNYLVGNALYWMERFGIDALRVDAVASMIYRDYSRKEGEWIPNEFGGRENLEAIEFLRNTNRIIGEQVPGAVSMAEESTDFSGVTRPPETGGLGFWYKWNLGWMHDTLDYMKLDPVYRQYHHDKLTFGMLYNHTENFVLPLSHDEVVHGKKSILDRMPGDAWQKFANLRAYYGWMWAFPGKKLLFMGNEFAQGREWNHDASLDWHLLEGGDNWHHGVQRLVRDLNHTYRHHKALHELDFDAYGFEWLVVDDNERSVLIFVRRDKAGNEIIVASNFTPVPRHDYRFGINQPGRWREILNTDSMHYHGSNTGNGGVVHSDEIESHGRQHSLNLTLPPLATIWLMREGE

SEQ ID NO: 7651 - protein, 130 aa, Zea mays
  misc_feature (102)..(102): Xaa can be any naturally occurring amino acid
GDADYLRYHGMQEFDQAMQHLEQKYEFMTSDHQYISRKHEEDKVIVFEKGDLVFVFNFHCNNSYFDYRIGCRKPGVYKVVLDSDAGLFGGFSRIHHAAEHFXADCSHDNRPYSFSVYTPSRTCVVYAPVE

SEQ ID NO: 7652 - protein, 373 aa, Pseudomonas syringae
MTLFNEFKLGNTPLSNRVVMAPMTRSRAPEDIAAEQIALHYTQRATAGLIVSEGTPISREGQGYLFNPGIYTPEQIQGWKLVTDSVHSVGGRMFAQLWHVGRVSHTSIQIDGKAPVSATTRQAQGAVAFAYGEDGEPGFVPTSAPRPLTTEEVARVVEDFAQAAQNAIDAGFDGVEIHGANGYLLEQFLNPLVNDRGDQYGASNLQDRLRFVFEVVDAACARIGADRVGIRISPYGQLFDMPLYPEIDETYSALCAGMRERGIAYVHVMDQTHFFMAGESSAAQEQALRKLLKHCKAELGNTALILAGDMTRERADALLEENLIDLAAFGQPFIGNPDLVARLKNGWPLTTPDRDTYYGGDAHGYIDYAPYRA

SEQ ID NO: 7653 - protein, 130 aa, Zea mays
  misc_feature (9)..(9): Xaa can be any naturally occurring amino acid
  misc_feature (11)..(11): Xaa can be any naturally occurring amino acid
  misc_feature (15)..(15): Xaa can be any naturally occurring amino acid
GDADYLRYXGXQEFXQAMQHLEQKYEFMTSDHQYISRKHEEDKVIVFEKGDLVFVFNFHCNNSYFDYRIGCRKPGVYKVVLDSDAGLFGGFSRIHHAAEHFTADCSHDNRPYSFSVYTPSRTCVVYAPVE

SEQ ID NO: 7654 - protein, 478 aa, Bacillus cereus
MKRRVAIIGMVVAFLIGAGGMFAGMSVFGVNPSEVTQTISSGNASTAQGNLAKINEAYALIDSRYVEDVKDEKLVEGAIQGMLSTLKDPYSTYMDKETAKQFSESLDPELEGIGAEVNKTDGKLIIVSPIKGSPAEKIGIKPNDQILSVDGNSVKDLSREEAVLKIRGKKGTTVAIEIKRAGVTDPIVFKIKREKIPIFTVFSSVKQESGKDIGYMQITSFAENTAKEFKDQLKELEKKNIKGLVIDVRGNPGGYLNSVEDILGEIMTNKKPMLQVEQRNGEKKKFSTELKERKPYPISVLIDNGSASASEILAGALKEGEGYDLIGEKTFGKGTVQQAVPFKDGSNIKLTMFKWLTPDGNWIHKKGIAPTVEVKQPNYYHSTPIQIEKTLSYNSNDVQVKHAQEMLKSLGYVPGREDGYFSKETESALKAFQNANEMEATGQLDKKTAEAIQTKIIEKIRSGENDLQLQSALKLMAK

SEQ ID NO: 7655 - protein, 383 aa, Bordetella parapertussis
MNQEAENTKLFAPLSLRGVVLPNRVLISPMSQYSAVDGVVQDWHGYHVAGMARGYPGSVMLEVAAVTRDGRGTPGDLGIWSDEQIAGLAELARIIEAHGVVPAIQIGHAGRKASMQRPWEGGRPLALDSSDEAWQAVGASALPIQDGWPAPRQLAQRELAGLVDSFRAAAARAVQAGYRFVEVHAAHGYLLHSFLSPISNQREDLYGGSLENRMRFPLEVVAAVRAALPDEVPLSVRISAVDGVEHGWQLADSIVFARELKALGVDLVDCSSGGIQGSATAGKGPQAVKRGPGFQVPFAHAVRQEAGIATIAVGLIVEPAQAEAILRQEQADLIAIGREALQNPNWPLHARQALGADRDYSAWPAQYGWWLQRRPKVAWEEGR

SEQ ID NO: 7656 - protein, 335 aa, Agrobacterium rhizogenes
MTITPDIELGAYLLQRKIDPALASLIESIAASATVVADHLKEAAFQNHIGSAGTTNVQGEDQKLLDVLADRVFRETCGEAVSLAAYVSEEAEDVTWLKAPAAGDLILYVDPLDGSSNLEVNLSVGSIFAVSQVQADGDTNVLRKGRDYLCAGYAIYGPSTLFVITFGLGVVGFTLDPSDGQFKLTNARMRVPTETTEFAVNSSRQRFWDEPIRRYVDECLAGSAGPRGQDFNMRWTASMVADVHRILTRGGVFLYPADDSNRRAGGKLRLMYEANPMAFLIEAAGGAASTGTEDILRIQPQAHHQRVSVLLGSSNEIQRLVQFHQIHHSQEEIGS

SEQ ID NO: 7657 - protein, 470 aa, Staphylococcus aureus
MTKTLPEDFIFGGATAAYQAEGATNTDGKGRVAWDTYLEENYWYTAEPASDFYNRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYQGEIGVVHALPTKYPFDPSNPEDVRAAELEDIIHNKFILDATYLGEYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIKDGANVKGYFIWSLMDVFSWSNGYEKRYGLFYVDFETQERYPKKSAYWYKELAETKEIK

SEQ ID NO: 7658 - protein, 181 aa, Cryptomeria japonica
DDHGEVVAEMLRPDLEPYLGLHYPATDIPQASRFLFLKNRVRMICDCRAPAVKVRQDKRWCRSLSISGSTLRAPDGCHAQYMANMGSIASLVMAVTVSNSEEGGRRLWGLVVCHHATPRFVPYPLRYACEFLMQVFGVQLNKEVELAARLRERHILRTQTVLCDMLLRDAPVGIVTKTPNI

SEQ ID NO: 7659 - protein, 137 aa, Brassica napus
MALEAMNCPTNSSSFTAREDRNEPTDDLTNDAVFMEPWLKRKRSKRQRSGSPSSSPPRSRPKSQIQDLAEEEYLALCLLMLANNHHQPKRRPQESTTKLSHKCSVCGKAFPSYQALGGHKASHRIKPPTTTADDDST

SEQ ID NO: 7660 - protein, 251 aa, Arabidopsis thaliana
MVNATVARNIAGICGNVISLFLFLSPIPTFITIYKKKKVEEYKADPYLATVLNCALWVFYGLPMVQPDSLLVITINGTGLAIEVVYLAIFFFFSPTSRKVKVGLWLIGEMVFVGIVATCTLLLFHTHNQRSSFVGIFCVIFVSLMYIAPLTIMSKVIKTKSVKYMPFSLSLANFLNGVVWVIYALIKFDLFILIGNGLGTVSGAVQLILYACYYKTTPNDDEDEEDEENLSKVNSQLQLSGNSGQAKRVSA

SEQ ID NO: 7661 - protein, 91 aa, Bacillus anthracis
MVLDRNPVDYHSEIEQAAFGTGVLVDGMDFSDDKMLQGRTFSYSDTQRYRVGANYLQLPVNAPKAPVRTNQHRGQMDMRNPKESGEIRILL

SEQ ID NO: 7662 - protein, 319 aa, Gloeobacter violaceus
MSEPAEQPESVKGWTRLTRRRDVLDDPYIHRYQRRHFFFFDILPAIGTVAAVALSWVWPPGPIEGSLLLGLWLVTGFGVTVGYHRLFTHRSFSAAPWVQALLAVSGSMAGQGSVISWVALHRRHHELSDQPGDPHSPNLHGQDPVGRLRGLLHAHLLWMRQHEYPNVVCYASDLLRDRSLLQVNGLYLWWVLLGLAIPALVGWWLHGHVAGLLLGFLWGGAVRMFVLGNIIWSINSFLHSFGPRLFATREHSRNSGWLALASFGESWHNNHHAFPTSASFGLDWYRLDPGYWLIWLLARLGLAWDVKVPSEEQIRLKRA

SEQ ID NO: 7663 - protein, 579 aa, Unknown
  Nocardioides sp. JS614
MTHGPFDVWAPLPRRLRLAVAGETVAMRRGEGDWWTPAGPVPAGAELDYGYLVDDGEAPRPDPRSRRQPGGVHQLSRTFDPASYPWTDQAWTGRQLAGSVVYELHVGTFTPEGTFDAALEKLPHLREIGVDLVELMPVNAFNGTHNWGYDGVGWFAVHEGYGGPAGYQRFVDGCHAAGLGVIQDVVYNHLGPSGNYLPELGPYLKQGANTWGDFLNLDGPGSDEVRRYILDNVRMWLADYHVDGLRLDAVHALNDAGHQHLLEELAAEVAALSAHQRRPLTLIAESDLNDTRLVRPREAGGYGLDAQWSDDFHHAVHVALTGETAGYYADFEPLSALAKVCERGFFHDGTWSSFRGRDHGFPVDLRTMPTWRLVVCSQNHDQIGNRARGDRITEVLDDDQLACAALLTLCGPFTPMLFMGEEWAASTPFQFFTSHPEPDLGTATAEGRIAEFERMGWDPAVVPDPQDPATFERSKLDWAEATRGRHARMLDVYRRLARLRREHEALTDPSFGSVRCTADEHTRVFTMRRGDLLVAVNFGDAAATVETAAATLLFQTGAGLTLDAGRLSLPPHAGALVGP

SEQ ID NO: 7664 - protein, 330 aa, Gloeobacter violaceus
MLYLYLGSTMETDHFPAPSSKYLPGGKVRVTTANAHLQARYRSVGLVTLGIPALGTLAALGLLAFQPLRLLDVALLLGMYVLTVFGLEVGYHRHFAHGAFKASPPVRVTLAVLGGMAASGPLIYWAATHRLHHHFPDEPGDPHSPYLKADRPLERLPGLWHAHTGWMLDSEITNCALLARDLLRDLNVSRLNRRYYLWVLLGLLLPALVGGLASATWMGALQGLLWGGMVRIFLVHQLYIGALNSVCHLLGDRPFATGDLSTNNAWLALPTLGESWHNNHHAFCSSAVTGLEWWQIDPSGWCIRLLAAVGLVWEVKIPNQATIAARRQVR

SEQ ID NO: 7665 - protein, 318 aa, Oryza sativa
MASFAVSGARLGVVRAGGGGGGGGGPAARSGGVDLPSVLFRRKDSFSRGVVSCAGAPGKVLVPGGGSDDLLSSAEPDVETQEQPEESQIPDDNKVKPFEEEEEIPAVAEASIKVVAEDKLESSEVIQDIEENVTEGVIKDADEPTVEDKPRVIPPPGDGQKIYQIDPMLEGFRNHLDYRYSEYKRMRAAIDQHEGGLDAFSRGYEKLGFTRSAEGITYREWAPGAQSAALVGDFNNWNPNADTMTRNEYGVWEISLPNNADGSPAIPHGSRVKAPGEIPYNGIYYDPPEEEKYVFQHPQPKRPNSLRIYESHIGMSSP

SEQ ID NO: 7666 - protein, 370 aa, Ralstonia solanacearum
MSALFQPFSLRGLRLDNRIVISPMCQYSADQGQATAWHQTHLGALSLSGAALLMIEATAVSPEGRITPGCLGLWDDATEAALAGALAAIRPHAQTPIGIQIAHAGRKASSARPWEGGALLPPESGGWETIGPSALPQRPEERPPRTMTEADLARVREAFAATARRAVGLGLAAIELHAAHGYLLHEFLSPLANQRTDAYGGSRENRMRYPLEVFEAVRAAVPDDIPVGVRVSCTDWVEGGWTLADSVAFAQALRARGCDWVDASSGGVSPLQQIPLSSGYQVPFADTIRHQAGIPTIAVGLINEPHEAEAILAEGRADLVAMGRAFLYNPHWAWTAAADLGATIKAPPQYWRAFPRHAKNLFGETHFGAR

SEQ ID NO: 7667 - protein, 675 aa, Chlorobium tepidum
MAAVGQAAQPALLKPTPNQEEAARYIAQYLLQNHYRKVPVNDSLSQQIFKRYLDNLDNNRSYFTAPEVEKLRQEFGAHLADDFVSGNPADGFAIYNQFLKRAREKMAYMKNALEKTTFNFSSPETLELERSKTAPWPANEAELHDLWRKELKYQYLSAKYSGEKGKNIKSEVMKTLDNRLKIFNQQKPEDAFQAYMYAVTTSFDPHTDYFSPDEYENFQIDMSRSLEGIGAKLQMENEYTVVNEIIPGGPAFKSKLLKKGDKIVGVGQGDKGEIIDVIGWRINDVVKKIRGPKGTVVRLKVLPASQAGKGPAKIIRLVRAKVDLQEQAAQKKIIYDNGHKIGVIVLPSFYLDFEGERQQKHNYASTTKDVARIINELKQENVEGIIVDLRENGGGSLEEAVNVTGLFTGRGPVVQVSNALGGKMVLNDENYPMLYRGPLVVLVNRYSASASEIFAAAIQDYGRGLIVGDRTFGKGTVQSIVTIQRPFSMFMKQADLGQLKLTIAKFYRISGGSTQHIGVLPDIVLPSLIDPEVVGEDTYTSSLPWTTISRAAYTPLGFVTKEDIVLLKKEFAEQSAKDKLYQSYLADLATLNRIRQKKSVSLQEKGFQVENKTLKEIQDRWGDQNADTGKKKKTDFILQEAARILDDLVALKSRPAVPAAAPLARPAVRRAVPVK

SEQ ID NO: 7668 - protein, 1300 aa, Aspergillus nidulans
MACADETLTAAAAIIQNLVREAPSSGSPSFEFNFSPQSTNGVDSLPKLPGEPSLAKVRFENELEALVRRIHRMEVQSQQNHTQHAEHTQHLHKRRKSSKDTEPEILDESDGAASDEDEEEGATTLVREEDISYLRNYVQKQAEEISFQKNIITQVREELQLQEVQTRRALTKVENEDVVLLERELRKHQQANEAFQKALREIGGIITQVANGDLSMKVQIHPLEMDPEIATFKRTINTMMDQLQVFGSEVSRVAREVGTEGILGGQAQITGVHGIWKELTENVNIMAKNLTDQVREIAVVTTAVAHGDLSQKIESRAQGEILELQQTINTMVDQLRTFATEVTRVARDVGTEGVLGGQAQIEGVQGMWNELTVNVNAMANNLTTQVRDIATVTKAVAKGDLTQKVQANCKGEIAELKNIINSMVDQLRQFAQEVTKIAKEVGTDGVLGGQATVNDVEGTWKDLTENVNRMANNLTTQVREIADVTTAVAKGDLSKKVTANVQGEILDLKSTINGMVDRLNTFAFEVSKVAREVGTDGTLGGQAKVDNVEGKWKDLTDNVNTMAQNLTSQVRSISDVTQAIAKGDLSKKIEVHAQGEILTLKVTINHMVDRLAKFATELKKVARDVGVDGKMGGQANVEGIAGTWKEITEDVNTMAENLTSQVRAFGEITDAATDGDFTKLITVNASGEMDELKRKINKMVSNLRDSIQRNTAAREAAELANRTKSEFLANMSHEIRTPMNGIIGMTQLTLDTDDLKPYTREMLNVVHNLANSLLTIIDDILDISKIEANRMVIESIPFTVRGTVFNALKTLAVKANEKFLSLTYQVDNTVPDYVIGDPFRLRQIILNLVGNAIKFTEHGEVKLTICKSDREQCAANEYAFEFSVSDTGIGIEEDKLDLIFDTFQQADGSTTRRFGGTGLGLSISKRLVNLMGGDVWVTSEYGHGSTFHFTCVVKLADQSLNVIASQILPYKNHRVLFIDKGENGPEAENVLKMLKKLDLEPLVVRNEDHVPPPEIQDPSGKESGHAYDVIIVDSVNTARMLRTYDDFKYVPIVLVCPLVCVSLKSALDLGISSYMTTPCEPIDLGNGMLPALEGRSTPITTDHSRSFDILLAEDNDVNQKLAVKILEKHNHNVSVVGNGLEAVEAVKQRRYDVILMDVQMPVMGGFEATGKIREYERDSGLSRTPIIALTAHAMLGDREKCIQAQMDEYLSKPLKQNQMMQTILKCATLGGSLLEKSKESRISSSGEMHHVHTGPDGKSQRPGMEGRSITSSSATSRTLASTSAERTEQLSIDRSIVSTS

SEQ ID NO: 7669 - protein, 303 aa, Arabidopsis thaliana
MSISQFPPPASPSPASSSRSLASSSPSPGSFSSSMRLWRPAAQRNLRNQWSNLSNCRQQWIVACSAGRSHATLLVNSYLSQKYMPMMELGVLSDMFDIDKKALKKLFTQQSSYRIKLLSSYKEMVAVVVEMVNASRSLRCYTKLSTGSLIQFSGTKEDSNDAGDCGGIPVFNFWNVSAFEKMAEELVEMFKREVMLKRLLIMELISLSTEVPQPINNSWSDELYHGEFDHLTKCSLYSMEVAKPVLPRVKDYNIGSSSISHTNQPTAEILQIYLTTWLAEVNIDTHRVDEILALVGEEIRVTF

SEQ ID NO: 7670 - protein, 700 aa, Ustilago maydis
MYASSVRRSANFTLANGAQIPKLGFGTWKMSKEQATPAVAHAIKTGYRHIDCAWAYRNEDAVAAGIKKAGVPRSQLWLTSKLWNSFHHPEHVEKALDASLKDLGTDYLDLYLMHWPVAFLNSKGSMVPSIRSTGGHPVESEDLSRDFMATYRVMEEMVKKGKVRNIGVSNFNIRRTSEVVDEASIKPVVNQVEVNLGVHNEELRNYAHAHGVTLQAYSPFGSNQNVAKSLEDPVVVDVAQRNNITPAQVLLAWTLGRDIIPISKSVTPERIEENFRVLDIQLAEEEIKHLTNEALSRPIERTVDPTEGWGVADEIFEDGVDQTREMELKGGSYVPPPAHESPAEHRLEPRNDPETPARMLHTAAHPLASSSRSTLVSRRRTAVQAKSSSSFFRGFATTSRVAAVAEVAPPSASEAPAVSESALLRTTSKSALATPGLKFLDGEQRIERETKKMNMYTVRRMSTSTTTQASVRASARVTATSSAVKPTTRKYPAKKSFLYEKYLRLLSDSQMVLVLQHNNLSVAELAQVRSDIAAINLAEGQTSKASLTVVRAGLIKAVTRQLSEKNAAMKSLQPALSGPIALLTCEHLTPAYLSALLNVVDRALGHVPPRAPAVGAKFPETAVANPRLVPLAAVLEGKRLLHVPQTRDVGRIGGLDQLRSQIVGLLSAPAQQLAHVLTHASGQQLAMTLEARKRDLEAKQ

SEQ ID NO: 7671 - protein, 161 aa, Escherichia coli
MKNKSGNSYYREAVDIHSSLELSFILHKYHLRVDEKKSRNVFSAIRDELILDGDSRQNLATFCQTWIDDEIRELLNLSIDRNMIYKDEYPQMAEPEGRCVRMLSDSWSFPDSRHTLGCSTIGSSEAAMLGRLALKWQWCKKREVQGKSTEPDLRSCANMLA

SEQ ID NO: 7672 - protein, 184 aa, Brassica napus
  misc_feature (129)..(129): Xaa can be any naturally occurring amino acid
MTTIYGTNPTAANDLAPKLEYITRTNNQHHVRPGLATRRPWKQMLDLRSFHFPRKIASVITRIKTNVVYFQTNYTIVVLFSVFLSLIWKPFALLILLALIGAWLFLYFLRDEPLTVFDREIDHRVVLIXMSVLTLSVLFLTDAKLNIAVAVVVGVVVVLLHAAVRKTEEINQNEDETSPLLPQV

SEQ ID NO: 7673 - protein, 736 aa, Rhodopirellula baltica
MNSQLSLSTIQSLVDGSVANPGSLLGRHPVNYRGREATSVRVLEPNAESVWLIDSASGLRRPMRRLHPGGFFEAICDEPITKPSTSRLQMIDKTGKEIKTTSPYTVPSIFSDLDRYLIGEGRHNQLYERLGAQLREVDGVKGVNFAVWAPNARSVQVVGDFNGWDGRGHVAQPVESTGIWELFLPGATVGQKYKFRIQTQHGHWMDKCDPMAFAAELPPLTANIITDINTYSWNDSDWLQQRAEMDPMHTPMNVYEVHLGSWQKGPGRTHGWLDYRDLAKRLVDYCHRMNFTHVELMPISEHPFTGSWGYQSVGYYAPTSRHGSPEDFMFFVDHMHQNGIGVLIDWVPAHFPKDDHGLRQFDGSALYEHADPRQGEHPDWGTMIFNFGRNEVKNFLIANALFWLDKYHIDGLRVDAVASMLYLDYSREDGEWIPNRYGGRENLESIDFLRDFNIAVHENHPGVITAAEESTAWPGVSRPTYDGGLGFTYKWNMGWMNDTLSYMRNEPIHRKFHQNELTFSLIYAFTENFTLPLSHDEVVHGKGSLISQMPGDMWQKFANLRLLYSYMWTHPGKKLLFMGGEIAQWTEWNADDGPQWELLDFDTHRGVQQLVADLNKVVIENPALHWHDFTGDGFEWIDAHNAEDSVLVYLRKGAEGDPPILVCNNFTPVPRDNYRVGVPAQGFWKEIFNSDGEAYGGSNLGNYPGCQTTGIEHHARPDSIEVTLPPLGTTILRLES

SEQ ID NO: 7674 - protein, 310 aa, Bacillus anthracis
MAENQDKNSLEEQDVKRETLTTRQGHPVKDNQNIRTIGNRGPATLENYHFIEKISHFDREEVPERVVHARGAGAFGYFETYGKVGDEPAEKYTRAKVFSGAGKKTPLMVRFSTVAGAKDSPETARDPRGFAVKMYTEDGNWDLVGNNLKIFFIRDAMKFPDMIHAFKVDPVSNVSNPQRMFDFVSRTPEATHMITFLFSPWGIPATYRHMQGSGVNTYKWVNEKGEAVLVKYHWEPKQGIRNLTQEDANSIQAMNVSHATQDLYEAIERKDYPEWELFVQIMEDGYHPELDFDPLMIRSFGQRSSSHGYQ

SEQ ID NO: 7675 - protein, 187 aa, Cryptomeria japonica
DEHGEVVAEIRRSDLEPYLGLHYPATDIPQASRFLFMQNRVRMICDCRANPVGVIQVEELKQPLCLVGSTLRAPHGCHAQYMANMGSIASLVMAVIVNGNGNDEEGSSGRVKLWGLVVCHHTSPRAVPFPLRSACEFLMQTFGLQINMEMQLAAQLTENNILRTQTLLCDMLLRDAPIGIVTQSPSI

SEQ ID NO: 7676 - protein, 192 aa, Cryptomeria japonica
DDHGEVISELRRSDLEPYLGLHYPATDLPQASRFLFMKNKVRMICDCQATPVKVVEDKRLPRELVLCGSTLRAPHGCHAEYMSNMGSVASVVIAVTINAKEEDGDTDGQQRQQKGRRLWGLVVCHHTSPRFVPFPMRYACEFLMQVFAIQLNKEVELADQLREKHILRTQTLLCDMLLRDAPMGIIREKPNI

SEQ ID NO: 7677 - protein, 235 aa, Matricaria chamomilla
MIRNNAFDSDFALLESVRRHLLDDNAPPMSCRSNNFLFPHLSDSWGELPLQQNDSEDMLIAKFLNEALPLQQNDSEGIITPEMTSSSENIFFVKSEPETSSFQPKSLGSQKGKHYRGVRRRPWGKYAAEIRDPAKNGARVWLGTYETAEDAAVAYDMAAYRMRGSRALLNFPLRINSGEPEPVRITSKRKTTSPSEGLVVKKVKVELEMSTQAEFPLVYGCYYCVILGPFLVKCF

SEQ ID NO: 7678 - protein, 667 aa, Desulfovibrio vulgaris
MPNLRIIVVDDEQIVALDLRRTLEGLGYIVPAVETDADGAIDAAKRLRPDLVLMDIRLRRGDGVDAAHVITNQFDIPVVFLTAFSDEATLSRAMKAGPFGFLVKPFAERELYSTIEVALLKHRAVREIDEARQAAEHASLAKTSFLAGMSHEIRNTLNGIVGMTELVLDTPLSGEQRESLNTVLASSETLLTLLHDVLDFSRLEARQLRLVERPFSLDRLLKQVVQASRSEAERKNISLDFRVTPDVPDRLTGDATRLTQVLANLVGNAVKFTHKGSVIIEVSAIPQDQTLLESLFPDGPPSSLTLLFSIRDTGIGIADEHLRTIFEAFSQGAEETVQRYGGTGLGLAICRNLVEIMGGSIWARSSEGQGSSFHFTCRLRPETPAINTPSEHAQAPTSSATPASGARPLRVLVVDDDATGRTITCKMLRKRGHVCACAHDGATALQRLTADRFDLVLLDVKMHPMGGLELLRRIRNAQYPGVDRNIPVVAVTAHALKGDRERFLASGMTDYIAKPINARAFNAMLDRFALSASSARDIPVIPDRSALLAPSEVVRRHGGDHNLVEPVWKAFCDEAPRHFALLAGALEEGDAQQAARFNKRLRLASEHAGAVALAMLTERVGLCLVEDDTAGARQLVPRLESLLSRTIGLILSGMGTTEVPPIEHTTD

SEQ ID NO: 7679 - protein, 505 aa, Staphylococcus aureus
MSQQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAERDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKFHFRTQQGIENLTDEEAAEIIATDRDSSQRDLFEAIEKGDYPKWTMYIQVMTEEQAKNHKDNPFDLTKVWYHDEYPLIEVGEFELNRNPDNYFMDVEQAAFAPTNIIPGLDFSPDKMLQGRLFSYGDAQRYRLGVNHWQIPVNQPKGVGIENICPFSRDGQMRVVDNNQGGGTHYYPNNHGKFDSQPEYKKPPFPTDGYGYEYNQRQDDDNYFEQPGKLFRLQSEDAKERIFTNTANAMEGVTDDVKRRHIRHCYKADPEYGKGVAKALGIDINSIDLETENDETYENFEK

SEQ ID NO: 7680 - protein, 497 aa, Zea mays
  misc_feature (280)..(280): Xaa can be any naturally occurring amino acid
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPXDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 7681 - protein, 192 aa, Cephalotaxus fortunei
DDHGEVISEIRKSDLEPYLGLHYPATDIPQASRFLFMKNRVRMICDCYAPPAKVVEDKRLPRELNLCGSTLRAPHGCHAQYMANMSSIASLVMAVIINEKEEEQGESDGQQQQKGRRLWGLVVRHHTSPRFVPFPLRYACEFLMQVFGIQLNKEVELAAQLKEKHILRTQTLLCDMLLRDAPVGIVTQKPNI

SEQ ID NO: 7682 - protein, 317 aa, Gloeobacter violaceus
MDAKPIFSQATSKGPRKTLDSARLKNHQRLHAVAVSSLSLLGCLAALALVCLGRPPGAVEVGLFLGGFLCTGFGVNIGLHRHFTHRSFQAVTPVRVALAILGSMAAQGPVIFWVALHRLHHEFSDQPGDIHSPHFHGEGWWGSVRGLWHAHVGWTFDHAVPNAAYYAGDLLRDRAIAPISRTYFFWVFLGLLIAAVLGGVLTGTWMGVLTGFLWGGPVRIFCWHNMIWSITSCAHFFGERPFDADDRSTNNFWFAIPTLGESWHNNHHAFPNAAMAGLEWWQIDPSGWVIRALEKLGLVWDVKIPTQAMRRAKARAI

SEQ ID NO: 7683 - protein, 332 aa, Gloeobacter violaceus
MSSPFERAMQSNPPASPLPWQKTIIKSTAAVRNAQRMHALAILSLPAVATAAAAAIALRSGLGLLELGLFLGMYTLTMVGGITVGFHRHFTHCAFQAHPVIRVLLAVLGSMACEGPLIYWVSNHRRHHQYSDRPGDVHSPYIRAQTPLGGLRGFWHAHIGWTFDHDLTNATIFARDLIRDPLIARVSRLYYLWAALGLLLPALLGAWWTRDTNGALLGLLWGGGVRLFCSYHFTNSINSVTHLFGSRPFETGERSTNNPWLALPTGGESWHNNHHAFPNSAVFGLQPWQPDPGAWLIRLLEKLGLAREVKVPSQALIAAKAVRPQPTRSHAG

SEQ ID NO: 7684 - protein, 433 aa, Arabidopsis thaliana
MELTLKLLVLLLFILNHHVGSGSIVKFLPGFEGPLPFELETGYIGIGEEEEVQLFYYFIKSERNPKEDPLLLWLSGGPGCSSITGLLFQNGPLALKSEVYNGSVPSLVSTTYSWTKTANIIFLDQPVGAGFSYSRAPLIDTPTDTGEVKRIHEFLQKWLSKHPQFSSNHFYAGGDSYSGMIVPALVQEISKGNYICCNPPINLKGYVLGNPITHEDDPNYRIPFSHGMALISDELYESIREACKGNYFNVDPRNTKCLKLVEEFHKCTDKLNEFHILSPDCDTASPDCYLYPFYLISFWANDESVRDALHVNKRSIGKWERCNYLSKPYNKDIKSSVPYHMNNSVSGYRSLIYSGDHDLVVPFLATQAWIKSLNYSIIDEWRPWMIRDQITGYTRTYSNKMTFATVKGSGHTAENKPQESFIMFRRWINGQPL

SEQ ID NO: 7685 - protein, 425 aa, Synechococcus elongatus
MAFSNRKLIAGICASAIATVAVVGAGNHWARGQALFQESPKEIIDEVWQVVDRNYVDSVGTFDRNKWRQLRREYLARNYKTREEAYSAVKEMLKTLGDPYTRFMDPDEFKDMQIDTSGELTGVGIQLSQDPDTKELIVVSPIEGSPAAAAGIRSRDVIVKIDQKTTQGMSSDEAVKLIRGPVGSKITLTIRREKETIAFPIVRERIEIHSVSARVQESPTGPVGYIRLRQFSANSAPEMRQAIKDLEAKNVKGYVLDLRSNPGGLLYASIDIARMWLPKGVIVSTKDRSGISEQASANNRALTDKPLVVLVDGGSASASEILSGALQDNNRAVLIGSKTFGKGLVQSVRPLGDGSGLAVTIAKYLTPSGRDINKQGIEPNIVAELTDAQREDLSKNQDQIGTASDPQFQSALKVLTQQIATASNK

SEQ ID NO: 7686 - protein, 423 aa, Aspergillus oryzae
MADLRGRKIFKVFNQDFIVDERYNVTKELGQGAYGIVCAATNIQTGEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSIDPEENAGYMTEYVATRWYRAPEIMLSFQSYTKAIDVWSVGCILAELLGGRPFFKGRDYVDQLNQILHYLGTPNEETLSRIGSPRAQEYVRNLPFMPKIPFQRLFPSANPDALDLLDRMLAFDPSSRISVEEALEHPYLHIWHDASDEPTCPTTFDFHFEVVDDVQEMRRMIYEEVVRFRAAVRQQSQAQAAAAAQQQQIAQQTNVPIPENQQGVWKQEEPKPQEALAAGGGVHNDLESSLQRGMDVQ

SEQ ID NO: 7687 - protein, 373 aa, Oryza sativa
MVGGGALRRVGKYEVGRTIGEGTFAKVKFAQNTESGESVAMKVVDRSSILKHKMADQIKREISIMKLVRHPNVVLASRKKIFIILEFITGGELFDKIIRHGRLNEADARRYFQQLIDGVDFCHSKGVYHRDLKPENLLLDSQGNLKISDFGLSAWPAQGGALLRTTCGTPNYVAPEVLSHKGYDGALADTWSCGVILYVLLAGYLPFDEVDLTTLYGKIESAEYSFPAWFPNGAKSLIHRILDPNPDKRIRIEEIRNDEWFKKNYEPTREIESEEVNLDDVNAAFDDPEEDADHTLDDEAGPLTLNAFDLIILSQGLNLAALFDRRQDYDKLQNRFLSRKPAKVIMSSMEVVAQSMGYKTHIRNYKTYRHEDL

SEQ ID NO: 7688 - protein, 365 aa, Cryptococcus neoformans
MADFVKLSIFGTVFEVTTRYVDLQPVGMGAFGLVCSAKDQLSGTSVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAVDIWSTGCIFAEMLEGKPLFPGKDHVNQFSIITELLGTPPDDVIQTIASENTLRFVQSLPKREKVPFSTKFPNADPVSLDLLEKMLVFDPRTRISAAEGLAHEYLAPYHDPTDEPVAAEVFDWSFNDADLPVDTWKVMMYSEILDFHNLGDISQNEAEGPVTGEVPAAPAS

SEQ ID NO: 7689 - protein, 274 aa, Bacillus clausii
MKMVTLNNGVNMPQLGFGVWQVPDEEATPAVAKALEVGYTSIDTAMIYKNEAGVGKAIKESGIDREKLFITTKVWNADQGYEQTLKAFDASLERLGLDYIDLYLIHWPTPHYDQYIETYKALEKLYNDGRVRAIGVCNFDIDHLERLLDECDITPVLNQVECHPYFAQNELKDFCAKHNIYVEAWSPLDQGGEVLTDEVVEKIAKAHNKTTAQVVLRWHLQNNTIVIPKSVTPSRIEENFDVFDFELSDEEMDAINRLDRNQRRGAKPSEMNTR

SEQ ID NO: 7690 - protein, 282 aa, Staphylococcus aureus
MNHIEISKDVKIPVLGFGVFQIPQEQTAEAVKEAIKAGYRHIDTAQSYLNETEVGQGIEASGIDRSELFITTKVWIENVNYEDTIKSIERSLQRLNLDYIDLVLIHQPYNDVYGSWRALEELKETGKIKAIGVSNFGVDRIVDLGIHNQIQPQVNQIEINPFHQQEEQVAALQQENVVVEAWAPFAEGKNQLFQNQLLQAIADKYNKSIAQVILRWLVERDIVVLAKSVNPERMAQNLDIFDFELTEEDKQQIATLEESNSQFFSHADPEMIKALTSRELDV

SEQ ID NO: 7691 - protein, 193 aa, Cephalotaxus fortunei
DDHGEVISEIVRSDLEPYLGLHYPATDIPQAARFLFMKNRVRMICDCGAPPVRVVEDKRLPREVSLCGSPLRAPHGCHTGYMTNMGSIASLVMAVVIDEKEEGGGDTNGQHEQKKGRRLWGLVVCHHTTPRFVQFPLRYACEFLMQVFGIQLNKEVDLAVQLREKHILRTQTMLCDMLLRDAPLGIIRQKPNI

SEQ ID NO: 7692 - protein, 181 aa, Chamaecyparis lawsoniana
DDHGEVVAEMRRPDLEPYLGLHYPAADIPQASRFLFLKNRVRMICDCRAPAVKVRHDESLGQVLSLQGSTLRAPFGCHAQYMANMGSIASLVMAVTVSDSEEGGRRLWGLVVCHHTTPRFVPYPLRYACEFLMQVFGIQLNKELELASRLRERHIFRTQTLLCDMLLRDTPVGIVTTTPNI

SEQ ID NO: 7693 - protein, 476 aa, Bacillus anthracis
MQNKIIVMFQKDFRLYDNPALFEAAQSGEVVPVYVHDETFSMGSASKWWLHHAIIDVKKQLEALGSTLIIRKGSTQEEILSLVEQLGITAVYWNICYDPDRLQSNQKMKMMLEHKGMICKEFNSHLLLEPWVIKKKDNTEYKVFTPFYNAFQKQVIHKPISKVQSIKGGNSLPVSLSVSELHLLPTIPWTSHMESIWEPTEEGAYKTWKEFFSSKLASYSEGRDFPNQNAHSMLAPYLSFGQISVKLIYHYLINKSTESQCSLFEKQVNSFIRQLIWREFSYYLLYHYPFTAYKPLNKSFEHFPWNNEEELLRVWQKGDTGYPFIDAGMRELWQTGFMHNRTRMAVASFLVKHLLIPWQEGAKWFMDTLLDADIANNTMGWQWVAGSGADASPYFRIFNPITQGEKFDKNGEYIRKWVPELKDMPNKYIHKPWEAPEHILQKANIQLGHTYPLPVVDHKAARERALCAYKSMKEFV

SEQ ID NO: 7694 - protein, 683 aa, Photorhabdus luminescens
MNKFVRLAFVLGVSIFGTCYANTNSPVAVPVGIEQLPILKQEPQHSTVSERVTSRFTRSHYRQFDLNGDFSAKIFDRYLNILDYSHNILLASDVAQYADKKKLLGKELENGNLEIPYDLFNLLQKRRFERYQYALSRLEQPMSFDGNDTIDVDRSKAPWPQSVEELNKLWDAKVKYDWLNLKLSGKEDNKIKEMLTKRYQSALKRLTQSQSEDVFQLIMTAFAREIDPHTNYLSPRNTEQFNSEMSLSLEGIGAVLQIDDDYTVINSLVAGGPAAKSKALNVGDKIIGVAQSGKSMVDIIGWRLDDVVALIKGPKGSKVRLEVVSDTKGAKPRTVILTREQIRLEDRAVKMSVKTIGQEKVGVLDIPGFYVGLTDNVKTQLQKLTKQHVSAIVIDLRSNGGGALTEAVSLSGLFLPSGPVVQVRDNNGKVRQDSDTDEVVYYKGPLVVLVDHFSASASEIFAAAMQDYGRALIVGEPTFGKGTVQQYRSLSRIYDQMMRPDWPSLGSVQYTIQKFYRVDGGSTQRKGVTPDIVMPTGVDPAETGESFEDNALPWDSIPPARYTGSKVIAALVPQLNVVHNIRITTDPEFKYINEDIAHYKALKEHKNIVSLNYAQREKENKEADALKLNRINDRFKREGKKPLTSLDDLPKDYQGPDPYLDESVKIALDLAHQPAEKMLAKSK

SEQ ID NO: 7695 - protein, 184 aa, Idiomarina loihiensis
MSRHFDEAKGLSEQHDPATHDFVFNQTMFRIKDPERTLKFYSEVLGMTLVKRFDFPEMEFTLYFMAAMSPEQRKGWSTDHDKRIEQTFGRPAMLELTHNWGDENDDSVSYHSGNEEPKGFGHIGFAVPDIDAACERFEKMGVEFQKRPNDGKMKGIAFIKDSDGYWIEIFTPDRQPELLKEHLK

SEQ ID NO: 7696 - protein, 157 aa, Triticum aestivum
  misc_feature (85)..(85): Xaa can be any naturally occurring amino acid
  misc_feature (119)..(119): Xaa can be any naturally occurring amino acid
  misc_feature (124)..(124): Xaa can be any naturally occurring amino acid
  misc_feature (127)..(127): Xaa can be any naturally occurring amino acid
  misc_feature (132)..(133): Xaa can be any naturally occurring amino acid
  misc_feature (151)..(153): Xaa can be any naturally occurring amino acid
  misc_feature (155)..(155): Xaa can be any naturally occurring amino acid
HIETYDVTTIRASTPMFLMSRKIKSLGVKMVLSGEGSDEIFGGYLYFHKAPNKKEFHEETCRKIKALHLYDCLRANKATSAWGLXEARVPFLRQKLHQMYNGPGFRNPKMIRRDLGRIXKWVCXKAXDDDEXXYLPKHIFTGKKTFNHGVXXXWXDG

SEQ ID NO: 7697 - protein, 769 aa, Xanthomonas campestris
MRERAAGLRAWSILAVLAALAAALGAGLQWSSLQGPWRAVSAVSAVLAVVCGLCAALAAHRAAQAQHALAQRLEEADLARERLQQELRRHGELEQELLRAKQAAEAATLAKGEFLATMSHEIRTPLNGIIPMLELISSGQLSVDQRDMLQTATGSSLQLLRIVDDILDYSKLEANKLELEITTFNLRELLDGVIQLLQRTAEGRQLRLSLDIEPSVRLLVRGDPIRLRQVLGNLIGNAIKFTERGSVDIQLRRLGETRAQHLLRFQVRDTGIGIAPDQQARLFRSFAQADASTTRLYGGTGLGLAICKRIIDLMGGRIGVESEPGRGSTFWFEIPLLKVIGDLQQATGADAARVMVISSDARLSQRLKRLLDSWGVSHVLMETTQEALERVRRHNDSEGFRCVIADHDTLRYSARAVHRALARPENANSARLIWLYGEEPVPAELQDHATLVPRQSPDETLRALVLPPEPKPAHVTTLASAMIPEPLPPPMANAREVRILLVEDNPVNLLVAQKLLAVLGFEADTATDGEAALASMESTRYDMVFMDCQMPVLDGYAATRRWRAMETESGGRPIPIVAMTANAMAGDRERCLAAGMDDYLSKPVAREQLDACLQRWLPRQALLPGPSSAGQATHDPESASAAAQARALPILDNNVIDELYEVAGADTITILQLFLEDAPLIIEQLEAAAANRDSMQLRDLAHTLKSSSANVGAQAVSNAARRIELAARTGTIERPSVMVALVIAEYARARLALLGQVARLQAAASTTNQ

SEQ ID NO: 7698 - protein, 426 aa, Hordeum vulgare
SKANRFTVMAAENIDEKRNTDKWKGLATDISDDQQDITRGKGIVDSLFQAPTGDGTHEAVLSSYEYVSQGLRKYDFDNTMGGFYIAPAFMDKLVVHLSKNFMTLPNIKIPLILGIWGGKGQGKSFQCELVFAKMGINPIMMSAGELESGNAGEPAKLIRQRYREAADMIKKGKMCCLFINDLDAGAGRMGGTTQYTVNNQMVNATLMNIADAPTNVQLPGMYNKRENPRVPIVVTGNDFSTLYAPLIRDGRMEKFYWAPTRDDRIGVCKGIFQTDNVCDESVVKIVDTFPGQSIDFFGALRARVYDDEVRKWVGSTGIENIGKRLVNSRDGPVTFEQPKMTVEKLLEYGHMLVQEQDNVKRVQLADTYMSQAALGDANQDAMKTGSFYGKGAQQGTLPVPEGCTDQNAKNYDPTARSDDGSCLYTF

SEQ ID NO: 7699 - protein, 671 aa, Unknown
  Parachlamydia sp. UWE25
MNKNWLKIWFVTLMTILVSLEAREQDLLKSSDIDRIMSQILSQHVDKRTMTSKILNSSIAIFINQFDPERIYLLESEIAPYAHLTQKQLDELVEQYKQNNFEFFEQINKVFQNAIERSKKLRHEIEIKDKEALFQTTRPSVQRIEERSFAKDEKELKKRLLENLENFISLYKSRHGELSTSSKKEFVLKTYENHLTEFENQYLYQDDQGKPLSYAQQDNLLTIHILKALASSLDSHTTFYQTHEAYDMKVRLQKEFQGIGLVLRDQGDKIIVSRMLEGGPAAKSGVIQAGDILLGVDGIPTEKLSFDKVMEMLHESKQAQVELSFKRKKKDEIEDKIFKVELQKEEIVLNNNRVDVSEETFGNGIIGKITLHSFYQGNGISSEKDVRDAIIELEKKGNLRGLILDLRENSGGFLSQAVKVAGLFITNGVIVISKYSTGEERFYRDVDGKIAYDGPLVVLISKATASAAEIVAQALQDYGVAIVVGDEHTYGKGTIQTQTVTDDQSTSYFKVTVGKYYTVSGKTPQKNGVKADVIAPGPWSLKNIGEVDSSSLTSDFISDAYEDNLSDIAPDVKSWYLKYYVPTIQKRTDQWKDLIPTLRKNSEYRLAHNKNYQLFLKGKALDLENEEQDEESEWLSTGKKAKNFGVDDLQMQEAVNVIKDMIVLYSIEKKK

SEQ ID NO: 7700 - protein, 412 aa, Brassica napus
  misc_feature (216)..(216): Xaa can be any naturally occurring amino acid
MSSSDNLTDKTAVFRKLKSKSDNKVCFDCSAKDPTWASVTYGIFLCIDCSATHRSLGVHISFVRSTNLDSWSPEQLRTMMFGGNNRAQVFFKQHGWTDGGKIEAKYTSRGAARPRQLLAKEVAKAIAEDAAIALPSSPLAAEGSNGVSSFSVKEELPPKESFTVKQEATSSPKASNTVVPSTFKKPIGAKRTGKTGGLGARKLTTKPTGNLYEQKXPEEVAPVIPAATSTNNGGSKSSGGSSSYAASRFEYNDDFQSGGKSIGGTQVLNHVAPPKSSSSFSDFGMDSYVPKKSSSNSSKAQVEESDEARKKFTNAKSISSAQYFGDQNKNADLESKATLQKFSGSASISSADFFGHDQDDSNDDITASDLINRLSFQAQQDISSIVNIAGETKKKLGTLASGIFSDLQDRML

SEQ ID NO: 7701 - protein, 415 aa, Arabidopsis thaliana
MSKAWKLKLLLLLQLLLLSQHDVDSASVISYLPGFEGLLPFHLETGYIGVGEGEKVQLFYYFIKSENNPEEDPLIIWLTGGPACTALSALAFEIGPLTFKTEGYNGGLPSLVSTSYSWTKVASIIFLDQPVGTGYSYSTTPLSYKPSDTGEAKQTYEFLQKWLVENPQFVSNPIYVGGDSYAGIVVPAIVQQISIGNEHGYKPQINLKGYILGNPSTDLDSDHNSKIPYAHRMGLISDELYESLKRTCQGNYVKVDPTNTKCLKLMEDYGKMYRYLLASHWANDEDVRRELHVVKGSIGKWMRCNWDLPYEKDIKSSVPYHRNNSIIGDYRSLVYSSDHDMMVPYIGTEAWIKSLNYSITDDWRPWFVNNQVIGYTRTYANNMTFATIKGGGHTAEYKPEESFMMFQRWISGRPL

SEQ ID NO: 7702 - protein, 284 aa, Streptococcus agalactiae
MTDTMILNDNHKIPTLGLGTWMIDNDRVAQVVKDAIELGYRHIDTAQAYNNEKGVGVGIKESGITRESLFVTTKIAAEHKDYESATKSIDQSLEALGLDYIDLMIIHSPQPWKEWRETDKHFDQGNLEAWRALEDAQKSGKMKSIGVSNFLEKDLENILKNGHVKPAVNQILAHIGNTPFDLIDYCQSKGIQVEAYSPIAHGQALKSDGIQKMAEKYGVSVAQLCIQYLLQLNLIVLPKASSKEHLQSNLDFDFVISDEDMSILKSLMFDDYGEFSNFPVFSGK

SEQ ID NO: 7703 - protein, 461 aa, Oryza sativa
MVNGEAEAECTRASLLGRYEIGRTLGEGNFGKVKYARHLATGAHFAIKILDRNKILSLRFDDQIRREIGTLKLLKHPNVVRLHEVAASKTKIYMVLEYVNGGELFDKIAVKGKLSEHEGRRLFQQLIDAVSYCHDKGVYHRDLKPENVLVDRRGNIKISDFGLSALPQHLGNDGLLHTTCGSPNYIAPEVLQNRGYDGSLSDIWSCGVILYVMLVGYLPFDDRNLVVLYQKIFKGDTQIPKWLSPSARDLLRRILEPNPMKRINIAGIKEHEWFQKDYTPVVPYDDDDDNYLDSVLPIKEQIDEAKQEKPTHINAFQLIGMASALDLSGFFEEEDASQRKIRFTSTHSPKDLFDKIENVVTEMGFQVQRGNSKLKVMKNGRGSKNLRNPSSFLVCTEVVELGPSLYVVELKKSHGDPILYRQLCERLSDELGVCKTEQIQRTESLEDDLESFDSGSSLPGF

SEQ ID NO: 7704 - protein, 166 aa, Oryza sativa; identical to SEQ ID NO: 138

SEQ ID NO: 7705 - protein, 404 aa, Oryza sativa
MEGKGVLEGRYEMGRVLGHGNFGRVHAARDVRTGRAVAMKVVSKDKVERAGMAEQIKREIAVMKMVSHPSVVELHEVMATRTKVYLALELVRGGELFDRIARHGRVGEGVARRYFRQLVSAVDFCHGRGVYHRDLKPENLLLDEAGNLKVADFGLSALACHARPDGLLHTACGTPAYVAPEVLAGNGYDGAKADLWSCGVILYVLLAGALPFQDDNLVCMYRKMRRGDFCCPPWVTTDARKLIKSLLDPNPGTRITVAGLLETPWFRKTAPVPRPIIADPAAAPVDTRGNAGDDKDEPPEVLNAFHLISLSEGFDLSPLFEHDPAASPGRATARAGGTRFATREAASGVVARLEALAMGGARVAPSLLMVDVKKDGGDAMEYRPFFSEELRPALKDIVWSPAAT

SEQ ID NO: 7706 - protein, 461 aa, Oryza sativa
MVNGEAEAECTRASLLGRYEIGRTLGEGNFGKVKYARHLATGAHFAIKILDRNKILSLRFDDQIRREIGTLKLLKHPNVVRLHEVAASKTKIYMVLEYVNGGELFDKIAVKGKLSEHEGRRLFQQLIDAVSYCHDKGVYHRDLKPENVLVDRRGKYQISDFGLSALPSHLGNDGMLHTTCGSPNYIAPEVLQNRGYDGSLSDIWSCGVILYVMLVGYLPFDDRNLVVLYQKIFKGDTQIPKWLSPSARDLLRRILEPNPMKRINIAGIKEHEWFQKDYTPVVPYDDDDDNYLDSVLPIKEQIDEAKQEKPTHINAFQLIGMASALDLSGFFEEEDASQRKIRFTSTHSPKDLFDKIENVVTEMGFQVQRGNSKLKVMKNGRGSKNLRNPSSFLVCTEVVELGPSLYVVELKKSHGDPILYRQLCERLSDELGVCKTEQIQRTESLEDDLESFDSGSSLPGF

SEQ ID NO: 7707 - protein, 130 aa, Zea mays
GDADYLRYHGMQEFDQAMQHLEQKYEFMTSDHQYISRKHEEDKVIVFEKGDLVFVFNFHCNNSYFDYRIGCRKPGVYKVVLDSDAGLFGGFSRIHHAAEHFTADCSHDNRPYSFSVYTPSRTCVVYAPVE

SEQ ID NO: 7708 - protein, 190 aa, Blechnum spicant
DEHGEVVAEIRKSDLEPYLGLHYPATDIPQASRFLFMKNRVRMISDCLAIPVKVIQDRELRQPLSLAGSTLRAPHGCHSQYMANMGSAASLVMAVTVNDNEEASSSRNHQPKQRKLWGLVVCHHTTPRAVSFPLRSACEFLMQVFGLQLNMEVELAAQMREKHILRTQTLLCDMLLRDAPIGIVSESPNI

SEQ ID NO: 7709 - protein, 459 aa, Zea mays
MEKKPTILMNRYELGRTLGQGTFAKVYHGRNLASGESVAIKVIDKEKVMRVGMIDQIKREISVMRLVRHPNVVQLHEVMASKSKIYFAMEYVRGGELFARVARGRLKEDAARRYFHQLVGAVDFCHSRGVYHRDLKPENLLVDEHGNLKVSDFGLSALRECQKQDGLLHTTCGTPAYVAPEIINKKGYDGAKADIWSCGVILFVLLAGYLPFHDANLVEMYRKISRADVKYPQWFSPELRRLMPKLLEPNPNNRITIEKLVEHPWFKKGYRPAVMLAQPHGSSSLKDVQVAFSNADHKDSSSKVEQPADSSLKPASLNAFDIISHSRGFDLSSLFEVDQEQKASNSRFMTQKPASAIVSKLEQIAETERFMVKKQDGLVKLQGSKQGRKGQLAIDAEIFEVTPAFHVVEVKKSAGDTLEYEMFCSKGLRPSLSDICWSSRSEENMAPSVVQPSQLEPSS

SEQ ID NO: 7710 - protein, 188 aa, Blechnum spicant
DEHGEVVAEIRRADLEPYMGLHYPATDYPQAARFVFMKNRVRMICDCTLPPVKISQDKNLAQPLSLTGSTLRAPHGCHAQYMSNMGSIASLVMAVIVNDSDVDSAGHTSQGIKLWGLVVCHHTSPRYVPFPVRSACEFLMQVFSLQLNMEVGMAAQVREKHILRTQTLLCDMLLRDAPIGIVSQSPSI

SEQ ID NO: 7711 - protein, 548 aa, Rhodospirillum rubrum
MAAKDVKFSTDARDRLLRGVDILANAVKVTLGPKGRNVVLDKSYGAPRITKDGVSVAKEIELKDKFENMGAQMVKEVASKSADVAGDGTTTATVLAQAIVREGVKSVAAGMNPMDLKRGIDLAVLAVVEDVKKRSKKIKTSAEVAQVGTISANGDEEVGKIIATAMEKVGNEGVITVEEAKGLDTELDVVEGMQFDRGYLSPYFVTNAEKMVADLENPYILLHEKKLSGLQALLPVLEAVVQSSRPLLIIAEDVEGEALATLVVNKLRGGLKVAAVKAPGFGDRRKAMLEDIAILTGGQVISEDLGIKLENVTIDMLGTAKKVTITKEETTLVDGAGDKKDIEARCSQIRANIEDTSSDYDREKLQERLAKLAGGVAVIKVGGATETEVKEKKDRVDDAMHATRAAVEEGVVAGGGVALLHAIRSLDSVKGANPDQNVGIEIVRRALQAPVRQIAENAGVDGAVVAGKLLENSDTDFGYNAQTGIYENLVTAGVIDPTKVVRAALQGAASIAGLLITTEAMVAEIPEKKDAMPSPDMGGMGGMGGMGF

SEQ ID NO: 7712 - protein, 462 aa, Unknown
  Halobacterium sp. NRC-1
MHLYWHQRDLRVPDNRGLHAATDGDTVVPVYVFDDTVLSQVGRPKRAFLAAGVRALRAAYRERGSDLLVREGDAESVLPALADEFDADTVFHAAHYDAARRNRRTRVADALAAAGVDTAGHVDHTLVDPATLDDAYPSHSQFYDDWQQAPKPDPVPAPDADALADVHDDHTLSVPAPEPPLPDAGHAAATDRLAAFLDDGIASYNDTRDDLAAAVDAPASAVSRLSPYLAAGNIGVREVWAAVADAYDDATGNAARNIGKYRYELSWREQNYHLLYHTPRLQTENYVSFDAPIAWQNSDDHFEAWTRGETGYPLVDAGMRQLRAEGYVHNRPRQVVASFLTKHLLVDWRRGERHFADRLVDYDPANNAANWQWTASTGTDTVAVRIFDPVSQMAKYDSDAAFVTEYVPELRGVDPETIVDWPTLRHSQRERLAPDYHHPIVDRDHAYERAQRVFEAALDGDA

SEQ ID NO: 7713 - protein, 190 aa, Botrychium lunaria
DEHGEVVSEIRQPDLEPYLGVHYPATDIPQASRFLFMKNKVRMICDCRAPPVRVIQDKESRRPISLAGSTIRAPHDCHAQYMENMGSIASLVMAVVVNENDEQPSNQSYRRKNRKLWGLIVCHHTTSRAVPFSLRSACEFLMQVFGLQLNIEVELAGQMREKHILRTQTLLCDMLLRDAPLGIVTQIPNI

SEQ ID NO: 7714 - protein, 279 aa, Klebsiella pneumoniae
MTTDSILLNDGYYMPRPGCGLWLIDNRDVDSLIRQALKAGFRHFDTAQAYFNEDGVGRALRYTEVPREQLFITSKIRGRDMGYARTLVSFNETLERLGVEYLELFLIHWPIPAKNLYVETWEASIELEASGLIRSIGVSNFTCQHIERLIEDTGVVPAVNQLELHPHFQQCDVRDYHHEAGIAIQSYSPFGSNGAAVLRNAVVMVLARRHDHSPAQIVLRWHLQQGLTPLPRTTNGARFSENVDVWDFELSEEEMKLLASLNTRTGNTQPLPDAMNMSF

SEQ ID NO: 7715 - protein, 233 aa, Glycine max
MALETLNSPTTTAPSFPFDDPTIPWAKRKRSKRCSRDHPSEEEYLALCLIMLARGGTTRRVSTPPPQPTPDPSTKLSYKCSVCNKSFPSYQALGGHKASHRKLAASGGEDQPTTTSSAASSANTASGGRTHECSICHKSFPTGQALGGHKRCHYEGNSNGNNNNSNSSVTAASEGVGSTHTVSHGHHRDFDLNIPAFPDFSTKVGEDEVESPHPVMKKPRPFVIPKIEIPQYQ

SEQ ID NO: 7716 - protein, 228 aa, Hyacinthus orientalis
MGRGKIEIKRIENTTSRQVTFCKRRNGLLKKAYELSVLCDAEVALIVFSTRGRLYEYSNSNSVKTTIERYKKACTDTTNTGTVSEANSQYYQQEATKLRQQITNLQNTNRTLMGESLSTMSLRELKQLEGRLERGINKIRTKKNELLSAEIEYMQKREAEMHNDNMYLRNKIAENERAQQQMNMLPSTATEYEGIPQFDSRNFLQVSLMEPNNHHYSRQQQQTALQLG

SEQ ID NO: 7717 - protein, 518 aa, Dianthus caryophyllus
MGSYKGVYDREILSKIATNDGHGENLEYFDGWKAYDRDPYHSTKNSNGVIQMGLAENQLCFDLVTEWLLKNPQASICTNEGVNKFMDIAIFQDYHGLPEFRSAVAKFMGKARDEKVIFNPDRIVMSGGATGASETLLFCLANPGDAFLIPSPYYPAFNRDLRWRTGVNLIPFTCSSSNNFKITKEALQSAYEDALKKNIKVKGIIVTNPSNPLGTVLDKDTLKMLLTFVNAKNIHLVCDEIYATTVFNSPSFISVAEVIKDMPHVNQDLVHILYSLSKDMGMPGFRVGIIYSYNDRVVSTARRMSSFGLVSSQTQFMIAALLSDDDFVRRFLVESRDRLFRRHQHFTSELAKIGIGCLQGNAALFVWMDLRHLLDEATVEGELKLWRVIINEVKINVSPGSSFLCSEPGWFRVCFANMDNATLDVALNRIRSFVTRGRVDNSTMTTTSARAAATTTTTTTTTTTTTTTTTTIKKKRGQMELRLSFNNRRFEDGLMSPHSSLLSPHSPMPQSPLVKART

SEQ ID NO: 7718 - protein, 457 aa, Staphylococcus aureus
MAIAVLLNRMFRMEHNPLFEYIYQQKEDIDACYFIIPEEDMSSASDLKAQFYRGTLQRFYQSLHAEKLTPYVMSYDDIISFCKENNISEVVTAGDIMSYHLEEYDILHQRSLFNEARIAVTLIRGNHYFKASKTMNQQGEPYNVFTSFYKKWRPYLRHRDVYHYDLKSFEDFVIASPDDLVFDDIAFGSSQIIEQNKWQHFLDQDIQNYESGRDYLPEVLTSQLSVALAYGLLDIIEIFNDLLARYDEDEANYEAFIRELIFREFYYVLMTQYPETSYQAFKPKYRQIKWSQNEADFNAWCEGQTGFPIIDAAIMELTQTGFMHNRMRMVVSQFLTKDLFIDWTWGEKFFRKHLIDYDAASNIHGWQWSASTGTDAVPYFRMFNPIRQSERFDAKALYIKTYLPIFNQIDAKYLHDTQRNESNLFEQGIELGSHYPRQMVDHQEKRTQVLATFKALD

SEQ ID NO: 7719 - protein, 161 aa, Pseudotsuga menziesii
MSIIPSFFGRRSSSAFDPFSLDVWDPFRAFTDLSGGGPSGQFVNEASAVANTQIDWKETPEAHIFKADLPGLKKEEVKIELEEGQRILQISGERSKEEEQKNDKWHRIERSRGKFLRRFRLPDNAKVEEIKAAMENGVLTVTVPKQPEPQPPQPKSIEISG

SEQ ID NO: 7720 - protein, 704 aa, Pseudomonas syringae
MRYQLSSRRISMKQLFPSTALALFVGLSVLPMSASTFAANSWDNLQPDRDEVIASLNVVELLKRHHYSKPPLDDKRSAIIYQSYIKQLDPSRSYFMASDIAEFDKWQFQFDDFLKSGDLNAGFIIYKRYLDRVNARLNFALGELGKGVDKLDFNTKETLLVDRKDAAWPKDTAELDELWRKRIKDEVLRLKIAGKDPAKIQETLTKRYKNQQARLNQTRAEDIFQAYINTFAMSYDPHTNYLSPDSAENFDINMSLSLEGIGAVLQSDNDNVKIVRLVPAGPAAKTKQVAPADKIVAVAQGDKEMVDVIGWRLDEVVKLIRGPKGSVVRLEIIPASNAPNDQTTKIVAITREAVKLEEQAAKKSILHLKQDGKDYKLGVIDIPAFYLDFKAYRAGDPEYKSTTRDVKKLLTELQAEKVDGVVLDLRNNGGGSLQEATELTSLFIDKGPTVLVRNADGKVDVLEDEAKGAFYKGPMALLVNRLSASASEIFAGAMQDYHRALVIGGQTFGKGTVQTIQPLNHGELKLTLAKFYRVSGQSTQHQGVVPDITYPSLIDTKEIGESALPEAMPWDSIKPAIKPAIDPFRPFLAQLQARHEARSAKDAEFVFIEDRLALAKKLMNEKTVSLNEADRRAEHASIESKQLALENTRRKAKGEEPLKELKKEDEDALPVEDEKTKPEDDAYLAETGRILIDYLGLSAAVAKK

SEQ ID NO: 7721 - protein, 192 aa, Ephedra major
DDHGEVISEIRRSDLEPYLGLHYPATDVPQASRFLFMKNRVRMICDCYSPPVRVIQDKRLKKELSFCGSTLRAPHGCHAQYMANMGSVASLVMAVIVNEKEDEEAENEGQSQQKGRKLWGLVVCHHTGPRFVPFPLRYACEFMMQVFSIQLNKEVELACQMREKQILRTQTLLCDMLLRDTPLGIISQKPSI

SEQ ID NO: 7722 - protein, 161 aa, Pseudotsuga menziesii
MSIIPSFFGRRSSSAFDPFSLDVWDPFRAFTDLAAGGPSGQFVNEASAIANTQIDWKETPEAHIFKADLPGLKKEEVKIELEEGQRILQISGERSKEEEQKNNKWHRIERSRGKFLRRFRLPDNAKVEEIKAAMENGVLTVTVPKQPEPQPPQPKSIEISG

SEQ ID NO: 7723 - protein, 630 aa, Candida glabrata
MDYEVNANQIPVLGIEQGLIPDNLDGSVKADTATSTAMNMNDKSEISNDGSHSIHTSNPNNNGENGKNGGKPASNDFVRKLFNILESNQYSNIVRWSNTGDSFVVLDTGKFTTQILPNHFKHSNFASFVRQLNKYDFHKIKRTNEERQKSIYGEQSWEFENPNFKINDEKSLDLIKRKTPAQRKVMLEDASAPSQKTPELLSVQSENKLKSALLSNTVKKDIFNNLRKRVDKMQKDMDTVMMDNYNLKSDYQKLATKYNTLLDSLITFRTVNENLINNFNALCNVLSSKGVELPSSVYENMNINIPVPSGQSPVNISPSPSLGIPIKNSTMSPSLPSMKSLQNTPSLTGKLSTNQRLDLPPNSQGILSDTNVGQTESPEIQMPISSNSSSTTKEVDQNIVLRKGFHVLLVEDDSVSIQLCSKFLRKYGCTVQVVTDGLSAISNLEKFRYDLVLMDIVMPNLDGATATSIVRSFDNQTPIIAMTGNIEDQDLITYLQHGMNDILAKPFTRNDLHSILIRHLKDRIPLCDQNRGSGITSESPNLPPTQHIISSQQNNEQNSSLPQSLPPIHPPNHQSPLFNNRASNITPLAPLNSAMSPQSPSHLERPLTNRSPLGMTPLNDGQPAFKKQHT

SEQ ID NO: 7724 - protein, 227 aa, Paulownia kawakamii
MAREKIQIKKIDNATARQVTFSKRRRGIFKKAEELSVLCDADVGLIIFSSTGKLFEYASSSMKEILGRHNLHSKNLDKLEQPSLELQLVEDSNYSRLSKEVAERSHQLRRMRGEELQGLSIEKLQHLKKSLESGLSRVIEKKGEKIMKGDQSTSRKGKQLMEENERLRQQVADISNDCKNNAASDSENIVYDEGQSSESVNACNSVGPPQDYDSSDTSLKLGLPYSG

SEQ ID NO: 7725 - protein, 534 aa, Oryza sativa
MGNSCQNGTYGNNYQNSNRFQNDRFASRYVDGNDTEDCYSGSSRASLAGALRQGLNLKSPVLGYKTPNVRELYTLGRELGQGQFGKTYLCTEISTGCQYACKTILKSNLRCVSDIEDVRREIQIMHHLSGQKNIVTIKDTYEDEQAVHIVMELCAGGELFSKIQKRGHYSERKAAELIKIIVGIIETCHSHGVMHRDLKPENFLLLDADDEFSVKAIDFGLSVFFRPGQVFREVVGSPYYIAPEVLEKRYGPEADIWTAGVILYVLLTGVPPFWADTQSGIYEKVLDGRIDFKSNRWPRISDSAKDLIKKMLCPYPSERLKAHEVLKHPWICDNGVATNRALDPSVLPRLKQFSAMNRLKKLSLQIIAERLSEEEIVGLREMFKAMDTKNRSVVTFGELKGLKRYSSVFKDTEINDLMEAADDTTSTINWEEFIAAAVSLNKIEREKHLMAAFTYFDKDGSGFITVDKLQKACMERNMEDTFLEEMILEVDQNNDGQIDYAEFVTMMQSNNFGLGWQTVESSLNVALREAPQVY

SEQ ID NO: 7726 - protein, 578 aa, Hordeum vulgare
MGGGNGIVDGFRRLFHRRTPSGSVLGSSNQSSAGEDSSELEAVEDLDLVGLRPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIEIWSIGCIFAELLTGRPLFPGKNVVHQLDIITDLLGTPSSETLSRIRNEKARRYLRYMRKKHPVPLTQKFPNADPLAVRLLGRLLAFDPKDRPSAEEALADPYFASLANVEREPSRHPISKLEFEFERRKVTKDDVRELIYREILEYRPQMLEEYMKGGDQISFLYPSGVDRFKRQFAHLEEHYSKGERGSPLQRKHASLPRQRVGASNDSNNEQHISDQEMSAEPDAHGAVSPQKPQDAPGVGQNGLSPTSLSSRTYLKSASISASKCVVVNPNKQPEYDDAISEETEGAVDGLSEKVSKMHA

SEQ ID NO: 7727 - protein, 344 aa, Cicer arietinum
GFREFKDDSDFDEDEEDDDDDEGLLVGGKGFTFSSNNTKSFKTFSRGSTAAKSVSPKSNEQAEKACKRKRKNQYRGIRQRPWGKWAAEIRDPRKGVRVWLGTFNTAEEAARAYDAEARRIRGKKAKVNFPEEAPVTSSKRFKPNLENKLVNKNLNSFNPNGNKMFNFGENVENYYSPMDQVEQKPLVNNNNQYANMGPFSGNGVQHSQISPSADVTAYFSSEHSSNSFDYSDLGWGEQGPKTPEISSMLSAAAPLESESQYVQNNMQSNNNQNMLPVEDNSAKTLSEELADIESQLKFFETPYDDNWGDASLASFLGGDATQDGGNPMNLWSFDDLPSISGGVF

SEQ ID NO: 7728 - protein, 448 aa, Magnetospirillum magnetotacticum
MGAGKKRISLRPDFVWGVSTSAFQVEGATKEDGRGPSIWDTRCRLAGGVWTGANADVACDHYHRWPEDVRLIKDLGVDAYRFSIAWPRLLPKGKGAVNQKGLDFYDRLIDGVLEAGITPWVCLYHWDLPQALDDLGGWTNRDCAGWFADYAVLAAKRYGDRVKHFATFNEFSVFTMFGYAIDWAAPGVTDRAAHMKAIHHVNLAHGMGVDVLRDHVPGVSIGAIHNRQIVRPEGGLAENQAAADLLDAHWNGVFCDPQHLGHYPEIMARDVEPYVQAGDLARICRPTDWMGLNHYGPIYAKADPATTWGYGWGAPPESANHPEVGWPIFPEVFKDELLTLTRRYGLPIYVTENGCGGGAGSDTPDENGEVKDTHRLAYFREYQQAMLDAVAEGADLRGYFVWALLDNFEWGSGYGPRFGLYHVDFETQKRTLKNSGKWYRDMIKGHRT

SEQ ID NO: 7729 - protein, 290 aa, Helicobacter pylori
MDYKRFKGKHANIVIEIISLLEKGVKKAQEILEKPDAGSYTQLENSSGDTPIKADLALDKFLEETFLSLENVKSVFSEEKETPVTKENGSYLIAYDPLDGSSVMEANFLVGTIIGVYEKDYKAQNLVASLYVVFGHKIELVVALEEVYRYAFYQNKFHFIETIVLENKGKIIASGGNQKDFSLGLKKALEGFFAENYRLRYSGSMVADVHHVLVKKGGMFSYPQKKLRKLFEVFPLALMVEKAKGEAFYFDKGVKKRLLDQSVESYHEKSECYLASPHEAQILEKHLKGE

SEQ ID NO: 7730 - protein, 769 aa, Xanthomonas axonopodis
MRERAAGLRAWSILAVLAALAAALGAGLQWSSLQGPWRAVSAVSAALAVVCGLCAAFAAHRAAHAQHALAQRLEEADLARERLQQELRRHGELEQELLRAKQAAEAATLAKGEFLATMSHEIRTPLNGIIPMLELISSGQLSLDQRDMLQTATGSSLQLLRIVDDILDYSKLEANKLELEITTFNLRELLDGVIQLLQRTAEGRQLRLSLDIEPSVRLLVRGDPIRLRQVLGNLIGNAIKFTERGSVDIQLRRLGETRAQHLLRFQVRDTGIGIAPDQQARLFRSFAQADASTTRLYGGTGLGLAICKRIIDLMGGRIGVESEPGRGSTFWFEIPLLKVIGDLQQATGADAARVMVISSDARLSQRLKRLLDSWGVSHVLMETTQEALERVRRHSDGEGFRCVIADHDTLRYSARAVHRALARPENASSARLIWLYGEEPVPAELQDHATLVPRLSPDETLRALVLPPEPKPAHATTLASAMIPEPLPPPMANAREVRILLVEDNPVNLLVAQKLLAVLGFEADTATDGEAALARMESTRYDMVFMDCQMPVLDGYAATRRWRAMETESGGRPVPIVAMTANAMAGDRERCLAAGMDDYLSKPVAREQLDACLQRWLPRQALLPGPSPAGQATHDPESASAAAQARALPILDNSVIDELYEVAGADTITILQLFLEDAPLIIEQLEAAAANRDSMQLRDLSHTLKSSSANVGAQAVSNAARRIELAARTGTIERPSVMVALVIAEYARARLALLGQVARLQADASTTNH

SEQ ID NO: 7731 - protein, 686 aa, Aspergillus nidulans
MTSTAPSDGTGIIDLDPWLEPFREAIKRRFDYVESWIKTVDEVEGGLDKFSKGYEKFGFNVSETGDITYREWAPNAIEAALVGDFNNWDTKANPMTRDNFGVWEIALPAKNGTPVIPHDSKVKITMVTRSGERIYRIPAWIKRVVQDLNVSPIYESVFWNPPKAERYNFQHARPKKPESLRIYEAHVGISSPDTRVATYKEFTANMLPRIKYLGYNAIQLMAIMEHAYYASFGYQVNNFFAASSRYGKPEDLKELVDTAHSMGLVVLLDVVHSHASKNVDDGLNMFDGSDHLYFHSGSKGQHELWDSRLFNYGNHEVLRFLLSNLRFWMEEYGFDGFRFDGVTSMLYTHHGIGTVSGFSGGYHEYFGPAVDDDGVMYLALANEMLHRLYPDCITVAEDVSGMPALCLPHGLGGVGFDYRLAMAIPDMYIKLLKEKSDNDWDIGNLAFTLTNRRHGEKTIAYAESHDQALVGDKSLMMWLCDKEMYTHMSVLTEFTPVIERGMALHKMIRLVTHALGGEGYLNFEGNEFGHPEWLDFPRAGNNNSFWYARRQLNLTEDHLLRYRFLNEFDRAMQLTESKYGWLHAPQAYISLKHEGDKVLVFERADLLWIFNFHPTESFTDYRVGVEQAGTYRVVLDTDDQAFGGLGRIDQGTRFFTTDMEWNGRRNYLQVYIPTRTALALALEETL

SEQ ID NO: 7732 - protein, 190 aa, Glycine max
  misc_feature (162)..(162): Xaa can be any naturally occurring amino acid
MSHIPTAGYGTLAGATPTGTTTSTTTTTTSLVTPRPWREFLDLSALSCPYSYDDAMIRVRRNLSHFRFNYAAVTLLIVFLSLLWHPVSMIVFLLVLVAWYYLYFSRDGLLVVFNQTLDDRTVLCVLGLLTVVALVSTHVGLNVLLSLIVAVVLVGLHAAFRXTEDLFLDEESSLLSVVGTQPLRTNYTPI

SEQ ID NO: 7733 - protein, 492 aa, Oryza sativa
MDPCKFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPLRHAPPTPITPRPVVGRRQKATIHKQNDFKQPGERYRSWAPDRQERFIRRFAGELAHPKVSPELRAIWVNYLSQCDESLGVKIANRLNVKPSM

SEQ ID NO: 7734 - protein, 233 aa, Pasteurella multocida
MLVPIPALNDNYIWLYGRANLPIIVIDIPEFTPLLDYVQQHQLNVEALLLTHHHDDHTAGVSLFKQHFPNVKVFGPAETQAKGATEIVNMGILQTEHYHIHVLQTAGHTEQHVSYLVDGHLFCGDSLFSAGCGRVFTGNYQHMFDGLQRLKSLPDDTIVCPAHEYTLANLAFAKYILPENVAIQQHEQWVQKQRVTHQPSLPTTMGREKQINPFLIAQDMETFVAWRKAKDVF

SEQ ID NO: 7735 - protein, 447 aa, Zea mays
MASEAAAASVISRNPCLFAPPLITNQQQPSHQEPQQEMPLPPPAKKKRNLPGTPGKLLASSSCIDPAAEVIALSPRTLLATNRFVCEICGKGFQRDQNLQLHRRGHNLPWKLRQRSAGKEPRKRVYVCPEKTCVHHNPCRALGDLTGIKKHFCRKHGEKKWKCDKCNKRYAVQSDWKAHAKTCGTREYRCDCGTLFSRRDSFITHRAFCDALAEETARQLNAAAAATSHLNNNAHVVVGLSLPSMVGHINGATGSILLPGAPPQLYADLFAPAPPQLSWPCELTSAAAAASSSAAASGKQKTDSVPSVFSGYPHANLAVPGAGAADMSATALLQKAAQMGAVTSGSGSVIMTTTAGGHHQPSDCGAGLLFSALTQQNATNLISGSGTSTLTTSQLTATGGNMPYDVLSAVRHAGLKDAAVAVGREETRDFLGVGVQALCSSSLNGWI

SEQ ID NO: 7736 - protein, 484 aa, Pseudomonas fluorescens
MSQNKTLTTASGAPVADNQNSRSSGPRGPLLLDDFHLIEKLAHFNRENIPERRVHAKGSGAYGTFTVTRDITQYTSAKLFSAVGKQTPTFLRFSTVGGERGSADTERDPRGFALKFYTEEGNWDIVGNNTPVFFIRDPLKFPDFIHTQKRLPQSNLKSAQMMWDFWSHSPEALHQVTILFSDRGIPDGYRHMHGFGSHTYSLISAQGERHWVKWHYKTKQGIKNLAPADAARLAGTDPDYAQRDLFEAIERGDFPKWSVCIQIMTEAQAAAHYENPFDVTKTWSQKEFPLIEVGELELNRNPLNYFAEVEQAAFGPSNMVPGVGLSPDRMLQGRVFAYADAHRYRVGTNHQQLPVNAPRSPVNTYQRDGSMAFGSNGGAAPNYEPNSYVESPKQAPHYAEPALALSGAADRYDHREDSDYYSHAGALFRLMSDEQKALLVSNIAGAMGGVSSDVIDRQLQHFYKADPAYGEAIAKLLNVQLNEV

SEQ ID NO: 7737 - protein, 696 aa, Oryza sativa
MSAASSSSVAAPPDYTKATDGTGVIGGDPWLEPFAPALRERYALYQDWKNKISVSEGGLEAFSGSYRNMGFQVDPKTQAVTYTEWAPNAVEAALISDFNNWSRDSHKMTKDDYGKWHITIPPLANATCAIPHDSKLKISMLLPSGERIERLPAWILRVTQDLNVSPVYDARFWNPPKEERYTIKNPKPPKPDNIKVYEAHVGIATPEARVGQFKEFTKNVLPRIKELGYNTIQLMAIQEHAYYASFGYQVTNFFAASSRYGNPEDLKELIDVAHSMGITVLLDIVHSHACKNVLGVLNMFDGTDHLYFHEGAKGRHELWDSRLFNYGHHEVLRFLLSNCLFWMEEYGFDGFRFDGVTSMLYTHHGIGTGFSGGYHEYFGPSVDVEAVVYLMLANDMIHKYNPNAITIAEDVSGMPALCRPVSEGGVGFDYRLSMAVPDMWIKLLKEKSDEDWDFGNICFTLTNRRHLEKSIAYAESHDQALVGDRTLAFWLMDKEMYTNMSDLTERTAIIDRGLAYHKMIRLITHALGGEGYLNFIGNEFGHPEWLDFPREGNGNSFHYARRQFNLVDDHLLRYQYLYAFDAAMNNAEGKYKWLASSQAYISLKHESDRVVAFERAGLLFVFNWHANNSYTDYRIGVDVPGKYKVLLDTDAKELGGHARIDHNTEWFTTDMEWNGRRNFVQLYLPSRSAIVLYRAD

SEQ ID NO: 7738 - protein, 282 aa, Solanum demissum
MVGKISSDLPPGFRFHPTDEELIMYYLRYQATSRPCPVSIIPEIDVYKFDPWELPEKAEFGENEWYFFTPRDRKYPNGVRPNRAAVSGYWKATGTDKAIYSANKYVGIKKALVFYKGKPPKGVKTDWIMHEYRLSDSKSQTYSKQSGSMRLDDWVLCRIYKKKNLGKTIEMMKVEEEELEAQNVSINNAIEVGGGPQTMKLPRICSLSHLLELDYYGSIPQLLSDNLLYDDQSYTMNYVSNTSNVDQVSSQQQNTNNITSNNCNIFFNYQQPLFVNPTFQSQ

SEQ ID NO: 7739 - protein, 117 aa, Brassica napus
MSYNNNGNVVPAADPLPGKKTKLQSSRSWVSIVATGESETLDVDKYAIMHRVQIHARDLRILDPNLSYPSTILGRERAVVLNLEHIKAIITADEVLLRDPSDENVIPVLKELERRLP

SEQ ID NO: 7740 - protein, 277 aa, Rhodopseudomonas palustris
MQTADAHFVEAHGAKIPALGLGTWELSGHSCSRIVEQALRLGYRHIDTAQIYDNEREVGEGIRNSHIRRDQLFVTTKVWTTHFAPNDLVRSAKESLVKLRLSEVDLLLLHWPNAHVPLAETLGALAQARALGLTRHIGVSNFTVALLAEAVAVCPAPLVCNQVEYHPFLDQQKVLAACALYGMALVAYSPIARGNAKKSEVLTRIGNVHGKTAAQVCLRWLIQQNVAAIPRSSRLERLAQNIDVFDFELSDAEMQEIFTLGSPKGRLTTMPTAPVWD

SEQ ID NO: 7741 - protein, 532 aa, Unknown
  Vibrio sp. Ex25
MAAKDVLFANDARQKMLKGVNLLADAVKVTLGPKGRNVVLDKSYGAPTITKDGVSVAKEIELKDKFENMGAQMVKQVASKANDEAGDGTTTATVLAQSFINEGLKAVASGMNPMDLKRGIDKATEAAVEKLREMSKPCSDKESITQVGSISANSDRAIGEIIAEAMEKVGRNGVITVEEGQGLDNELSVVEGMQFDRGYLSPYFITNQENGSVELDNPYILLVDKKVSSIRELLPVLEEVAKSSRSLLIIAEDIEGEALATLVVNNMRGIVRATAVKAPGFGDNRKAMMEDIAVLTAGTVISEEIGLELEKATLEQLGSAKKVTITKDTTTIVGGAAEASAIADRVASIEKQIETTTSQYDKDKLQQRVAKLSGGVAVIKIGAATEVEMKEKKDRVDDALHATRAAVEEGIVAGGGVALTKIAKELADLKGDNDDQNVGIRVALRAMEEPLRQIATNAGDEASVVANAVKAGDADYGYNAATGEYGSMIEMGILDPAKVTRSALQFAASVAGLMITTEAMITNHVEDKELDI

SEQ ID NO: 7742 - protein, 321 aa, Unknown
  Polaromonas sp. JS666
MRLDADSFDNETYIARPITVEELSVNSSYLIRLQQRWAWPTVTLSFAGAGVAAWLAVTEGVSIAEIGILVAMYVLTYLGLTVGYHRCFAHRAFKANPLVRYVLAILGSMNVQGPIVFWVATHRRHHQFSDVPGDPHSPHLHGSGFRGSVEGFFHAHIGWLFAADMTNTALYARDLLRDSVMRRINRLYLVWVMLGLLIPTLAGALLLGGVGGALRGLLWGGLVRGFIAYHATWALNSLTHVVGKRDFNTQDHSHNIGWLAMLTLGEGWHNNHHAFPYSAVLGLKWWQLDVSAIVIRMLKALGLAWDVKVPLKKAREVMATA

SEQ ID NO: 7743 - protein, 276 aa, Bacillus halodurans
MANNLQATTTLHNGVKMPWFGLGVFKVSEGDEVIQSVKDAIRAGYKSIDTAAVYGNEEGVGKAIAESGVPREELFITSKVWNADQGFDSTISAFNTSLKKLGLDYLDLYLVHWPVKGKYVETWKALEKLYQDGLVRAIGVSNFQVHHLKDVLEAGSIVPMVNQVEYHPHLTQTELHDFCKQNKIQLEAWSPLKQGQLLNDPTIVAIAEAHQKTPAQIILRWDLQNEVVTIPKSVKKDRIISNADIFDFQLTEEDMQKINELNKNERVGPDPDNFDF

SEQ ID NO: 7744 - protein, 451 aa, Zea mays
MAEHKGNVLLHKYEMGKLLGQGTFAKVYHARNTATSESVAIKVIDKEKVMKVGLIDQIQREISVMKLVRHPNIVQLYEVMATKTKIYFVLEHVKGGELFNKIQRGRLKEDAARKYFQQLICAVDFCHSRGVYHRDLKPENLLLDENSNLKVSDFGLSALAECHRQDGLLHTTCGTPAYVAPEVINRKGYDGAKADIWSCGVILFVLLAGYLPFHDKNLMDMYKKIEKADFKCPSWFSTDVRRLLQRILDPNPSRRISVEKIMENPWFRKGLGAKLLRYDLQNKNAPHVDKKADFDSLSTNVTTESKQHEEKKPTNMNAFDIISLSTGLDLSGLFEESNKKRESKFTSTNTSSTIISKIEDIAKNLRLNLTKKDGGLLKMEASKPGRKGVMGIDAEVFEVSPNFHLVEIKKTNGDTLEYQKVLNQEMRPALKEIVWAWQGEQSKQKQEQQSC

SEQ ID NO: 7745 - protein, 324 aa, Unknown
  Polaromonas sp. JS666
MRLTLPTTSIQTAESVFVIKLRLVLVHLGALCIFFVPFTYQLLVGAVIGYFVRVFAWEGGSHRYFAHKAYKTSRGFQLFLALLAAAAGVRGPLWWATHHRLHHRTADTAEDPNTPLFRGFWHGYVGWLFLQENADSNLDATKDLSRYPELVIVNRYQYFAPLVLMALTYAVGQYTPLFGAKGMGVSALIWVFFLSTALSLQSLFSVGALGHGIKPSVFNHRRFETGDTSTNLGLMAIFTMGGSWHNNHHRCAVAARSGFYWWQVDLTYYVLRLLKAVGLIWDLRLPSARILEEGRRGAGRQTAEIAGVAEDLTARQEHGYEGVK

SEQ ID NO: 7746 - protein, 242 aa, Castanea mollissima
MVYPNQSMSLSPQRKIGRGKMEMKRIENTTNRQVTFCKRRNGLLKKAYELSVLCDAEVALIVFSTRGRLYEYANNSVKSTIERYKKACADSSNTGSVAEANTQFYQQESAKLRAQIGNLQNSKQANDGESLSNLTVKELKSLEIKLERGISRIRSKKNELLFAEIEYMQKREVELHNNNQLLRAKIAENERNQQNLNVMPAGGGSYELMQTQQYDSRNFFQVNALQPNHQYPREDQMSLQLV

SEQ ID NO: 7747 - protein, 243 aa, Castanea mollissima
MGRGRVEVKRIENKINRQVTFAKRRNGLLKKAYELSVLCDAEVALIIFSNRGKLYEFCSTSSMLKTLERYQKCSYGAVEVNKPGKELEISYREYLKLKARFESLQRTQRNLLGEDLGPLNTNDLERLERQLDSSLKKSGPLRQYMLDQLSDLQNKEHLLVEANRALAIKLDEISPRNNLRQSWEGGEQSMSYGPQNAHSQSFFQPLDCNPTLQIGYNASGSDQQLSGTTHAQQVNGFIPGWML

SEQ ID NO: 7748 - protein, 540 aa, Streptococcus sanguinis
MAKDIKFSADARSSMVRGVDILANTVKVTLGPKGRNVVLEKSFGSPLITNDGVTIAKEIELEDHFENMGAKLVSEVASKTNDIAGDGTTTATVLTQAIVREGIKNVTAGANPIGIRRGIEAAVATAVEALKSNSVPVSNKEAIAQVAAVSSRSEKVGEYISEAMEKVGNDGVITIEESKGMETELDVVEGMQFDRGYLSQYMVTDNEKMVAELDNPYILITDKKISNIQEILPLLENILKTNRPLLIVADDVDGEALPTLVLNKIRGTFNVVAVKAPGFGDRRKAMLEDIAILTGGTVITDDLGLELKDATIEALGQASKVTVDKDSTVIVEGSGNPEAIANRVAVIKSQIESSTSEFDREKLQERLAKLSGGVAVIKVGAATETELKEMKLRIEDALNATRAAVEEGIVSGGGTAYINVLDAVAGLELAGDEGTGRNIVLRALEEPVRQIALNAGFEGSIVIDRLKNSEVGTGFNAATGEWVNMIEAGIIDPVKVTRSALQNAASVASLILTTEAVVANQPEPASPAPAMDPGMMGGMM

SEQ ID NO: 7749 - protein, 242 aa, Castanea mollissima
MGRGRVQLKRIENKYRQVTYSKRRSGLLKKAHEISVLCDAEVALIVFSTKGKLFEYSSDSSMETILERYERYSFAERQLVATDSESQGGWCMEFPKLTARVEVLQRNIRNFMGEDLDPLSFRELQNLEQQIDAGLKRIRTRKNQLMHESVMELQKKEKSLQEQNSVLAKKLKENEKNIPEQAHQEQPSLGLLSLPQQPMPSTLSLPSLTIGGAFQERAVDEDAGVQTRPTLMPPWMLRHVNG

SEQ ID NO: 7750 - protein, 546 aa, Bacillus anthracis
MAENQDKNSLEEQDVKRETLTTRQGHPVKDNQNIRTIGNRGPATLENYHFIEKISHFDREEVPERVVHARGAGAFGYFETYGKVGDEPAEKYTRAKVFSGAGKKTPLMVRFSTVAGAKDSPETARDPRGFAVKMYTEDGNWDLVGNNLKIFFIRDAMKFPDMIHAFKVDPVSNVSNPQRMFDFVSRTPEATHMITFLFSPWGIPATYRHMQGSGVNTYKWVNEKGEAVLVKYHWEPKQGIRNLTQEDANSIQAMNVSHATQDLYEAIERKDYPEWELFVQIMEDGYHPELDFDPLDDTKLWPEEQFPWLPVGRMVLDRNPVDYHSEIEQAAFGTGVLVDGMDFSDDKMLQGRTFSYSDTQRYRVGANYLQLPVNAPKAPVRTNQHRGQMDMRNPKESGENPHINYEPSMLGGYKDAKQEKHHPHQPTYNAAAMSAPIDRPNNYGQAGHTYRSFEEWERNELVKNLSEALAVCDKRIQNAMIAHFTQADEDYGRRVKEGIEKKMKEAKTENKLPGREVSKSKYGQGSLAANEATKDAVKKSHESDPY

SEQ ID NO: 7751 - protein, 142 aa, Rhodobacter sphaeroides
MQVKYLHTMVRVLDLEKSIAFFRLLGLEETRRTESETGRFTLVFMAPPGQPECPVELTYNWDGDEGLPSDSRHFGHLAYAVEDIYDMCARLQAAGVTINRPPRDGHMAFVRSPDNISIELLQMGDSLPPAEPWSSMQNTGHW

SEQ ID NO: 7752 - protein, 392 aa, Brassica napus
RPTRPVRGGELFNKVAKGRLKEDVARKYFQQLISAVTFCHARGVYHRDIKPENLLLDENGNLKVSDFGLSAVSDQIRQDGLFHTFCGTPAYVAPEVLARKGYDAGKVDIWSCGVVLFVLMAGYLPFHDRNVMAMYKKIYKGEFRCPSWFSPELTRLCSRLLETNPEKRFTFPQIMENSWFKKGFKHVKFYVEDDKLCNVVDDDDELETGSVESDRSSTVSESDVEFFKPARRVGGLPRPASLNAFDIYRFSQGFDLSGLFDDDGEGSRFVSGAPVSKIISKLEEIAKVVSFTVRKKDCRVSLEGSRQGVKGPLTIAAEIFELTPSLVVVEVKKKGGDRTEYEEFCNKELKPKLQTLTADEVDDPVAVSAVVDETASGVANSPPVCFLPSDTE

SEQ ID NO: 7753 - protein, 479 aa, Streptomyces sp.
MVPAAQQTATAPDAALTFPEGFLWGSATASYQIEGAAAEDGRTPSIWDTYARTPGRVRNGDTGDVATDHYHRWREDVALMAELGLGAYRFSLAWPRIQPTGRGPALQKGLDFYRRLADELLAKGIQPVATLYHWDLPQELENAGGWPERATAERFAEYAAIAADALGDRVKTWTTLNEPWCSAFLGYGSGVHAPGRTDPVAALRAAHHLNLGHGLAVQALRDRLPADAQCSVTLNIHHVRPLTDSDADADAVRRIDALANRVFTGPMLQGAYPEDLVKDTAGLTDWSFVRDGDLRLAHQKLDFLGVNYYSPTLVSEADGSGTHNSDGHGRSAHSPWPGADRVAFHQPPGETTAMGWAVDPSGLYELLRRLSSDFPALPLVITENGAAFHDYADPEGNVNDPERIAYVRDHLAAVHRAIKDGSDVRGYFLWSLLDNFEWAHGYSKRFGAVYVDYPTGTRIPKASARWYAEVARTGVLPTA

SEQ ID NO: 7754 - protein, 444 aa, Arabidopsis thaliana
MVRRQEEEKKAEKGMRLGKYELGRTLGEGNFGKVKFAKDTVSGHSFAVKIIDKSRIADLNFSLQIKREIRTLKMLKHPHIVRLHEVLASKTKINMVMELVTGGELFDRIVSNGKLTETDGRKMFQQLIDGISYCHSKGVFHRDLKLENVLLDAKGHIKITDFGLSALPQHFRDDGLLHTTCGSPNYVAPEVLANRGYDGAASDIWSCGVILYVILTGCLPFDDRNLAVLYQKICKGNPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVKQEERNQKGQVGLSVTAEVFEIKPSLNVVELRKSYGDSCLYRQLYERLLKDVGTSSPEQEIVT

SEQ ID NO: 7755 - protein, 585 aa, Pyrenomonas salina
MRRFSETYGQKKQITFFCSNLSITAVVIEGLLKHKEEYGALERGMDILAEAVSVTLGPKGRNVVLESGKYGPPQIVNDGVTIAKEIELEDHIENTGVALIRQAASKTNDVAGDGTTTATVLAHAMVKQGMKNVRCRSKSIAIKRGIEKATQFVISQIAEYSRPVEDTKSITQVAAISAGNDMEVGQMIADAIEKVGREGVISLEEGKSTVTELELTEGNGWFLKKGFISPYFVTDTDRMETTQENPYILLTDKKISLVQELVPIHLELISKTSRPLLIIAEDVEKEALATLVVNKLRGIVNVVAVRAPGFGDRRKTMLEDIAILTGGQVISEDAGFSLETVQLDMLGQARRITVVKEGTTIIAEGHEREVKARCEQIRRQIEASESSYEREKLQERLAKLAGGVAVIKVGAATETEKDKKLRLEDAINATKAAVEEGIVPGGATLIHFIEDLNDWAEDNLLDDELIGALIVEKALSAPMKRIIENTGISSSIIIEKIKDKDFSIGYNAAQGEIEDMYEIGVIDPAKVTRSAMQNAASIASMILTTECIVVDKKKTCSLETSIYWLVLTNKYFCLDLLRLYFFLKD

SEQ ID NO: 7756 - protein, 214 aa, Zea mays
TTSRQVTFCKRRNGLLKKAYELSVLCDAEVALVVFSSRGRLYEYANNSVKSTIERYKKANSDSSNSGTVAEVNAQYYQQESSKLRQMIHSLQNANTRNIVGDSIHTMGLRDLKQMEGKLEKAIIKIRARKNELLYAEVDYMQKREMDLQTDNMYLRSKIAESNETGQPAMHMTMGAPPTSEYDHMAPFDSRNFLQVSMPQHYSHQLQPTTLQLG

SEQ ID NO: 7757 - protein, 310 aa, Zea mays
MARHFVLNTGAKIPSVGLGTWQSDPGVVGNAVYAAVKAGYRHIDCARVYGNEKEIGLALKKLFEEGVVKREDMFITSKLWNDHHAPEDVPEALNDSLNDLQLEYLDLYLIHWPFRVKKGTNTSPENFVTPDFPATWGAMEKLYDAGKARAIGVSNFSSKKLGDLLAVARVPPAVDQVECHPGWQQTKLHSFCQSTGVHLTAYSPLGSPGTTWMNGNVLKEPIIISIAEKLGKTSAQVALRWNIQMGHSVLPKSTNEERIKQNLDVYDWSIPDDLLAKFSEIKQARLLRGNFIVNPESVYKTHEELWDGEL

SEQ ID NO: 7758 - protein, 484 aa, Debaryomyces hansenii
MSDKVEVADVTSLNALAAGTNKKNPRVVAAGLGGRLMGTKSLVDVTADEITKDSELSLAEKDRKDKEKWTKMTHISDQPWTWSNWSEHINWLNLILVVLVPTVGFVCALRHPPQLKTAVMGVILYILSGLSITAGYHRLYSHKAYDAAVPVKIFFALFGAGAVEGSIKWWGHSHRVHHRYTDTARDPYDARQGLWYSHMGWLLIKANPKNRARADISDLTGDWVVNFQHRHYLVIMIFMALVLPTLIAGLGWGDYWGGFVYGGIIRSFFIQQATFAINSLAHWIGSQPFDDRRTPRDNVITALVTFGEGYHNFHHEFPSDYRNALIWYQYDPTKITIWVLSKLGLAWGLKTFSQNAIEQGLIQQQQKKLDRMKSKLEWGTMLNELPLMDKEEFTARAKKDGLILISGIVHDVKQFIKQHPGGQALIRVSLGKDATKAFNGMVYAHSNAAHNMLANMRIAILKDHAVNGNTFDLQQEFLDKEKVN

SEQ ID NO: 7759 - protein, 280 aa, Streptococcus mutans
MEAYTLINGVHIPKIGFGTWKLADGDEAYKSVSYALEVGYRHVDTAQYYGNEVSVGRAIADSPIKREELFITTKIWNDKHSYDEAKQSVEESLAKLKLNYLDLLLIHWPNPKALRENDAWKTRNADVWRAMEDLYQAGKVRAIGVSNFMIHHLEPLLEVATVKPMVNQVLLAPGCSQEELVAFCRQNEMILEAYSPLGTGSIFDNQTAQDLANKYNKTVAQIALRWSLQKGFLPLPKSATPKNILSNLAIFDFDLTEDDILKLDKIENVKSQGNPDETAF

SEQ ID NO: 7760 - protein, 297 aa, Unknown
  Rosa hybrid cultivar
MPSRLINWQVQFFGREWDFMDLYHLTLFLGVPFVCLLAPFQFTWGALWVAISLYLVSGMGVTISYHRNLAHQSFKVPKWLEYSLAYCAVLSLQGSPLEWVSTHRYHHQFTEKLRDPHSPNKGFWFSHLNWLFDYHSRFGSYDGQLMKNVGDLECQLYYRFLHYTYFLHSVLLGVALYVAGGLPFVIWGMGVRVVVISQVTFSINSICHTWGKQIWDTGDASKNNWLFGLLAFGEGWHNNHHAFEYSARQGLERWQIDTSWYVIKFFQVVGLATHVKLPTEIQKKRKALAKNSIMKDK

SEQ ID NO: 7761 - protein, 247 aa, Capsicum annuum
MGRGRVQLRRIENKINRQVTFSKRRSGLLKKAHEISVLCDAEVGLIVFSSKGKLFEYSTDSCMERILERYERYSYAERQLNATDVETPGSWTLEHAKLKARLEVLQRNQRHYAGEDLDSLSMKELQNLEQQLDSALKHIRSRKNQLMHESISELQKKDKALQEQNNNLSKQMKEREKQLAQQHTPWEQQNHDHLNSSSFGLPHPFNNNHLGEVYPTAGDNGEVEGSSRQQQQNAAVMPPWMLRHLNG

SEQ ID NO: 7762 - protein, 521 aa, Chlamydomonas reinhardtii
MRKEATRLVSALLRAGNNGVSTSWAVGGTRLKSAMPQPDEKKDEDLHAKEGKVLHPHLLNENVVKTQYAVRGELYLRAEQLRKEGKEIIFTNVGNPHALGAKPLTFTRQVLALCAAPFLLDHPKVEDMFPADAIARAKKILASFKGGVGAYTDSRGNPLVREEVARFIEKRDGVPSNPDHIFLTDGASVAVRLCLNAMIRHDRDSVLVPIPQYPLYSASIRLYGGTLVGYFLDERRGWGLSVEELQRALQESREEGKLVRGLVFINPGNPTGQCLSKENLQELIKLAYQEKIVLMADEVYQENVYQDERPFVSAKKVMWEMGEPYRSHVELLSFHTVSKGTAGECGLRGGYVEMTNIHPGAIEEVYKCASINLSPNTMGQIALSVLVNPPKPGDPSYDQYTKEKASELVSLRRRRHMVTDGFNALDGVTCNFTEGAMYSFPQIKLPAKALEAAKAAGKAGDVFYCLKLLEATGISTVPGSGFGQEEGTFHLRTTILPREEVMTTFVEKFDKFHKDFMKQYS

SEQ ID NO: 7763 - protein, 694 aa, Thiobacillus denitrificans
MSQKKKPAKAGPDENFERGAGGEIHQTANGAHPPLTTNDGVPISDDQNSLRSHPRGPTLLEDFVLRDKITHFDHERIPERVVHARGSAAHGYFELTESLEKYTTARILTEVGEKTPVFTRLSTVAGGAGSVDTPRDVRGFAVKFYTKEGNWDLVGNNIPVFFIQDAIKFPDLVHSFKMEPDRGFPQSSTAHDTFWDYVSLTPESMHMILWIMSDRTTPRSLRMIEAFGVHSFRLVNAKGASTFVKFHWRPKLGLQSTIWDETVKIAGADPDFHRRDLFEAISEGNFPEWEFAVQLFTEADAERFPFDHLDATKLIPEELVPLKVIGRMVLDRWPDNFFAETEQVAYCPTHVVPGIDFSNDPLLQGRLFSYVDTQLLRFNSPNFHQVPVNMPKCPFANLQRDGHMQMERPKGRVNYEPNTLGTDTPRETPQGFRSAAVTESGEKGRIRAERFADHYSQARQFYVSQTEYEQAHIASTLVFELAKVDHVHIREAMVGHLRHVDEDLAHRVAKGLGIDPLPPAPEAAAPVQDLPPSPALQIIGNMKDTLEGRMVGILVGDGSDGARVEALRRAATDAGAAVKIIAAHVGQVKLANGKMLKVDKQLAGTPSVLFDAVAVVVSEDAAKMLLKESAALDFVHDAFGHLKAIASDAGGQALLDAVHVVRDAGVVDAADVGAFIAAAKTRQWDREPSVRLLA

SEQ ID NO: 7764 - protein, 635 aa, Fagus sylvatica
MESCDCIETQWHDELLVKYQYISDFLIALTYFSIPLELIYFVQKSAFFPYRWVLMQFGAFIGLCGATHFISLWTFSMHSKAVAVVMTVAKIACAIVSCATALMLVHIIPDLLSVKTRELFLKNKAEELDREMGLILTQEETGRYVRMLTHEIRSTLDRHTILKTTLVELGRTLGLEECALWMPSRTGMNLQLTHTLNSQIQGSTVPLSDSIVNEVFNNARAMRIPYTCPLARFRPLVGRYVLPEVVRVPLLPLSNFQINDWPDLSAKSYAIMVLILPTDGARKWRDYELELVDVVADQVAVALSHAAIIEESMRARDQLMEQNVALDLARREAERAIHARNDFLAVMTHEMRTPMHATIALSSLLLESELSPEQRVVIETVLKSSNLLATLINDVLDLSRLEDGSLELEIGTFNLHGVFREVLNLIKPIASVKKLSMTLLLTPDLPVCAVGDEKRLMQTVLNVAGNALKFTKEGYVSIIASVAKPESFRDWRAPEFYPIASDGHFYLRVQVDKDSGCGILPQDIPHLFTKFTQSQSGSNRRNGGAGLGLAICKRIRFVNIMGGHIWIESEGPDKGSIATFIVKLGICDNPNDSALQQVAPIGRAHNASGDLTGHKPVSRDIVNMDSSNLRYQRSF

SEQ ID NO: 7765 - protein, 312 aa, Candida glabrata
MESQQVDVDSIIDRLLEVRGSKPGQQVDLEEHEIRHLCSKARSIFIKQPILLELEAPIKICGDIHGQYYDLLRLFEYGGFPPESNYLFLGDYVDRGKQSLETICLLLAYKIKYPENFFILRGNHECASINRIYGFYDECKRRYNIKLWKTFTDCFNCLPIAAIIDEKIFCMHGGLSPDLNSMEQIRRVMRPTDIPDVGLLCDLLWSDPDKDIVGWSENDRGVSFTFGPDVVNRFLQKQDMELICRAHQVVEDGYEFFSKRQLVTLFSAPNYCGEFDNAGAMMSVDESLLCSFQILKPAQKSLPRQQAGRKKK

SEQ ID NO: 7766 - protein, 375 aa, Fagus sylvatica
MCGGAIISDFIAPTGSRRLTADYLWGDRKKPISGKRFSKPVVDLDDEFELDFQGFKDEEESDIDEEEVLVQDVKPFTFSAPPSSGSKPVKSVEFNGQAEKSAKRKRKNQYRGIRQRPWGKWAAEIRDPRKGVRVWLGTFNTAEEAARAYDAEARRIRGKKSKGNFPMRLPVPKRSVKANLQKPLAKANLNSVQPNLNQNFNFMNSDQDYTMGLMEEKPFTNQYGYMDSIPVNADVGLKSFASNNTAPYFNSDQGSNSFDCSDYGWGEQGSKTPEISSVLSATLEGDESQFVEDAVPTKKLKSDSGNAVFIENNTAKTLSEELSAFESQMNFQMPFLEGSWESNMEALFSGDTTQDGNSMDLWSFDDLPVMAGGVL

SEQ ID NO: 7767 - protein, 551 aa, Glycine max
RAEFGSRAIQATKVVFNHLYDPVSLVRDHNIKEKLVEQGISVQSYNGDLLYEPWEVNSESGRAFTTFNAFWKKCLHMQMDIVSVVPPWQLIPAEGKIEECSLEELGLENESEKPSNALLGRAWSPGWRNADKALREFVELHLLHYSKKRLKVGGESTSLLSPYLHFGELSARKVFQVTCMKQILWTNEGNSAGEESANLFLRAIGLREYSRYLCFNFPFTHERALLGHLKFFPWNPDPDIFKTWRQGRTGFPLVDAGMRELWATGWIHNRIRVIVSSFAVKMLLLPWKWGMKYFWDTLLDADLESDILGWQYISGGLPDGHELERLDNPEIQGAKFDPEGEYVRQWLPELARMPTEWIHHPWDAPLTVLRAAGVELGQNYPKPIIDIDLARERLTEAIFKMWESEAAAKAAGSEPRDEVVVDNSHTVENLDTQKVVVLGKAPCATISANDQKVPALQDSKNEPPTRKRPKHMIEEGQNQDHSQNHNKDTGLSSIDQDICSTADSSSCKKQCASTSSYSFSVPQQCSSSSNLKWPWQEKIDMEQSSSKDGAM

SEQ ID NO: 7768 - protein, 309 aa, Triticum aestivum
  misc_feature (62)..(62): Xaa can be any naturally occurring amino acid
  misc_feature (66)..(66): Xaa can be any naturally occurring amino acid
  misc_feature (125)..(125): Xaa can be any naturally occurring amino acid
  misc_feature (135)..(135): Xaa can be any naturally occurring amino acid
  misc_feature (285)..(285): Xaa can be any naturally occurring amino acid
  misc_feature (296)..(296): Xaa can be any naturally occurring amino acid
MSASPSMSGGAGERTRTRTVVWFRRDLRVEDNPALAAAARTAGEVVPAYVWAPEEDGPYYPXGCPXWWLTQSLKHLDASLRRLGATRLVTRRSTDTVAALLELVRSTGAPRLRFNHLYDPLSLVXRNHRVKQVLXAQGITRQSFNSHLLYEPWEVLDDHGCPFTMFTPFWNTCLCMVDPPAPMLPPKRINSGELSRCCSSDDLIFEDESERGSNALLARAWSPGWQNADKAFTAFINGPLIDYSVNRKKADSANTSLLSPYLHFGELSVRKVFHQVRMKQLTWSXESNGDGEEGCXLFLRSIGLREYSR

SEQ ID NO: 7769 - protein, 465 aa, Chlamydomonas reinhardtii
MGSCLAKPAESAEQKKASSVPSPPPAPAPQPVQQAAAPAPKDSGDVKPGQQATPVPPPSPPPQPKPAPPAQPAPAPAAKVVEAIPAVADEKSPQGKQPRRSQEHDNGVKAEEIELVKQKSTEPQPSASATAAVATPKAIEPAMEPKVAAPSAPAAAPAPAQAPAAAPTPARPGSKLRTDVKLRDLYKLGKTLGTGGFSVVKLATDRGTGVEYACKIMALPPVGQEVGENENTREDIFKEIDLLCGMNHENVIFLKEYFEEGNKVYLITELLTGGELLEAVLKRGSYTEAEARLCFVQVLRGIEYLHSKNVVHRDLKLENLLLAKQDDISLVKIADFGLAKHAVNGMQTICGTPQYVAPEVIVGAKGHVYGPGVDMWSAGVVLYILLGGYPPFWSDSEPQLFDMIRKGKYSFGDPVWNKVSEGAKDLIRKLLVVDPTKRLSATEALQHQFILEGNFNPPSTPKGPR

SEQ ID NO: 7770 - protein, 192 aa, Cupressus sempervirens
DDHGEVISEIRRPDLEPYLGLHYPATDVPQASRFLFMKNKVRMICDCYANPVEVVEDKRLPRELILCGSSLRAPHGCHAEYMSNMGSIASLVIAVTINAKEEDVDTDAQQQQQKGRRLWGLVVCHHTSPRFVPFPLRYACEFLMQVFAIQLNKEVDLADQLREKHILRTQTLLCDMLLRDAPMGIIREKPNI

SEQ ID NO: 7771 - protein, 106 aa, Saccharum officinarum
MAEAHNGRRVGMVGDVRDAPAGHENDLEAIELARFAVAEHNSKTNAMLEFERLVKVRHQVVAGTMHHFTVQVKEAGGGKKLYEAKVWEKVWENFKQLQSFQPVGDA

SEQ ID NO: 7772 - protein, 274 aa, Oryza sativa
  misc_feature (10)..(10): Xaa can be any naturally occurring amino acid
  misc_feature (30)..(30): Xaa can be any naturally occurring amino acid
  misc_feature (225)..(225): Xaa can be any naturally occurring amino acid
  misc_feature (240)..(240): Xaa can be any naturally occurring amino acid
DPRAAGWKPXCGVKSLLDDEAVTVGGTNHXHATQDLYDSIAAGNFPEWKLFIQTIDPDHEDRFDFDPLDVTKTWPEDIVPLQPVGRMVLNRNIDNFFSENEQLAFCPGIIVPGIYYSDDKLLQTRIFSYSDTQRHRLGPNYLLLPPNAPKCAHHNNHYDGFMNFMHRDEEVDYFPSRYDPAKHAPRYPIPSATLTGRREKVVIAKENNFKQPGERYRSWDPARQXRFIKRWIDALSDPRXLTHEIRSIWLSYWSQADRSLGQKLASRLSAKPSM

SEQ ID NO: 7773 - protein, 917 aa, Pseudomonas fluorescens
MLKKLGIKGRVLLLTLLPTSLMALVLGGYFTWMQQSDLHAQLLQRGEMIAEQLAPLVAPAMSRQDTDLLERIATQSLEQADVRAVTLLAPDRTPLAHAGPTMLNRAPEGNSAQLQQRTGNDATRYLLPVFGKHRNLAGELIPEEADRLLGWVELELSHSGMLLSGYRSMFASLLLIAVCLGLTALLALRMGRTINRPLSQIKHAVAQLKDGHLETRLPPLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDNIPFNLRDLLQDTLTILAPAAHAKQLELVSLVYRDTPLSLVGDPLRLKQILTNLVSNAIKFTREGTIVARAMLEDEHEDSVQLRISIQDTGIGLSNQDVRALFQAFSQADNSLSRQPGGTGLGLVISKRLVEQMGGEIGVDSTPGEGSEFWISLRLPKTRDDAEDLPGPPLLGRRVAVLENHELARQALQHQLEDCGLQVTPFNTLESLTNGITVAHQTDQAIDLAVLGITSNDMPPERLNQHIWDLEHLGCKVLVLCPTTEQTLYHLSVPNPHSQLQAKPACTRKLRRSLSDLVNPRPTRSEPHEPVASRAPKVLCVDDNPANLLLVQTLLEDMGAKVLAVESGYAAVKAVQKETFDLVLMDVQMPGMDGRQNTEAIRQWESERHCTPLPIVALTAHAMANEKRALLQSGMDDYLTKPISERQLAQVVLKWTGLALRNQSPDRGGDAQGNGSELLVLDHEEGLRLAAGKADLAADMLAMLLASLEADREAIRQASEANDHNALIERVHRLHGATRYCGVPQLRAACQRSETLLKQQDPKAAAALEELERAINRLASEARISA

SEQ ID NO: 7774 - protein, 761 aa, Methanosarcina acetivorans
MVFKMIELYTSDKPKVLIIDDEKDQVELLCLQLEDEYLPIPAYSGKEAIELVKAKLPDLILLDLMLPENDGYEICSTLKSDPEYRFIPIIIISRFFEKTNKMKATRCGADDFIHKPINRFELKTRIKSLIRIKKNYEALQESENRYKQLFNNSPAVTLLIDPVDYLIADANEPACAYYGYTYAEMTAKKITDISIYSRERNRKISQQVFSEKKGHFYSCHKLASGEIRHVEMYINTINIRGRELFFTNVYDVTASKKIERELTESEEKFKQVVELSIDGIIIGANSGKIVDCNEAACRIFGYGKEEMLELNVDNILREDFMQSIPEIITTGKAVSENKTIESINKRKDGTFFTAEIATRTFKLGDEDRLIVYVRDITERKKAERDLKSSEENFRALVNNTLDGIIILNFEGEVIAANAAVGKMFNVELEKITGTNIAKYLAPESVPVAIRDQINVLNNQGGYLSVYKAISSMGEHFWIEGLGTKIIYQNQPANIVVIRDITVRKKAEEALINAKTAAEVANRTKSEFLTNMSHELKTPLNSIIGFSDLLKEEIAGPLNEKQSRYVQFISSSGKNLLEIINDILDLSKAESGEEDLNVEKFSVDESINKVISVVLPQAQEKNIILNYQSENRTLWITADEGKFRQIMENLLSNAIKFTPAGGSIDVTLKQEGLLVTIEVKDTGIGIPEDSFEKIFKPFIQIDSSLSRNFEGTGLGLTLVKKYVEMHGGNIYVESKIGEGSSFRFELPVTRKRTVEPVLKVLE

SEQ ID NO: 7775 - protein, 123 aa, Triticum aestivum
  misc_feature (65)..(65): Xaa can be any naturally occurring amino acid
CSSLHTRHEQQPGPWALLVEQRSSHGVPSIEKITFLLVRYQTIHVLQIRDSSSLVEVRRIGAFCXEDDELCLHSHGQAAQWSSFLPGIKQRLLSFIFHRTWNEEPEQALLTYLAILHAVDAAA

SEQ ID NO: 7776 - protein, 92 aa, Daucus carota
DLPGLKKEEVKVEVEEGKVLQISGERNKEKEEKNDKWHPLEVSSGKFLRRFRLPENANVDEVKAGMENGVLTVTVPKVEMKKPEVSVIDISG

SEQ ID NO: 7777 - protein, 548 aa, Zymomonas mobilis
MAAKDVKFSRDARERILRGVDILADAVKVTLGPKGVTLFWTKPLVLPYHQRWCFCRQRNRTERQVRKYGHRCLREVPSKTNDLAGDGTTTATVLAQAIVREGMKSVAAGMNPMDLKRGIDLAATKVVESLRSRSKPVSDFNEVAQVGIISANGDEEVGRRIAEAMEKVGKEGVITVEEAKGFDFELDVVEGMQFDRGYLSPYFITNPEKMVAELADPYILIYEKKLSNLQSILPILESVVQSGRPLLIIAEDIEGEALATLVVNKLRGGLKVAAVKAPGFGDRRKAMLEDIAILTKGELISEDLGIKLENVTLNMLGSAKRVSITKENTTIVDGAGDQSTIKDRVEAIRSQIEATTSDYDREKLQERVAKLAGGVAVIKVGGATEVEVKERKDRVDDALHATRAAVQEGIVPGGGTALLYATKALEGLNGVNEDQQRGIDIVRRALQAPVRQIAQNAGFDGAVVAGKLIDGNDDKIGFNAQTEKYEDLAATGVIDPTKVVRTALQDAASVAGLLITTEAAVGDLPEDKPAPAMPGGMGGMGGMGGMDF

SEQ ID NO: 7778 - protein, 676 aa, Ralstonia solanacearum
MRSIVKSLLHPSSRAPAAHRAQDAALFSTHPQGDAPPIRPSAWLVAIGAAVAGTFARLMLESAAGIRLPFYLAFPVVTVAAWYGGFWPGVVAIAGYAALFAGLAALQISPPPAQPILPTQLVVLALGTLLICVLCEQLRRARAGAERRARAETQQRVSQQRLLAALQASPISLYDVDNTMHFTWVHNPVFGLQPHELLGRTVREVFGRRAASRLTDAGQRVIATGLPTRVEFAFRRRHTQRVVYDVVVMPLRDDTGEIIGLTNAVIDITEHRQAEARRALLLEAESRAREEAERASRLKDDFLATVSHELRTPLNAVLGWAQLLAMRPYDEAMFRRGLEAIERSARTQVHLIDDLLDMSAILSGKVPLEIGPVDLADVLERARETIEPMARQKQITVDTEYLPVPLLQGDAGRLKQVFWNLLANAVKFTPEGGHVRITVQAGADGLVATVRDTGIGIEPTFLPHVFDRFQQADLSSTRRHGGLGLGLAIAKQLVELHHGHITAASSGADLGTTMAVTLPLHAPPSNEPPGRAPGLVTGTAAPALDGLRVLVVDDNAESLGVIALMLERYGAEVVTVASGAAALDALDRAAGGPPFDALVSDLAMPGMDGMQLLRAIRARGLTALPAIAVTAFADPIRLKAAKEAGYQSVITKPIFPGELGHVLAANVRRATGPQDA

SEQ ID NO: 7779 - protein, 157 aa, Daucus carota
MSIIPSFFGGRRSNVFDPFSLDVWDPFKDFPLVTSSASEFGKETAAFVNTHIDWKETPQAHVFKADLPGLKKEEVKVELEEGKVLQISGERNKEKEEKNDKWHRVERSSGKFLRRFRLPENAKVDEVKAAMANGVVTVTVPKVEIKKPEVKAIDISG

SEQ ID NO: 7780 - protein, 483 aa, Rhodopseudomonas palustris
MLTPASSRPLIVWFRDDLRLADHPALHAAAQSGAPVLCVYVLDEVSDDVRALGGAVRWWLAQSLRALESELRALGGALILRRGPTAAVLAELAQQHDAAAVHWNEIEIAAHRAVADALADALTVAGIAYHRHRGDTLVEPSAIRSKDGRGMRVFTPFWRRVLSLGDPPQPLPRPTTLRPAPAVPTEQLSDWQLEPTAPDWAGGLRQTWTPGEAAAQTRLAAFLAMQPGYAEGRDYPDRHITSGLSPHLRFGEISPRQVWYAARFAAAERPAIAPDIDKFLSEVGWREFCRHLLFDHPDLASRNLQPAFDAFPWQSDDAVLTAWQRGRTGYPIVDAGMRELWHSGVMHNRVRMVVGSFLVKHLLIDWRLGEQWFWDTLVDADPGSNPGNWQWVAGCGADAAPYFRVFNPVLQSEKFDAGGAYIRRWVPELARLPNDLIHQPWTATPLELAAAGIKLGGNYPGPIVDHKTGRQRALSAYAELRQR

SEQ ID NO: 7781 - protein, 159 aa, Daucus carota
MSIIPSFFGSRRSNVLNPFSLDIWDPFQDYPLITSSGTSSEFGKETAAFANTHIDWKETPQAHVFKADLPGLKKEEVKVEVEEGKVLQISGERNKEKEEKNNKWHRVEFSSGKFLRRFRLPENANVDEVKAGMENGVLTVTVPKVEMKKPEVKSIHISG

SEQ ID NO: 7782 - protein, 492 aa, Zea mays
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYSLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAISVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLPSRLNLKPSM

SEQ ID NO: 7783 - protein, 491 aa, Zea mays
MDPYKHRPSSAFNAPYWTTNSGAPVWNNDSSLTVGARGPILLEDYHCEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRPTCGVRSLMDDEAVRCGANHSHATKDLTDAIAAGNFPEWTLYIQTMDPEMEDRLDDLDPLDVTKTWPEDTFPLQPVGRLVLNRNIDNFFAENEQLAFCPGLIVPGIYYSDDKLLQTRIFSYSDTQRHRLGPNYLLLPANAPKCAHHNNHYDGSMNFMHRHEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 7784 - protein, 402 aa, Streptomyces coelicolor
MEFRQSNKLSEVCYEIRGPVIEHANALEEAGHSVLRLNTGNPALFGFEAPEEIVQDMIRMLPRAHGYTDSRGILSARRAVAQRYQALGLEVDVDDVFLGNGVSELISMAVQALLEDGDEVLIPAPDFPLWTAVTTLAGGKAVHYLCDEQAEWYPDLADMEAKITDRTKAVVIINPNNPTGAVYPKEIVEGILDLARRHGLMVLADEIYDQILYDDAVHHSAASLAPDLVVLTFCGLSKTYRVAGFRSGWLVVTGPKQHARDYLEGLTMLASMRLCANAPAQYAIQAALGGRQSIRELTAPGGRLHEQRDVAWEKLNEIPGISCVKPKGALYAFPRIDPAVHKIHDDERFVLDLLLREKIQVVQGTGFNWPSPDHFRILTLPHAEDLEAAIGRIGRFLSGYRQ

SEQ ID NO: 7785 - protein, 495 aa, Zea mays
MTMDPTKFRPSSSHDTTVTTTNAGAPVWNDNEALTVGPRGPILLEDYHLIEKVAHFDRERIPERVVHARGASAKGFFESTHDVTSLTCADFLRAPGVRTPVIVRFSQVIPEPGSGRTIRDARGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGERCILTDEEARVGGRNHSHTQDLYDSIAAEGSFPEWTLYVQVMDPAQEEQYDFDPLDDTKTWPEDLLPLRPVGRLVLDRNVDNFLNENEQLAFGPGLVVPGIYYSDDKMLQCRVFAYADTQRYRLGPNYLMLPVNAPRCGTHNNHYDGAMNLMHRDEEVDYYPSRHARRCGRAAPTPLPPRPVAGRREKATIRKPNDFKQPGERYRSWDADRQDRFVKAIRRLARTPKGQPELRSIWIDLLAKVDASLGMKIATRLNMKANM

SEQ ID NO: 7786 - protein, 94 aa, Zea mays
KEQFSDGVGYGWIDALKDTAEKQVTDEMMKNPKPEWGNDIPDTKEAYWYRCMFDEHFPPHCASTVMRWTPTWSKQTDPSGRAIATHNAKYDSAA

SEQ ID NO: 7787 - protein, 181 aa, Cupressus sempervirens
DDHGEVVAEMRRPDLEPYLGLHYPATDIPQSSRFLFLKNRVRTICDCRAPAVKVRHDESLGQVLSLQGSTLRAPFGCHAQYMANMGSIASLVMAVTVSDSEEGGRRLWGLVVCHHTTPRFVPYPLRYACEFLMQVFGIQLNKELELASRLRERHIFRTQTLLCDMLLRDAPVGIVTTTPNI

SEQ ID NO: 7788 - protein, 264 aa, Unknown
  Gerbera hybrid cv. 'Terra Regina'
MENSDVLELDFSCVDRSMSFPDDTGDMSPQRKMGKGKIEIKRIENTTNRQVTFCKRRNGLLKKAYELSVLCDAEVALIVFSSRGRLYEYANNSVKGTIDKYKKACLDPPTSGTVAEANTQYYQQEAAKLRQQIANLQNQNRQFYRNIMGESLGDMPVKDLKNLEGKLEKAISRIRAKKNELLFAEIEYMQKRELELHNSNQFLRAKIVENERAQQHHMSLMPGSSDYELVTPHQPFDGRNYLQTNDLQPNNDYSCQDQTPLQLV

SEQ ID NO: 7789 - protein, 389 aa, Euphorbia esula
MEDASATTTAPSDSLNNHQLPPTAGIENIPATLSHGGRFIQYNIFGNIFEVTAKYRPPIMPIGKGAYGIVCSALNSETGEHVAIKKIANAFDNKIDAKRTLREIKLLRHMDHENVVAIRDIMPPPQREVFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEEELGFLNENAKRYIRQMSVFRRQSFTEKFPTVHPAAIDLVEKMLTFDPRQRITVEDALAHPYLTSLHDISDEPVCMTPFSFDFEQHALTEEQMKELIYREALAFNPEYQQQ

SEQ ID NO: 7790 - protein, 542 aa, Sinorhizobium meliloti
MAAKEVKFQTDARERMLRGVDVLANAVKVTLGPKGRNVVIDKSFGAPRITKDGVSVAKEIELEDKFENMGAQMLREVASRTNDLAGDGTTTATVLAQAIVREGAKAVASGMNPMDLKRGIDLAVDAVVKELKNNARKISKNSEIAQVGTISANGDTEIGRYLAEAMEKVGNEGVITVEEAKTAETELEVVEGMQFDRGYLSPYFITNQDKMRVELEDPYILIHEKKLSNLQAMLPVLEAVVQSGKPLLIIAEDVEGEALATLVVNKLRGGLKVAAVKAPGFGDRRKAMLEDIAILTGGTVVSEDLGIKLESVTLDMLGRAKKVSIEKENTTIIDGAGSKADIEGRTAQIRAQIEETTSDYDREKLQERLAKLAGGVAVIRVGGSTEVEVKEKKDRVDDALHATRAAVEEGILPGGGVALLRAVKALDGLKTANNDQRVGVDLVRRAIEAPVRQIAENAGAEGSIIVGKLREKTEFSYGWNAQTNEYGDLYAMGVIDPAKVVRTALQDAASVAGLLVTTEAMIAEKPKKEAAPALPAGGGMDF

SEQ ID NO: 7791 - protein, 188 aa, Glycine max
NEEEEQIRKMASKVPKKANLLDHHSIKHILDESVSEVVTSRGYVEDVRLSNARLFIGAIIIVIALFAQFYKKKFPENRDFLIACIAFGLLQLIIYTKEKNAILFTYPPVGSFTSTGLVVSSKLPRFSDMYTLTIASADPKSISANEPVHFTKSVTQWFTKDGVLVEGLFWKDVEALIVQYTKEPKKGK

SEQ ID NO: 7792 - protein, 246 aa, Unknown
  Gerbera hybrid cv. 'Terra Regina'
MSFPNDSGEMSPQRKLGRGKIEIKRIENTTNRQVTFCKRRNGLLKKAYELSVLCDAEVALIVFSSRGRLYEYANNSVKGTIDRYKKACLDPPSSGSVAEANAQFYQQEAAKLRQQIANLQNQNRQFYRNIMGESLGNMPAKDLKNLESKLEKGIGKIRSKKNEILFAEIEYMQKRENELHNSNQFLRSKIAENERAQQHMSLMPGSSDYELVAPHQPFDGRNYLQVNDLQPNNNYSCQDQTPLQLV

SEQ ID NO: 7793 - protein, 188 aa, Stigmatella aurantiaca
MADLSVRRGTGSTPQRTREWDPFQQMQELMNWDPFELANHPWFANRQGPPAFVPAFEVRETKEAYIFKADLPGVDEKDIEVTLTGDRVSVSGKREREKREESERFYAYERTFGSFSRAFTLPEGVDGDNVRADLKNGVLTLTLPKRPEVQPKRIQVASSGTEQKEHIKAYPAPAEPGLAAPLGWPGFS

SEQ ID NO: 7794 - protein, 192 aa, Dacrydium cupressinum
DEHGEVISEIRKSDLEPYLGLHYPATDIPQASRFLFMKNRVRMICDCHAPPVRVVEDKRLPRELNLCGSTLRALMGCHAQYMSNMGSIASLVIAVIVNEKDEEEGDSEDNIQQKGRKLWGLVVCHHTSPRFVPFPLRYACEFLVQVFGIQLNKEVELAAQVREKHILRTQTLLCDMLLRDAPTGIVTQKPNI

SEQ ID NO: 7795 - protein, 678 aa, Sinorhizobium meliloti
MPNDPLLQPYQLKHLTLRNRIIVTAHEPAYPEDGMPKERYRAYTVERARGGVAMTMTAGSAAVSKDSPPVFNNLLAYRDEIVPWIREMTDAVHEEGAVIMIQLTHLGRRTRWDKGDWLPVVAPSHHREAAHRAFPKKIEDWDIDRIIKDFADAAERMKAGGMDGVELEAYGHLIDQFASPLTNELDGPYGGSLDNRMRFCFDVLKAIRARVGDEFILGVRYTADECLPGGTDKAEGLEISKRLKESGLIDYLNIIRGHIDTDPGLTDVIPIQGMANSPHLDFAGEIRAATNFPTFHAAKIPDVATARHAIASGKVDMVGMTRAHMTDPHIVRKIIEKREEDIRPCVGANYCLDRIYQGGAAYCIHNAATGRELTMPHSIAKAHCRRKVVVVGTGPAGLEAARVAGERGHEVIVFEAASDPGGQVRLTAQSPRRREMISIIDWRMSQCEKLGVTFHFNTWAEAEAIQAESPDVVIIATGGLPHTEVLSRGNELVVSAWDIISGDAKPGTNVLIFDDAGDHAALQAAEFLATAGARVEIMTPDRSFAPEVMAMNLVPYMRCLQKLDVTFTVTYRLEAVEKSGNELVAHVGSDYGGISKQRTFDQVVVNHGTIPLDELYFELKPFSSNLGEIAHDQMIAGEPQSVVRNAEGKFQLFRIGDAVAARNTHAAIYDALRLLKDI

SEQ ID NO: 7796 - protein, 467 aa, Triticum aestivum
MGRRSGGRKLPFFSAASSSSSTKRTRSARRLPSLPKPSSPPPPSPTTPPPAPQTTTSPPAPSPGGSAAVAGVSGKVGKKKAGARLWMRLDRWGSSEILELDKASIIRRAGVPPRDLRILGPVFSHSSNILAREKAMVINLEFIRAIVTAEEVLLLDPLMQEVLPFVDQLRQHLPLRSLVGGNGEHGGDSNGVKQDGSPGDQVPCLNEATGAEHELPFEFQVLEVGLEAVCSTLDSSVADLERRAIPVLDELTKNVSTKNLERVRSLKSDLTRLLARVQKVRDEIEHLLDDNEDMAHLYLTRKQAQNQQVEAIMTSAASNSIVPAGASLPRLNSSFRRSVSIATSIYLDNDVEDLEMLLEAYFMQLDGIRNRILSVREYIDDTEDYVNIQLDNRRNELIQLQLTLTIASFGIAVNTFIAGAFAMNIPCHFYDTDGSFFWPFVGGTSSGCFVISVVLLGYAWWKKLLGP

SEQ ID NO: 7797 - protein, 469 aa, Bacillus anthracis
MFQKDFRLYDNPALFEAAQSGEVVPVYVHDETFSMGSASKWWLHHAIIDVKKQLEALGSTLIIRKGSTQEEILSLVEQLGITAVYWNICYDPDRLQSNQKMKMMLEHKGMICKEFNSHLLLEPWVIKKKDNTEYKVFTPFYNAFQKQVIHKPISKVQSIKGGNSLPVSLSVSELHLLPTIPWTSHMESIWEPTEEGAYKTWKEFFSSKLASYSEGRDFPNQNAHSMLAPYLSFGQISVKLIYHYLINKSTESQCSLFEKQVNSFIRQLIWREFSYYLLYHYPFTAYKPLNKSFEHFPWNNEEELLRVWQKGDTGYPFIDAGMRELWQTGFMHNRTRMAVASFLVKHLLIPWQEGAKWFMDTLLDADIANNTMGWQWVAGSGADASPYFRIFNPITQGEKFDKNGEYIRKWVPELKDMPNKYIHKPWEAPEHILQKANIQLGHTYPLPVVDHKAARERALCAYKSMKEFV

SEQ ID NO: 7798 - protein, 242 aa, Lycopersicon esculentum
MGTGKVELKRIENKINRQVTFAKRRNGLLKKAYELSILCDAEIALIIFSSRGKLYEFCSNSSMSKTLERYHRYNYGTLEGTQTSSDSQNNYQEYLKLKTRVEMLQQSQRHLLGEDLGQLGTKDLEQLERQLASSLRQIRSTKTQHILDQLAELQQKEQSLTEMNKSLRIKLEELGVTFQTSWHCGEQSVQYRHEQPSHHEGFFQHVNCNNTLPISYGYDNVQPENAAPSTHDATGVVPGWML

SEQ ID NO: 7799 - protein, 493 aa, Euphorbia characias
MDPYKFRPSSAYNSGFFTTNSGAPVWNNNNSLTVGSRGPILLEDYHLVEKLANFDRERIPERVVHARGASAKGFFQVTHDISHLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLHMFTFLFDDIGVPQDYRHMDGSGVNTYTLINKAGKAHYVKFHWKPTCGVKSLLEEEAIKIGGANHSHATQDLYDSIAAGNYPEWKLFIQTMDPADEDKFDFDPLDMTKIWPEDMFPLQEIGRLVLNRNIDNWFAENEMLAFDPGLIVPGIYYSQDKLFQLRTFAYADTQRHRLGPNYKMLPVNAPKCPYKNNHFDGAMNFMHRDEEVDYFQSRYAPTSHAEQVPIPNAIISGGRRMKTVLPKECNFKQPGERYRSWAPDRQERFLCRLANALSEPRISQEIRGIWVSWWAQCDQTLGQKLASRLNVRPNI

SEQ ID NO: 7800 - protein, 459 aa, Helicobacter pylori
MVLLTMTKRLFKGLLAVSLAVSLHGGEVKEKKPVKPVKEDPQELAAKRVEAFSRFSNVVSEIEKKYVDKISISEIMTKAIEGLLSNLDAHSAYLNEKKFKEFQAQTEGEFGGLGITVGMRDGVLTVIAPLEGTPAYKAGVKSGDNILKINNESTLSMSIDDAINLMRGKPKTPIQITVVRKNEPKPLVFNIIRDIIKLPSVYVKKIKETPYLYVRVSGFDKNVTKSVLEGLKANPKAKGIVLDLRGNPGGLLNQAVGLSNLFIKEGVLVSQKGKNKEENLEYKANGRAPYTNLPIAVLVNGGSASASEIVAGALQDHKRAVIIGEKTFGKGSVQMLLPVNKDEAIKITTARYYLPSGRTIQAKGITPDIVIYPGKVPENENKFSLKEADLKHHLEQELKKIDDKTPNSKEADKDKKNEEEKEITPKMINDDIQLKTAIDSLKTWSIVDEKMDEKAPKKK

SEQ ID NO: 7801 - protein, 253 aa, Unknown
  Petunia x hybrida
MALEALNSPTTTTPPSFQFENNGLKYLESWTKGKRSKRQRSMERQCTEEEYLALCLIMLARSDGSVNNSRSLPPPPLPPSVPVTSQINATLLEQKNLYKCSVCGKGFGSYQALGGHKASHRKLVSMGGDEQSTTSTTTNVTGTSSANVNGNGRTHECSICHKCFPTGQALGGHKRCHYDGGNGNGNGSVSVGVTSSEGVGSTISHHRDFDLNIPALPEFWPGFGSGEDEVESPHPAKKSRLSLPPKLELFKGL

SEQ ID NO: 7802 - protein, 117 aa, Glycine max
  misc_feature (38)..(38): Xaa can be any naturally occurring amino acid
  misc_feature (78)..(78): Xaa can be any naturally occurring amino acid
  misc_feature (99)..(99): Xaa can be any naturally occurring amino acid
MATETNVPVLGGITDVQGAANSVEINNLARFAVEEQNXRENSVLEFVRVISAKQQVVAGVNYYITLEAKDGVIKNEYXEAKVWVRVWLNSLELLQFNPXLVMVSSSAIRNDWYSWGV

SEQ ID NO: 7803 - protein, 227 aa, Arabidopsis thaliana
MALEALTSPRLASPIPPLFEDSSVFHGVEHWTKGKRSKRSRSDFHHQNLTEEEYLAFWLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 7804 - protein, 262 aa, Fagus sylvatica
VDRGQHSLETITLLLALKIEYPENVHLIRGNHEAADINALFGFRLECIERMGENDGIWAWTRFNQLFNYLPLSALIEKKIICMHGGIGRSIHSVEQIEKLERPITMDAGSIILMDLLWSDPTENDSVEGLRPNARGPGLVTFGPDRVTDFCKKNKLQLIVRAHECVMDGFERFAQGQLITLFSATNYCGTANNAGAILVVGRGLVVVPKLIHPLPPPLQSPETSPERIQEDTWMQELNIQRPPTPTRGRPQPDLDRSSLAYI

SEQ ID NO: 7805 - protein, 163 aa, Zea mays
MDAVMFGLETPLMAALQHLLDVPDGDAGAGGDSDNKTGGGATRTYVRDARAMAATPADVKELPGAYAFVVDMPGLGTGDIRVQVEDERVLVVSGERRREEREDAKYLRMERRMGKFMRKFVLPDNADVDKVAAVCRDGVLTVTVEKLPPPEPKKPKTIEVKVA

SEQ ID NO: 7806 - protein, 306 aa, Fagus sylvatica
MPSHSDLDRQIEHLMECKPLPEAEVKTLCDQARAILVEEWNVQPVKCPVTVCGDIHGEFYDLIELFRIGGNAPDTNYLFMGDYVDRGYYPVETVTLLVALKVRYRDRITILRGNHESRQITQVYGFYDECLRKYGNANVWKFFTDLFDYLPLTALIESQIFCLHGGLSPSLDTLDNIRALDRIQEVPHEGPMCDLLWSDPDDRCGWGISPRGAGYTFGQDIAAQFNHTNGLTLISRAHQLVMEGFNWCQDKNVVTVFSAPNYCYRCGNMAAILEIGENMDQNFLQFDPAPRQIEPDTTRKTPDYFL

SEQ ID NO: 7807 - protein, 710 aa, Xanthomonas axonopodis
MRRPASAAYANPSRIRQGRPFPRGAVFDGKGTNFALFSAHATRVELCLFDEQGNETRVDLPEYTNEIWHGYLPDAKPGQRYGYRVHGPYAPTEGHRFNHNKLLLDPYARELDGDLIWSDELYGYTVGHPDGDLSFDERDSAPFMPKCVVVEDTYDWGDDTRLLKPWNETVIYETHVRGYTMRNPQVPEAVRGTFAGLAQPQVLQYIKDLGITAVELLPVHAYLDDQHLLDKGLRNYWGYNTIGFFALKSRYLSSGHRDEFRDMVKAMHKQGLEVILDVVYNHTAEGSELGPTLSFKGIDNASYYRLADDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRRGRRPWASVNFITAHDGFTLRDLVSYNEKHNIDNGEDNRDGSSNDGSCNYGEEGDTDNAEVLQIRERQMKNLLATLLLSQGTPMMLSGDERAQTQGGNNNTYCQDNEITWLDWENDPTDGRLTEFVKALTRLRKRYPILSRGRFLNGQYNEEAGLRDLTWLNPGGIEMDDAHWTDPAARSVGLLLEGKAQTSGVKELANDDTLLIVINAYHEGVTFTLPSSDEPVHWKLVLSTDEALEVDMMPAGASEFLAPPRSVSVFECKSDQ

SEQ ID NO: 7808 - protein, 461 aa, Metroxylon sagu
FGFIRSADGITYREWAPGAKSATLIGDFNNWNPNADVMNRNEFGVWDIFLPNNADGSPPIPHGSRVKIRMETPSGIKDSIPAWIKFSVQAPGEIPYNGIYYDPPEEEKYVFQHPQPKAPKSLRIYESHVGMSSLEPKINTYVSFRDDVLPRIKRLGYNAVQIMAIQEHSYYASFGYHVTNFFAPSSRFGTPDELKSLIDRAHELGLLVLMDIVHSHASNNVLDGLNQFDGTDSHYFHSGLRGYHWMWDSRLFNYGSWEVLRFLLSNARWWLEEYKFDGFRFDGVTSMMYTHHGLQVAFTGNYNEYFGYATDVNAIVYLMLVNDMIHGLYPESVAIGEDVSGMPTFCIPVQDGGVGFDYRLHMAVPDKWIELLKLKDEDWKMGDIVHTLTNRRWLEKCVAYAESHDQALVGDKTIAFWLMDKDMYDFMALDTPSTPRIDRGIALHKMIRLVTMGLGGEGYLN

SEQ ID NO: 7809 - protein, 338 aa, Unknown
  Vibrio sp. Ex25
MSGLRTLGEFIVEKQADFPHASGDLSSLLASIRLAAKIVNREINAAGLGDITGAVGTENVQGEDQQKLDVYANDKFKAALEARDQVCGVASEEEDEAVAFNKELNQNAKYVVLMDPLDGSSNIDVNVSVGTIFSIYRRVSPIGTPATEEDFLQPGHKQVAAGYVIYGSSTMLVYTTGNGVNGFTYDPSIGSFCLSHENMMIPEEGKIYSINEGNYIRFPQGVKKYIKYCQENVPEDGRPYTSRYIGSLVADFHRNLLKGGIYLYPSTQSHPQGKLRLLYECNPMAFLIEQAGGIASDGVNRIMDIKPTELHQRVPFFVGSKNMVRKVEEFLELHRDEE

SEQ ID NO: 7810 - protein, 344 aa, Zea mays
  misc_feature (34)..(34): Xaa can be any naturally occurring amino acid
MRMLSKACSIVASSLPRCSSSAAAPTVALLSHLXRGQPSLLPSVRKQWPGKPLLYGIGTLLVMPLRTLYGVGRVFGAGRFLCNMTNVSSSLQIELVPCLRDNYAYILHDVDTGTVGVVDPSEAMPIINALEKRNQNLTYILNTHHHYDHTGGNLELKAKYGAKVIGSEKDKDRIPGIDITLKEGDTWMFAGHQVLVLETPGHTTGHVCYYFAGSGAIFTGDTLFNLSCGKLFEGTPQQMYASLQKITALPDDTKVYCGHEYTLSNAKFALSVEPGNKALQEYAANAAELRNKNIPTVPTTIGREKECNPFLRTSNPEIKRTLSVPDHFDEDRVLGVVRRAKDNF

SEQ ID NO: 7811 - protein, 443 aa, Metroxylon sagu
PRPPKPAAPRIYEAHVGMSGSEPCVSTYREFADNVLPRIKANNYNTVQLMAIMEHSYYASFGYHVTNFFAVSSRSGTPEDLKYLIDKAHSLGLRVLMDVVHSHASNNVTDGLNGFDVGQSTQDSYFHTGERGYHKLWDSRLFNYANWEVLRFLLSNLRWWLEEYQFDGFRFDGVTSMLYHHHGINMAFTGNYREYFSVATDVDAVVYMMLANHLVHKLLPDATVVAEDVSGMPALCRPVCEGGVGFDYRLAMAIPDKWIDYLKNQNDTEWSMQEIAGSLTNRRYSEKCIAYAESHDQAIVGDKTIAFLLMDKEMYSGMSDLEPASPVVERGTALHKMIHFITMALGGEGYLNFMGNEFGHPEWIDFPREGNGWSYDKCRRQWNLVDTDHLRYKHMNAFDRGMNLLDDRFSFLASTKQIVSSINEEDKVIVFERGDLVFVYNFH

SEQ ID NO: 7812 - protein, 414 aa, Unknown
  Nostoc sp. PCC 7120
MSYYIAPRFLDKLAVHITKNFLNIPGVRVPLILGIHGRKGEGKTFQCELAFEKMGIEVTLISGGELESPDAGDPARLIRLRYRETAELIKVRGKMCVLMINDLDAGAGRFDEGTQYTVNTQLVNATLMNIADNPTDVQLPGSYDSNPIRRVPIIVTGNDFSTLYAPLIRDGRMEKFYWEPNRDDKVGIVGGIFAEDGLSQREIEQLVDTFPKQSIDFFSALRSRIYDIQIRDFIHKVGFERISLRVVNSLEAPPEFKKPDFSLAHLIESGNLVLGEQQRVDNSQLVDEYNRLNRGRGYQTAPPPEAPVIQPVNNSSHKQKTSNTHLSLETQEQIRQILSQGHKITFEHVDARRFRTGSWQSCGTLHIDAESDAISTLEACLVDYDGEYVRMVGIDPKGKRRVVETIIQRPNGKN

SEQ ID NO: 7813 - protein, 358 aa, Unknown
  Vibrio sp. Ex25
MSNSVDLFSPIELGQLALDNRAIMAPLTRARASADHIPNDLMVEYYAQRASAGLIIAECTMVMEGTSAFMAEPGIYNEEQIAAWKKVTDAVHERGGKIVLQIWHAGRACHPELNDGKTPVAASALAIRDELVHTPSGKQAYTVPRALEVDEIASIVAAFKQGAKNAKRAGFDGVEIHGANGYLIDNFLRDGSNLRTDEYGGSVENRARFLLEIVKEVVEVWGPGRVGLRTSPLNGFNDMKDSDPVGLVRYLAKQLNAFDLAYWHVMRADLKGVQKADVLKPARENYQGYLMANVGYSAQEATTAIAENQVDVVAFGVPFIANPDLVERFKKNAPLNEAKPEHFYLGGAEGYTDYPVMA

SEQ ID NO: 7814 - protein, 368 aa, Candida albicans
MATLKNKNNHLKACSTYTDNENHFLVDSRYEIVRVLGKGSYGVVCSAIDTKSSVSAMEHKIAIKKVTKIFNKDILLIRAIRELKFMMFFRGHKNLDVVYVKPYEGLYCFQELADLDLARVLYSNVQFSEFHIQSFMYQVLCGLKYIHSADVIHRDLKPGNILVTTQGTLKICDFGLARGINPVYFRNRSAVITNYVATRWYRAPELIMSTKNYTKAVDIWAVGCILGELFGRRPLFPGKNSHEQIHELFKIIGNPPIETIKKYNWKVEGLLWVKYRPVKWKSLYPFAPLNALELLDSLLQWDYKARLGVEQILEPEFFKNLRNVHGEPSSKAIFDFSFEEKGKSIPQLKEILETEVRVFKEISKTGIE

SEQ ID NO: 7815 - protein, 728 aa, Unknown
  Magnetococcus sp. MC-1
MNQPLSEPMQRLVEARHHDPFELLGRHPDGKGGVLVRVYMPYAEQVRILERGTQQVLNMQRIDGSDFFEWQGQLEQVADDYRLMWKDKWGYEHLNRDPYAQLPMVSDFDLYLFNQGNHTQIQNFLGSHVMQDAHGAGVRFSVWAPNAERVSVVGDFNHWDGRCHPMRVLPNSGVWELFIPDLEPGGYYKFEVRDRLGVIHLKTDPMARQNQLRPETASVITPPSSFEWTDAAWLERRKDWDWQSAPISIYEMHPGSWQRGCEGEFLNYREMAHQLVPYLQELGFTHVELMPITEHPFDLSWGYQATGYFAPTRRFGRPDDFRYFVDYLHSHHIGVLLDWVPAHFPKDAHGLARFDGTPLYEHADPRLGEHLDWNTYIFNFGRNEVKSFLISSAMFWLNEFHLDGLRVDAVASMLYLDYSREEWIPNIYGGRENIEAVEFMRHLNSLVGRECPGALMIAEESTSWPSVTRPPENGGLGFHMKWNMGWMNDSLSYIAEDPIHRKYHHDKLTFSLYYAFSENFLLPFSHDEVVHGKGSMIGKMPGDEWQRFANLRALYLYQFTHPGKKLLFMGTEFGQGNEWNSTTVMEWSLLQYPLHSGMKQLVADLNHLYARLPALHKVDFSWQGFQWLDANDGEQSIAAYLRLDGETHVVVVINFTPVVRRNYRLGVPALSGYREVLNSDSSYYAGSNVGNGQALIMAEEKPWHEQSYSIELTLPPLGGVVLMPDQAE

SEQ ID NO: 7816 - protein, 478 aa, Listeria monocytogenes
MEHQKRSPFPKDFLWGSASAAYQIEGAWDADGKGKSVWDEYVRIPGTTFKGTNGDVAVDHYHRYKEDVKLMADAGLKAYRFSIAWTRIFPNGKGEVNEAGLQFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLASAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 7817 - protein, 372 aa, Candida albicans
MKKFTGPTQTRQVVFNISQNFKVLKILGEGAYGIVALAVHLPTETKVAIKKIEPFERPLFCLRTLREIKLLTKFKNHDNIVRLYDVQKPMNYDSFNEVYLIQGYMPSDLHNLIHTHLLSDQHVQYFIYQILKGLKMIHSARVIHRDLKPSNILVNEKCDLKICDFGLARLDTKHYNFDEAPRISMLTEYVATRWYRAPEIMLSASNYSTAIDLWSVGCILAELLTYRALFPGSDYINQLKLIFEVLGTPTDEDLQIIKSERAQKFIRSLPTKVKIDLSEFINNHPYRNIKHRGRDQVNPLAIDLLEKLLVFDPAKRITVQDALEHPYLNSYHEQLDEPVTSPIPIEEFDFDIDKKNLDTNDLKKQIFEIVMS

SEQ ID NO: 7818 - protein, 365 aa, Unknown
  Azoarcus sp. EbN1
MNSRLLEPVRLGALELPNRVVMAPLTRCRADNPEFAPTESTARYYAQRASAGLIVSEATIVSAQGRGYPYTPGIWSDAQVTGWRRVTDAVHAAGGRIVCQLWHCGRLSLTEFHDGELPVAPSAVNAEWKMFSAQGLKTTPTPHALSRDEIAAIVADFGRAARNAVLAGFDGVEIHSSNGYLIHQFFSPLANRRDDEYGGSHANRARFFFEVLDAVAAEWSPSRIGFRLNPMMNRFHGMRVDEDTLPMFEHVVRRTNAYELAYLHLTEPYLPNQLDGAVGAIDDVARHFRDIATMAVMTNGGFDQTRAEAALAAGTCDAVAFGRPYISNPDLVERFRAGAPLNEWDADTFYQGGDRGYIDYPTLGG

SEQ ID NO: 7819 - protein, 285 aa, Arabidopsis thaliana
HFLQLLQISYFPENHFPKKNKTFPFVLLPPTAITAYQSELGGDSSPLRKSGRGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQLMPPPQTQSQPFDSRNYFQVAALQPNNHHYSSAGRQDQTALQLV

SEQ ID NO: 7820 - protein, 202 aa, Phytolacca americana
KRRNGLLKKAYELSILCEAEVALIVFSSRGRVYEYSNNNIRSTIERYKKASSDGSNSASFIEINAQYYQQESAKLRQQIQVMQNSNRNLVGECLSSLNVKELKQLENRLERGMSRIRSKKHELLLADIEFLQKREKELEHENSFIRAKINEVERLQQLNMMPSEDLSAMNAFVTRSDHILAQNMLDTSSAFSNASKKLLHLG

SEQ ID NO: 7821 - protein, 165 aa, Triticum aestivum
  misc_feature (147)..(147): Xaa can be any naturally occurring amino acid
MAGMVFGLENPMMTALQHLLDIPDGEAGGAGAAGGEKQGPTRAYVRDARAMAATPADVKELPGAYAFVVDMPGLGSGDIKVQVEDERVLVISGERSREEEEDAKYLRMERRMGKLMRKFVLPENADMEKISAACRDGVLNRPTVREXLPARPKPKKPKTIQVQVA

SEQ ID NO: 7822 - protein, 176 aa, Arabidopsis thaliana
  misc_feature (76)..(76): Xaa can be any naturally occurring amino acid
  misc_feature (93)..(93): Xaa can be any naturally occurring amino acid
  misc_feature (114)..(114): Xaa can be any naturally occurring amino acid
  misc_feature (145)..(146): Xaa can be any naturally occurring amino acid
  misc_feature (148)..(148): Xaa can be any naturally occurring amino acid
  misc_feature (170)..(170): Xaa can be any naturally occurring amino acid
MDPYKYRPSSAYNAPFYTTNGGAPVSNNISSLTIGERGPVLLEDYHLIEKVANFTRERIPERVVHARGISAKGFFXEVTHDISNLTCADFFRXAPGCSKLPVICPFSPPLVHGXCPVPETMRGIRGFCRSKFSTGGGKFFFFWDXXPXFLIRDGVKSRFFPGLNPSPKKXPGSGFG

SEQ ID NO: 7823 - protein, 699 aa, Ustilago maydis
MAAATTSAAAQAPAPIDYSKATDGTGVIALDPWLEPFAPALRERYGVYADWVKRINASEGGLEAFSRSYRKMGFQIDPTTQAVTYTEWAPNAVQASLVGDFNNWSRDAHPMSKDDFGKWHITIPPLAKGQCAIPHDSKIKVSFVLPSGERIERLPAWILRVTQDLNVSPVYDARFWNPAKQDRYTMRFPKPPKPDNIKVYEAHVGIATPEARVGQFKEFTKNVLPRIKELGYNTIQLMAIQEHAYYASFGYQVTNFFAASSRYGNPEDLKELIDVAHSLGITVLLDIVHSHACKNVLDGLNMFDGTDHLYFHEGGKGRHELWDSRLFNYGHHEVLRFLLSNCLFWMEEYGFDGFRFDGVTSMLYTHHGIGTGFSGGYHEYFGPSVDVEAVVYLMLANQMIHEYNPKAITIAEDVSGMPALCRPVSEGGVGFDYRLSMAVPDMWIKLLKETSDEDWDFGNICFTLTNRRHLEKSIAYAESHDQALVGDKTLAFWLMDKEMYTNMSDLTERTQVIDRGLALHKMIRLITHALGGEGYLNFIGNEFGHPEWLDFPREGNGNSFHYARRQFNLVDDQLLRYKYLYAFDAAMNKAEEKYKWLAAPQAYISLKHDSDRVVAFERAGLLFVFNWHADKSYTDYRIGVDVPGKYRVLLDTDQASLGGHARLDHATEYFSTDMAWNGRSNFVQLYLPSRSAIVLYRAG

SEQ ID NO: 7824 - protein, 222 aa, Zea mays
MAGASLLSPSCTLLRLIPSASHFKRFDRVRRFAPAAMATSSGPKEAPANNPGLQTEVDPATKGYFLQQTMLRVKDPKVSLDFYSRVMGMSLLKRLDFEEMKFSLYFLGYEDVTLAPDDHIKRTEWTFRQKATLELTHNWGTENDPEFKGYHNGNSDPRGFGHIGVTVDDVHKACERFERLGVEFVKKPDDGKIKGIAFIKDPDGYWIEIFDQTIGTVTSSAS

SEQ ID NO: 7825 - protein, 166 aa, Aspergillus oryzae
MSLFRTMPTAGDFSPLFRLLDDYDTHRQSRGQVSSVRSFAPRFDVRETDDAYHFDGELPGISQKDIDIQFSDPQTLVIKGRSEREYHSPEAGETKETEGESKEVVKKENNKPRFWVSERSVGEFHRTFTFPSRVDQENVKASLKNGILSLVVPKAAAYTGKKITIE

SEQ ID NO: 7826 - protein, 716 aa, Claviceps purpurea
MVRTSLAAFSLAVAGLASAQCPFADPGRLAARAQGLDESSRGHLAGFEVDDSEGYLTSDVGGPIEDQNSLKAGDRGPTLLEDFIFRQKITHFDHERVPERAVHARGTGAHGTFTSYGDYSNITAASFLGQKDKKTPVFVRFSTVAGSRGSADTARDVHGFAVRLYTDEGNFDIVGNNVPVFFIQDAIQFPDLIHSVKPRQDNEIPQAATAHDSAWDFFSQQTSTLHTLFWAMAGYGIPRSLRHMDGFGVHTYRLVTDDGTSKLVKWHWKSKQGKASLVWDEAQRAAGKNADYHRQDLFDAIQSGNYPEWELNLQIINEDQALAFGFDVLDPTKIIPEEYAPLMPVGVMRLDANPSNYFAETEQVMFQPGHIVRGVDFTEDPLLQGRIFSYLDTQINRHGGPNFEQLPINRPVVPIHNNNRDGAGQNFIHKNNAPYTPNTLNKGFPKQANQKEGKGFFTAPGRKVSGSLQRRLSNTFLDHWTQPRLFFNSITPIEQQFLINAIRFETSHLSQVVQKNVLAQLNKISHDVAVRVGKALGLDAPPADDKYYHNNQTKGLSIFGEELPTIATLIVGVLASTASKNSLAQAQALKDAFKTREVNVIVVAESLATGVDQTYDAADAVSFDGIVVADGVEALFDNTKKSSLFQPGRPSQIVNDGYNWGKPMGFLGSAKRAVKATSVVEGAGVYMRNSTATLVGDFQKGLAKFKFTDRFPMDTK

SEQ ID NO: 7827 - protein, 366 aa, Unknown
  uncultured bacterium
MTDQNLFTPYTLGALTLSNRVVLAPLTRNRAGEGFVPSEFAATYYSQRASAGLLISEATQISRQGQGYQDTPGIYTPAQIDGWRTVTDAVHAKGGKIFLQLWHVGRVSHVDLQENGAAPVAPSALRAATKVFVNNRFEDVSEPRALDIKELPGIVADFRQAAANAVCAGFDGVEIHGANGYLLDQFLRDSANLRTDAYGGSIENRARLLLEVTAAVVNEIGADRTGVRLSPVSPANGVSSSDPQAQFDYVVEQLDALDVVYLHVVEGATGGPRDVAPFDFGALRQRFKNTYIANNGYDLDLATSKLAEDQADLIAFGRPFIGNPDLVERLKRGAPLSAFNPATLYGGGATGYIDYPTLAESSASAS

SEQ ID NO: 7828 - protein, 237 aa, Unknown
  Frankia sp. CcI3
MTDRLYFRQLLSGRDFAVGDPVGTQMVNFVYLVGDRETGEALVVDPAYKVDDLLNLLAADGMRLTGALVTHYHADHIGGNAFGLEIEGVRQLLGRQNVPIHVNRAEAEWVRRATEVSAADLVEHDDDDVVTVGEIPVRLLHTPGHTPGSQCFLVDDRLVAGDTLFLEGCGRMDLPGGDAGLMYDSLRRLAALPDTTTVFPGHQYSPQASEDLAVVKRMNHVFRPTSAQQWKAMLGLS

SEQ ID NO: 7829 - protein, 576 aa, Schizosaccharomyces pombe
MQPQEVDLMENSTMRNGARVLPPEAISKRHIGPYIIRETLGEGSFGKVKLATHYKTQQKVALKFISRQLLKKSDMHMRVEREISYLKLLRHPHIIKLYDVITTPTDIVMVIEYAGGELFDYIVEKKRMTEDEGRRFFQQIICAIEYCHRHKIVHRDLKPENLLLDDNLNVKIADFGLSNIMTDGNFLKTSCGSPNYAAPEVINGKLYAGPEVDVWSCGIVLYVMLVGRLPFDDEFIPNLFKKVNSCVYVMPDFLSPGAQSLIRRMIVADPMQRITIQEIRRDPWFNVNLPDYLRPMEEVQGSYADSRIVSKLGEAMGFSEDYIVEALRSDENNEVKEAYNLLHENQVIQEKSHLSKSKRVDSFLSVSPPAFSEYTSELQKKSKQELIDPTLEGPRWTVSDPPTYAKQTIDSNICVLVPTAEKNKLEMRTLADAASAVDTSQSTRKKSRRNKWHFGVRCRGDAPEILLAVYRALQRAGAQFTVPKPVNGKYRSDMYTIKSRWEIPHCKREGKNTYAYIELQLYEVMPGCFMLDVKSNGYKDIYSHPERTADHGMDDLKSSSPFSDLCAMLVCKLFSA

SEQ ID NO: 7830 - protein, 509 aa, Hordeum vulgare
MRSSPVLLLVIALVAAAHLAPLECDGPNPNPEIGNTGGLSRQGFPAGFVFGTAASAYQVEGMARQGGRGPCIWDAFVAIQGMIAGNGTADVTVDEYHRYKEDVGIMKNMGFDAYRFSISWSRIFPDGTGKVNQEGVDYYNRLIDYMLQQGITPYANLYHYDLPLALHQQYLGWLSPKIVGAFADYAEFCFKVFGDRVKNWFTFNEPRVVAALGYDNGFHAPGRCSKCPAGGDSRTEPYIVTHNIILSHAAAVQRYREKYQPHQKGRIGILLDFVWYEPHSDTDADQAAAQRARDFHIGWFLDPITNGRYPSSMLKIVGNRLPGFSADESRMVKGSIDYVGINQYTSYYMKDPGAWNQTPVSYQDDWHVGFVYERNGVPIGPRANSDWLYIVPWGMNKAVTYVKERYGNPTMILSENGMDQPGNVSIADGVHDTVRIRYYRDYITELKKAIDNGARVAGYFAWSLLDNFEWRLGYTARFGIVYVDFNTLKRYPKDSALWFKNMLSEKKRS

SEQ ID NO: 7831 - protein, 682 aa, Unknown
  Polaromonas sp. JS666
MPHEPMAPFPRLLSPLKVGAHTLGNRTLMGSMHTRLESLDRSIDRLSLFYAERARGGVGLIVTGGYAPCQDGLLDETGPLLVTPEQADALKPIPQAVHAEGGKIILQILHTGRYAKVARPVGASDIPSPINPRAPRALSTAEVWQTIEDYVRCAELAQRAGFDGVEIMGSEGYLLNQFTVTRTNNRSDEFGGSMENRHRLPVEIVQRTRERLGPEFLLMFRVSALDLVEGGAPAAEIIQLAQAVQAAGADILNTGIGWHEARIPTIAYVVPRAAWRFAAARIKKAVTIPVIVSNRINTPDLAEEILASGDADMVSMARPFLADADFVRKAAEGRANEINTCIACNQACLDYIFADRPATCLVNPRAGRELEFSLMPPPAARRKVAVIGAGAAGLACALSAAERGHAVTLFEAGPEIGGQLNLARAVPGKQEFNELLRYFKQGVARHGVTLKLDTRADAPSLAAGHYDRIVVATGVRPRLPQIPGIPHPKVVSYADLLSDRVQAGHKVAVIGAGGIGFDVATFLLHESPADAARPQTVAQFQAEWGVDTSPTAAGGLKPAQPVSAAREVTLLQRKLEKPGRTLGMSTGWALKAELARRGLRTLSGCTYERIDDTGLHLSVNGVPQTLVVDTIVLCAGQDSENTLAAELRALGLAPEIIGGADLAAELDALRAIDQGTRLGLAL

SEQ ID NO: 7832 - protein, 108 aa, Triticum aestivum
QPQSPSVADRFEGITCNKAEGAMYLFPQICLPQKAIEAAKAANKAPDAFYALRLLESTGIVVVPGSGFGQVPGTWHFRCTILPQEEKIPAIISRFTVFHETFMAEYRD

SEQ ID NO: 7833 - protein, 996 aa, Emericella nidulans
MVQSPMISCPLKQTNEIDWIQPLKDYIRQSYGEDPERYSQECATLNRLRQDMRGAGKDSATGRDLLYRYYGQLELLDLRFPVDENHIKISFTWYDAFTHKPTSQYSLAFEKASIIFNISAVLSCHAANQNRADDIGLKTAYHNFQASAGMFTYINENFLHAPSTDLNRETVKTLINITLAQGQEVFLEKQIMDHKKAGFLAKLASQASYLYAQAIEGTQEHAKGIFDKSWVTLLQVKSAHMGSVASYYQALADGESGSHGVTVARLQLAEKHSTSALSWAKSLPSSISPNTNLTSEAGPSLVNIVKFHLANVQSQLATFVKDNDFIYHQPVPSEAGLSAVSKLPAAKAIPVSELYQGQDIQRIIGPDIFQKLVPMSVTETASLYDEEKAKLIRAETEKVETADGEMAASLDYFKLPGSLNILKGGMDQEVMVDEEFQRWCQELAGHDSFAKAFDTLQDRKSEVLATLDQCAKQLDLEESVCEKMRSKYGADWSQQPSSRLNMTLRNDIRTYRDTVHEASASDAQLSATLRQYESDFDEMRSAGETDEADVLFQRAMIKAGSKQGKTKNGVTSPYSATEGSLLDDVYDDGVPSVAEQIARVESILKKLNLVKRERTQVLKDLKEKVRNDDISNVLILNKKSITGQESQLFEAELEKFHPHQMRIVQANHKQTALMKELTKTYGDLLQDKRVRAEQSKYESITRQRNSVMARYKKIYDSFNNLGSGIKQAQTFYAEMTETVDSLKKNVDTFINNRRSEGAQLLGQIEREKAAGTSDHEEREREKLRQLMERLSTEPKPPSVPPGSSTAGPAKAKSPPPPVKAPAYPTNIAPPKASPHFAPTVPQQHGTPVSHSPAPYSQYVPPGAGVSYLPSQSFQQGAAAPLSEGYNPMAYPIPASSMSPPPSQPFYSPTPTPFYTSPTPPVPSGQYMPPRLCSPSATSPTTTAHLPTINRAVPLGTRRVCSEPTIRKQPAPQGSFTVITANWDLPFPQILPILGPG

SEQ ID NO: 7834 - protein, 378 aa, Arabidopsis thaliana
METRNETKASPENNLRNRGADGNNSKKDMIFRADKIDLKNLDIQLEKHLSRVWSRSIEKHPKPKEEWEIELAKLEMRNVIARGAYGIVYKGIYDGQDVAVKVLDWGEDGYATTAETSALRASFRQEVAVWHKLDHPNVTRFVGASMGTANLKIPSSAETENSLPQRACCVVVEYIPGGTLKQYLFRNRRKKLAFKVVVQLALDLSRGLSYLHSERIVHRDVKTENMLLDYQRNLKIADFGVARVEAQNPKDMTGETGTLGYMAPEVLDGKPYNRRCDVYSFGICLWEIYCCDMPYPDLSFADVSSAVVRQNLRPDIPRCCPTALATIMKRCWEANPEKRPEMEEVVSLLEAVDTTKGGGMIPEDQRPGCFCFVSGRGP

SEQ ID NO: 7835 - protein, 236 aa, Brassica napus
  misc_feature (59)..(59): Xaa can be any naturally occurring amino acid
  misc_feature (132)..(132): Xaa can be any naturally occurring amino acid
  misc_feature (183)..(184): Xaa can be any naturally occurring amino acid
  misc_feature (199)..(199): Xaa can be any naturally occurring amino acid
  misc_feature (204)..(204): Xaa can be any naturally occurring amino acid
  misc_feature (209)..(210): Xaa can be any naturally occurring amino acid
  misc_feature (216)..(216): Xaa can be any naturally occurring amino acid
  misc_feature (219)..(219): Xaa can be any naturally occurring amino acid
  misc_feature (227)..(227): Xaa can be any naturally occurring amino acid
MKGEGNEMFPKLPQNHSLSSHFHLPATIAVDDSSIEVVRRPRGRPPGSKNKPKPQVYVXTRDTEPPMSPYILEVPSGNDVVEAINRFCRRKSIGENPSACAFSVALDSVANITLRQPSPAAPGSTITFHGKXFDLLSVSATFLPPPPRTSLSPPVANFFTVSLAGPQGQIIGGFVAGPLISAXXTVYVIAASFNNPSYXRFTGXREEHXXSISARXREXGDGQSPRXFGRRRAKKG

SEQ ID NO: 7836 - protein, 544 aa, Aeromonas salmonicida
MAAKEVKFGNEARIKMLEGVNILADAVKVTLGPKGRNVVLDKSFGAPTITKDGVSVAREIELEDKFQNMGAQMVKEVASKANDAAGDGTTTATVLAQAIVNEGLKAVAAGMNPMDLKRGIDKAVIAAVAELQVLSQPCADNNAIAQVGTISANSDEKVGRLIAEAMDKVGRDGVITVEDGQGLDDELAVVEGMQFDRGYLSPYFVNKPETGAVELDDPFILLVDKKVSNIREMLPVLEGVAKAGKPLLIVAEDVEGEALATLVVNTMRGIVKVAAVKAPGFGDRRKAMLQDIAMLTSGGTVIEEVGMELEKATLEDLGRAKRIVITKENTTIIDGVGDAALIESRVAQIRQQIEETSSDYDREKLQERVAKLAGGVAVIKVGAATEVEMKEKKARVDDALHATRAAVEEGVVAGGGVALVRVAAKLAGLRGDNEDQNVGIKVALRAMEAPLRQIVINAGEEASVIANAVKNGEGNFGYNAYTEQYGDMLAMGILDPTKVTRSALQFASSIAGLMITTECMITELPKKDTPAMPDMGGMGGMGMM

SEQ ID NO: 7837 - protein, 501 aa, Emericella nidulans
MGQNDDQKTYRYNESPVYTTSNGCPVMDPQASQRVGPNGPLLLQDFNLIDLLAHFDRERIPERVVHAKGAGAYGEFEVTDDISDITVIDMLKGVGKKTKTFVRFSTVGGEKGSPDSARDPRGFACKFYTEEGNWDWVFNNTPVFFLRDPSKFPMFIHTQKRNPQTNLKDATMFWDYLSTHQEAVHQVMHLFSDRGTPYSYRHMNGYSGHTYKWIKPDGTFNYVQLHLKTGQGNKTFTDAEATRLAAENPDWHTQDLFNAIARGEYPSWTCYVQTLSPEQAEKFRWNIFDLTKVWPQSEVPLRRFGRFTLNKNPENYFAEVEQAAFSPSHLVPGVEPSADPVLQARLFSYPDTHRHRLGTSNYQSIPVNCPLRAFTPFHRDGAMSVNGNHGANPNYPSTFRPLQYKPVKASQEHEKWAGSVVTEQLPVTDEDFVQANGLWKVLGRQPGQQENFVGNVAGHLCNAHPRVRQATYGMFRRVNADLGKRIEKATEKKATEARARL

SEQ ID NO: 7838 - protein, 534 aa, Haloarcula marismortui
MARLESAEMLDAPQQEAIPTLADDEAGTVVWHREHLRIRDQGAVARAAASEYVLPLFVFDPAFYGADGLACDSRIRFLHDCLADLSDQYHTATGCGLTYAHGDPVDVLGRFREAGWDIVTMAAPTGRYGRERDRRVREQCDVTFVDGDGLVRDRAATRDGWQDDVSAWFAADQHDWDPSTVTSRSFDSGIDISTIEDHYDIAPSKSDVPRGGTGPARERLSAFAERIDDYPGNISAPVDARDGTSGLSPYLAFGCLSVRQVIQYIDEHAPDGRGKEMFVSRLFWNKHYEQKLEDWPGWLETAVNPVLEGFNAEQYDPDLVAAWKHGQTGFPMVDASMRCLRQTGWLNFRMRSMSASVYYHLLQQPWRIGADWFYHHLIDASAAINYTQWQSQCGLVGKPALRLYNPRKQVRDQDPDGEFIRQWVPELESLPDEYLDRPEQTPVHVQASCGVDIGDDYPHPVVDYDAARQAFHRRYEAVRPDAADALHDPTIARRVSFSGGREAAARIAAEHGTDASNGTENSRTQASLDSFGDE

SEQ ID NO: 7839 - protein, 412 aa, Oryza sativa
MAFDAFTDKNAVFRRLKAKPENKMCFDCSAKNPTWASVTYGIFLCLDCSAVHRSLGVHITFVRSTNLDSWTPDQLKMMAFGGNNRAHAFFKQHGWTDGGKVDAKYTSRAAELYRQILQKEVAKSSADNVLPSSPVAASQPQNPSDDFPEFKLPEAPAENTNGKQEPDVTNSQKAPTQTPKAPTHPTFATSVKKSIGAKKIGGKTGGLGVKKLTTKPSESLYDQKPEEPKPAAPVMTTSTTKSGPSLHSRFEYVENEPAVDSRNGGTQMTGHVAPPKSSNFFQEYGMDNGFQKKTSTAATKTQIQETDEARKKFSNAKAISSSQFFGNQSREEKDAQMSLQKFAGSSSISSADLFGRRDMDDSNLDLSAADLINRISFQASQDLSSLKNMAGETGKKLTSIASNFISDLDRIL

SEQ ID NO: 7840 - protein, 267 aa, Oryza sativa
MEWDKAKASSGEAVDDRGGGEGGLGYVKVMTDEQMEVLRKQISIYATICEQLVEMHRALTAQQDSIAGMRLGNLYCDPLMVPGGHKITARQRWTPTPMQLQILENIFDQGNGTPSKQKIKDITAELSQHGQISETNVYNWFQNRRARSKRKQAALPNNNAESEAEADEESPTDKKPKSDRPLHQNIAMRDHNSERISEMHHFDTEHEQIRRMMYASNDSSSRSSGSLGQMSFYDNVMSNPRIDHFLGKVESPGSFPHMRSGESFDMY

SEQ ID NO: 7841 - protein, 152 aa, Pisum sativum
MDLDSPLFNTLHHIMDLTDDTTEKNLNAPTRTYVRDAKAMAATPADVKEHPNSYVFMVDMPGVKSGDIKVQVEDENVLLISGERKREEEKEGVKYLKMERRIGKLMRKFVLPENANIEAISAISQDGVLTVTVNKLPPPEPKKPKTIQVKVA

SEQ ID NO: 7842 - protein, 631 aa, Unknown
  Oncidium Gower Ramsey
MEGCDCIEPQWPADELLVKYQYISDFFIALAYFSIPLELIYFVKKSSFFPYRWVLIQFGAFIVLCGATHLINLWTFTMHSRTVAIVMTVAKVSTAGVSCATALMLGHIIPDLVSVKTRELFLRNKAEELDREMGLIRTQEETGRHVRMLTHEIRSTLDRHTILKTTLVELGRTLDLAECALWMPLRTGLHLQLSHTLNNKIPVGSVVSINLPIVNQIFNSSRAGRIPNTCPLARFQPYTGRYVPQEVVAVRVPLLHLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETELTPEQRLMVETILKSSNLLATLINDVLDLSKLEDGSFELEATIFNLHTVFREAVNLIKPIAAVKKLSLFVSLAPDLPSCAIGDEKRLLQIMLNVVGNAVKFTKEGTIFITVNIAKPDSLRDPDFYPAPTDGHFYLRVQVKDTGCGISPQELPHLFTKFAHTQNGSDKGYSGSGLGLAICKRFVNLMKGHIWLESEGIGKGCTTIFIVKLGMSEDPTLRYQQKLLPPIRAGQAEADPFGLKPAALKDELMPKIRYQRSL

SEQ ID NO: 7843 - protein, 631 aa, Unknown
  Oncidium Gower Ramsey
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPLRTGLHLQLSHTLNNKIPVGSVVSINLPIVNQIFNSSRAGRIPNTCPLARFQPYTGRYVPQEVVAVRVPLLHLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETELTPEQRLMVETILKSSNLLATLINDVLDLSKLEDGSFELEATIFNLHTVFREAVNLIKPIAAVKKLSLFVSLAPDLPSYAIGDEKRLLQIMLNVVGNAVKFTKEGTVFITVNIAKPDSLRDPDFYPAPTDGHFYLRVQVKDTGCGISPQELPHLFTKFAHTQNGSDKGYSGSGLGLAICKRFVNLMKGHIWLESEGIGKGCTTIFIVKLGMSEDPTLRYQQKLLPPIRAGQAEADPFGLKPAAPKDELMPKIRYQRSL

SEQ ID NO: 7844 - protein, 493 aa, Methanosarcina mazei
MCGIAGMFGTPDSNTKVKKMLAILGHRGPDACGIHTEGKLSIGNTLLKITGDMPQPLTGTGSLVLNGEIYNFRELAAEIGLKTDSDTELLFTLIERKVRKGIKPTNAVFSVLSKVNGDYALAYACGTELVLARDPSGVKPLYYFYEKSMVKPGLAFASEKKALAFTGREVKPFPQGGIMGFSTENGKIAEKFTEKSLKITQPEKRISAEKEAIIYLKAALEKAVELRLTPVSGIAFSGGIDSTFLAALAKRIDPYVSLYAVGLPDSHDIAQAEYAAEAIGMKRNLKTHFLSPEEIEAAVPEVIYATESTDPMKVAIGLPLHIVAKTAREEGKRVLLTGQGADELFGGYSRHEGFFEQGADVLDREIYSDLENISAINLERDDMVAMANSVELRVPFLDKEVIKTGLAISPELKVRKKEGVYIRKYILRKAAEGLLPPKILWKEKKAVQYGTGVQKTLDRLARDSGFSKKQGGHIEKYLSQIASEKGFDFINEM

SEQ ID NO: 7845 - protein, 158 aa, Pisum sativum
MSLIPSFFSGRRSNVFDPFSLDVWDPLKDFPFSNSSPSASFPRENPAFVSTRVDWKETPEAHVFKADLPGLKKEEVKVEVEDDRVLQISGERSVEKEDKNDEWHRVERSSGKFLRRFRLPENAKMDKVKASMENGVLTVTVPKEEIKKAEVKSIEISG

SEQ ID NO: 7846 - protein, 534 aa, Gibberella zeae
MGNNNSSQGGSGSKGSGSAGPDGPLQSYPSFSRSDTKDSSRSFRTLGSKIRSSSKSDSPRNSKVLSNGENPVESKSDDRRSSRHGRSSSSRLSRSELPPLNTAGTDISTSESALADSAVGEDQPPPSPVHGNAKGGNHDVSAAQASGEVDHVSDQPPSVNAGANAHMQAPGQSILVKRENTINPVNNGPSDESRADGNSNVAMSEIKDIDLDDFIKRLLDAGYAGKVTKSVCLKNAEIVAICQRAREVFLSQPALLELDAPVKVVGDVHGQYTDVIRMFEMCGFPPNSNYLFLGDYVDRGKQSLETILLLLCYKLKFPENFFLLRGNHECANVTRVYGFYDECKRRCNVKIWKTFIDCFNTLPIAAIVAGKIFCVHGGLSPALVHMDDIRNIARPTDVPDYGLLNDLLWSDPADMEQDWEANERGVSYCFGKRVITEFLAVHDFDLICRAHMVVEDGYEFFNDRVLVTVFSAPNYCGEFDNWGAVMSVSAELLCSFELLKPLDSSALKSHIKKSRNKRQHMLNSPPAMIQPQSM

SEQ ID NO: 7847 - protein, 631 aa, Unknown
  Oncidium Gower Ramsey
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPLRTGLHLQLSHNLNNKIPVGSVVSINLPIVNQIFNSSRAGRIPHTCPLARFQPYTGRYVPLEVVAVRVPLLNLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETDLTPEQRLMVETVLKSSNLLATLINGVLDLSKLEDGSFELEATIFNIHTVFREAVNLIKPIAAVKKLSLFVSLAPDLPSCAIEDEKRLLQIMLNVVGNAVKFTKEGPIFITANTAKPDSLRDPDFYPAPNDGHFYLRVQVKDTGCGISPQEFPPLFTKFAHTQNGSDKGYSGSGLGPAICKRFINLMKGHIWLESEGTGKGCTTIFIVKLGMSEDPTLRYQQKLLPPIRAGQSEADPFGLKPAAPKGELLPKIRYQRSL

SEQ ID NO: 7848 - protein, 574 aa, Unknown
  Oncidium Gower Ramsey
FGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPLRTGLHLQLSHTLNNKIPGGSGGSINLPIVNQIFNSSRAGRIPNTCPLARFQPYTGRYVPQEVVAVRVPLLHLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETELTPEQRLMVETILKSSNLLATLINDVLDLSKLEDGSFELEATIFNLHTVFREAVNLIKPIAAVKKLSLFVSLAPDLPSCAIGDEKRLLQIMLNVVGNAVKFTKEGTIFITANIAKPDSLRDPDFYPAPTDGHFYLRVQVKDTGCGISPQELPHLFTKFAHTQNGSDKGYSGSGLGLAICKRFVNLMKGHIWLESEGIGKGCTTIFIVKLGMSEDPTPRYQQKLLPPIRAGQAEADPFGLKPAAPKDELMPKIRYQRSL

SEQ ID NO: 7849 - protein, 823 aa, Triticum aestivum
MATFAVSGATLGVARPAGAGGGLLPRSGSERRGGVDLPSLLLRKKDSSRAVLSRAASPGKVLVPDGESDDLASPAQPEELQIPEDIEEQTAEVNMTGGTAEKLESSEPTQGIVETITDGVTKGVKELVVGEKPRVVPKPGDGQKIYEIDPTLKDFRSHLDYRYSEYRRIRAAIDQHEGGLEAFSRGYEKLGFTRSAEGITYREWAPGAHSAALVGDFNNWNPNADTMTRDDYGVWEIFLPNNADGSPAIPHGSRVKIRMDTPSGVKDSISAWIKFSVQAPGEIPFNGIYYDPPEEEKYVFQHPQPKRPESLRIYESHIGMSSPEPKINSYANFRDEVLPRIKRLGYNAVQIMAIQEHSYYASFGYHVTNFFAPSSRFGTPEDLKSLIDRAHELGLLVLMDIVHSHSSNNTLDGLNGFDGTDTHYFHGGPRGHHWMWDSRLFNYGSWEVLRFLLSNARWWLEEYKFDGFRFDGVTSMMYTHHGLQMTFTGNYGEYFGFATDVDAVVYLMLVNDLIHGLHPDAVSIGEDVSGMPTFCIPVPDGGVGFDYRLHMAVADKWIELLKQSDESWKMGDIVHTLTNRRWLEKCVTYAESHDQALVGDKTIAFWLMDKDMYDFMALDRPSTPRIDRGIALHKMIRLVTMGLGGEGYLNFMGNEFGHPEWIDFPRGPQTLPTGKVLPGNNNSYDKCRRRFDLGDADFLRYHGMQEFDQAMQHLEEKYGFMTSEHQYVSRKHEEDKVIIFERGDLVFVFNFHWSNSFFDYRVGCSRPGKYKVALDSDDALFGGFSRLDHDVDYFTTEHPHDNRPRSFSVYTPSRTAVVYALTE

SEQ ID NO: 7850 - protein, 242 aa, Unknown
  Malus x domestica
MEFANQAPESSTQKKLGRGKIEIKRIENTTNRQVTFCKRRNGLLKKAYELSVLCDAEVALIVFSTRGRLYEYANNSVRATIDRYKKACADSTDGGSVSEANTQFYQQEASKLRRQIREIQNSNRHILGESLSTLKVKELKNLEGRLEKGISRIRSKKNEILFSEIEFMQKRETELQHHNNFLRAKIAESEREQQQQQTHMIPGTSYDPSMPSNSYDRNFFPVILESNNNHYPRQGQTALQLV

SEQ ID NO: 7851 - protein, 245 aa, Unknown
  Malus x domestica
MAYESKSLSLDSPQRKLGRGKIEIKRIENTTNRQVTFCKRRNGLLKKAYELSVLCDAEVALIVFSNRGRLYEYANNSVKGTIERYKKASADSSNTGSVSEASTQYYQQEAAKLRARIVKLQNDNRNMMGDALNSMSVKDLKSLENKLEKAISRIRSKKNELLFAEIEYMQKRELDLHNNNQLLRAKIAENERASRTLNVMAGGGTSSYDILQSQPYDSRNYFQVNALQPNHQYNPRHDQISLQLV

SEQ ID NO: 7852 - protein, 159 aa, Dactylis glomerata
MEGRVFGLETPLMTALQHLLDIPDGEAGNAGGEKQGPTRAYVRDARAMAATPADVKELPGAYAFVVDMPGLGSGDIKVQVEDERVLVISGERRREEKEDAKYLRMGAPDGKLMRKFVLPENADMEKISAVSRDGVLTVSVEKLPPPEPKKPKTIQVQVA

SEQ ID NO: 7853 - protein, 145 aa, Unknown
  Magnetococcus sp. MC-1
MSTLMSYDPFHRVRTLQNELNRLFDPGWDDGNSQMAKLSMGVDIREDENQIVIKADLPGMSQEAIQVNVEHNTLTISGERTFGDEVNRDRYHRVERAYGRFSRSFQLPNTTDTANIKASYVNGVLEVALPKREESKPRAIQIEVQ

SEQ ID NO: 7854 - protein, 483 aa, Bacillus subtilis
MSSNKLTTSWGAPVGDNQNSMTAGSRGPTLIQDVHLLEKLAHFNRERVPERVVHAKGAGAHGYFEVTNDVTKYTKAAFLSEVGKRTPLFIRFSTVAGELGSADTVRDPRGFAVKFYTEEGNYDIVGNNTPVFFIRDAIKFPDFIHTQKRDPKTHLKNPTAVWDFWSLSPESLHQVTILMSDRGIPATLRHMHGFGSHTFKWTNAEGEGVWIKYHFKTEQGVKNLDVNTAAKIAGENPDYHTEDLFNAIENGDYPAWKLYVQIMPLEDANTYRFDPFDVTKVWSQKDYPLIEVGRMVLDRNPENYFAEVEQATFSPGTLVPGIDVSPDKMLQGRLFAYHDAHRYRVGANHQALPINRARNKVNNYQRDGQMRFGDNGGGSVYYEPNSFGGPKESPEDKQAAYPVQGIADSVSYDHYDHYTQAGDLYRLMSEDERTRLVENIVNAMKPVEKEEIKLRQIEHFYKADPEYGKRVAEGLGLPIKKDS

SEQ ID NO: 7855 - protein, 379 aa, Emericella nidulans
MAEFVRAQIFGTTFEITSRYTDLQPVGMGAFGLVCSARDQLTAQPVAVKKIMKPFSTPVLSKRTYRELKLLKHLRHENIISLSDIFISPLEDIYFVTELLGTDLHRLISSRPLEKQFIQYFLYQIMRGLKYCHSAGVVHRDLKPSNILINENCDLKICDFGLARIQDPQMTGYVSTRYYRAPEIMLTWQKYDAKVDVWSAACIFAEMLLGAPLFPGKDHVNQFSIITELLGTPPDDVIQTICSENTLRFVKSLPKREPQDLAKLPKFLALVHPDKKPEEDEDYKNTINLLKAMLVYNPKDRISAEAALAAPYLAPYHDETDEPVAEEKFDWSFNDADLPVDTWKIMMYSEILDFHNIDQGGDINPALVEGAGLNQQGFQ

SEQ ID NO: 7856 - protein, 270 aa, Zea mays
  misc_feature (203)..(203): Xaa can be any naturally occurring amino acid
  misc_feature (252)..(252): Xaa can be any naturally occurring amino acid
METSAATPTRPPHQAATSPSPSPSSSLRLWRPAAQHNMRNQWSHLSAAKEQWLAAVADGRAHASALVNVHLSCRNMPTMDLGVLKDMPGIRDKANSKLALREEQYSGMLLSAYKEMVRQLSYLVEASHSMRRFSKAAPNCPITQFSDRQDNLNDSGDGGGAPVFKWFSVLEFESLAQELVQMFVSEQKLKRLLLLEFLSIALXEGVELQTSLNWGDELYDERLGSQRPGNLPLHEVLQVYLTTWHANMNINXEIDEIFELVEEEMKIKLS

SEQ ID NO: 7857 - protein, 335 aa, Chromobacterium violaceum
MSRITLSRFLIEQQRKAGTLPPELRLLIETVGRACKAISYSVNKGALADVLGEAGTGNIQGEAQKKLDVIANDFLLDANEWGGSLAAMASEEMELPYHIPGEYPKGEYLLMFDPLDGSSNIDVNISVGTIFSILRCPEGVTQPTETDFLQPGTHQVAAGYTVYGPQTMLVLTFGSGVHGFTLDREHGSFVLTHPDMKVPERTAEFAINMSNMRHWEAPVRRYVEEMLAGKTGPRGRDFNMRWVASMVAEVHRIITRGGIFMYPKDARDPSKAGKLRLMYEGNPMAFIIEQAGGAATNGHQRILDIVPTKLHERVAVFLGSKEEVELVTRYHSEQQ

SEQ ID NO: 7858 - protein, 520 aa, Pyrus communis
DVQYLTGHVDERKPPQLADFLNWFLHDKKGTSTLSKPSSTGHRPHHVRVTGRLSTSCHLVDEDRELLLPRRHHNDDDHDNHVSSIFIDQSLTDGGEGGQIIKETSLLPGDQTRFGLESSLMRLELKGNSPHCLVQSDIPPCVQGDASEALDVTATAVASLEECARLSEENDVVQQAYRKEIVVSRNQVIRNSVEQPKVTLYNQSDLEGVHSELVKQGRITAVTNPRYLNLEPTLAMDWLEISWDELNIKERVGAGSFGTVHRAEWNGSDVAVKVLTVQDFHDDQLKDFLREVAIMKRVLHPNVVLFMGAVTKRPHLSIVTEYLPRGSLYRLIHRPASGELLDQRRRLRLALDVAKGINYLHCLNPPIVHWDLKSPNLLVDKNWTAKVCDFGLSRFKANTFISSKSVAGTPEWMAPEFLRGEPSNEKSDVYSFGVILWELATMQQPWGNLNPAQVVAAVGFKNKRLEIPRDLNPNVAAIIEACWANEPWKRPSFAVIMDSLTPLIKAPVTQPSRADMPLLT

SEQ ID NO: 7859 - protein, 450 aa, Glycine max
GNPRLNLASFVTTWMEPECDKLIMAAINKNYVDMDEYPVTTELQNRCVNMIAHLFNAPLEETEAAVGVGTVGSSEAIMLAGLAFKRKWQNRRKQEGKPYDKPNIVTGANVQVCWEKFARYFEVELKEVKLRDDYYVMDPEKAVELVDENTICVAAILGSTLNGEFEDVKRLNDLLIEKNKITGWDTPIHVDAASGGFIAPFIYPELEWDFRLQLVKSINVSGHKYGLVYAGIGWVIWRSKQDLPEELIFHINYLGADQPTFTLNFSKGSSQVIAQYYQLIRLGFEGYRNVMENCRDNMLVLKEGLEKTGRFSIVSKDNGVPLVAFTLKDHTHFDEFQISDFLRRFGWIVPAYTMPPDAQHVTVLRVVIREDFSRTLAERLVSDVEKVLHELDSLPARVISSTTVTLSAEENGKVVVAKKNPMETQREITAIWKKFVLERKKNNDKMNGVC

SEQ ID NO: 7860 - protein, 741 aa, Pyrus communis
MEACNCIEPQWPADELLMKYQYISDFFIALAYFSIPLELIYFVKKSAVFPYRWVLVQFGAFIVLCGATHLINLWTFNMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPIHLPVVNQVFSSNCAVKISPNSPVARLRQLAGKHIPGEVVAVRVPLLHLSNFQINDWPELSTKRYALMVLMLPSDSARQWHVHELELVEVVADQVAVALSHAAILEESMRARDLLMEQNIALDLASREAETAIRARNDFLAVMNHEMRTPMHAIIALSSLLQETDLTPEQRLMVETILKSSNLLATLINDVLDLSRLEDGSLQLDIATFNLHSIFREVHNMIKPVASIKRLSVALNIAADLPVYAIGDEKRLMQIILNVVGNAVKFSKEGSISITAYVAKSESLRDFRAPDFFPVQSDNHFYLRVQVKDSGSGINPQDIPNLFTKFTQTQTLASQNSGGSGLGLAICKRFVNLMEGHIWIESEGLGKGCTATFIVKLGFPERSNESKQPFAPKLQANHVQTNFPGLKVLVMDDNGVSRSVTKGLLVHLGCDVTTVSSIDEFLHVISQEHKVVFMDVCMPGIDGYELAVRIHERFTKRHERPVLVALTGSIDKMTKENCMRVGMDGVILKPVSVDKMRSVLSELLEHRVLFEAM

SEQ ID NO: 7861 - protein, 399 aa, Thermococcus kodakarensis
MIKPSERAMGVEYAIRDVVLPARELEKKGIEVIRLNIGDPGKYDFQPPEHMKEAYCRAIKEGHNYYGPSEGLPEMREAVVQREKRKNGVDITPDDVRVTTAVTEALQLLFGALLDPGDNILVPSPSYPPYTGLVKFYGGIPNEYDTIEENGWQPDIDDMRKRINERTKAIAVINPNNPTGALYEKKTVKEILDLAGEYDIPVISDEIYDLMTYEGEHVSPGSLTKDVPVIVMNGLSKVYFATGWRLGYFYYVDPENKLAEVREAVDKLMRIRICPSTPAQFAAIAGLTGPMDYLEEYMKKLKERRDYIYKRLTEIPGVSTQKPQGAFYIFPRIDERSKWKSDKEFVLDVLHEAHVLFVHGSGFGRAGNWHFRIVFLPPVEILEKAMDRFEEFMRKRLAE

SEQ ID NO: 7862 - protein, 546 aa, Bacillus cereus
MEENQDMNSLDEQDVKRETLTTRQGHPVKDNQNIRTIGNRGPATLENYHFIEKISHFDREEVPERVVHARGAGAFGYFETYGKVGDEPVEKYTRAKVFSGAGKKTPLMVRFSTVAGAKDSPETARDPRGFAVKMYTEDGNWDLVGNNLKIFFIRDAMKFPDMIHAFKVDPVSNVANPQRMFDFVSRTPEATHMITFLFSPWGIPATYRHMQGSGVNTYKWVNEKGEAVLVKYHWEPKQGIRNLTQEDANSIQAMNVSHATQDLYEAIERKDYPEWELFVQIMEDDYHPELDFDPLDDTKLWPEEQFPWLPVGRMVLDRNPVDYHSDIEQAAFGTGVLVDGMDFSDDKMLQGRTFSYSDTQRYRVGANYLQLPVNAPKAPVRTNQHRGQMDMRNPKESGENPHINYEPSMLGGYKDAKQEKHHPHQPTYNAAAMSAPIDRPNNYGQAGHTYRSFEEWERNELVKNLSEALAVCDKRIQNAMIEHFTQADEDYGRRVKEGIEKKMKEAKTENKLPGREVSKSKYGQGSLAANEATKDAVKKSHESDPY

SEQ ID NO: 7863 - protein, 440 aa, Zea mays
MSTTKVKRRVGKYELGRTIGEGTFAKVRFARDTVTGEAVAIKILDKEKVLRHKMVEQIKREISTMKLIKHPNVVRIYEVMGSKTKIYIVLEFATGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEFTFPPWTSFPAKRLLTRILDPNPMTRITIPEILEDEWFKKGYKRPEFDEQYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKAKGDTLEFHKFYKNLSKTLKDVVWKSDDLQTQHAS

SEQ ID NO: 7864 - protein, 544 aa, Caulobacter vibrioides
MAAKDVYFSSDARDKMLRGVNILANAVKVTLGPKGRNVVIEKSFAAPRTTKDGVSVAKEIELADKFENLGAQMIREVASKTNDKAGDGTTTATVLAQAIVQEGLKSVAAGMNPMDLKRGIDKAVAIAIEDIKTSSKKVTTNAEIAQVGTISANGDKEVGEIAKAMDKVGNEGVITVEEAKTAETELDVVEGMQFDRGYLSPYFITNADKMEVQLEEPLILLSRKKLSSLQPLPVLEAVVQSGRPLLIIAEDVEGEALATLVVNKLRGGLRVAAVKAPGFGDRRKAMLEDIAILTGAQVVSEDIGIKLENVSLEMLGRAKKVSITKDDTTIVDGVGEKADIEARIAQIKRQIEDTTSDYDKEKLQERLAKLAGGVAVIRVGGSTEVEVKEKKDRVDDALNATRAAADEGIVPGGGTALLKASKASAVVGDNDDQTAGIAIVRRALQAPIRQIAENAGVEGSIVVGKILENDNSAFGFNAQTEQYVDLVVDGVIDPAKVVRTALQNAASVAGLLITTEAAIVVSPQEGRRRPAGGGMPGGMGDMDF

SEQ ID NO: 7865 - protein, 461 aa, Saccharophagus degradans
MKTFNPDFVWGAASSAYQVEGATTTDGRGPSIWDAFSSIPGKTYHNQNADIACDHYNRWQEDVAIMKEMGLKAYRFSISWSRIFPTGRGEVNEKGVAFYNNLIDELIKNDITPWVTLFHWDFPLALQMEMDGLLNPAIADEFANYAKLCFARFGDRVTHWITLNEPWCSAMLGHGMGSKAPGRVSKDEPYIAAHNLLRAHGKMVDIYRREFQPTQKGMIGIANNCDWREPKTDSELDKKAAERALEFFVSWFADPIYLGDYPASMRERLGERLPTFSDEDIALIKNSSDFFGLNHYTTMLAEQTHEGDVVEDTIRGNGGISEDQMVTLSKDPSWEQTDMEWSIVPWGCKKLLIWLSERYNYPDIYITENGCALPDEDDVNIAINDTRRVDFYRGYIDACHQAIEAGVKLKGYFAWTLMDNYEWEEGYTKRFGLNHVDFTTGKRTPKQSAIWYSTLIKDGGF

SEQ ID NO: 7866 - protein, 290 aa, Helicobacter pylori
MDYKCFKGKHANIVIEIISLLEKGVKKAQEILEKPDAGSYTKLENSSGDTPIKADLALDKFLEENFLSLENIKSVFSEEKETPVTKENGSYLIAYDPLDGSSVMEANFLVGTIIGIYEKDYKAQNLAASLYVVFGHKIELVVALEEVYRYSFYQNKFHFIETIVLENKGKIVASGGNQKDFSLGLKKALEGFFAENYRLRYSGSMVADVHHVLVKKGGMFSYPQKKLRKLFEVFPLALMVEKAKGEAFYFDKGVKKRLLEQSVENYHEKSECYLASQHEAHILEKYLKGE

SEQ ID NO: 7867 - protein, 488 aa, Methanosarcina barkeri
MCGIAGAAGTPDTNEEVKRMLAALGHRGPDACGTYQAKGLSIGNTLLKITGDMLQPLVGKGALVLNGEIFNFRELAAEQGIKTNSDTEVLFALIETKIKEGETPTNAIFSVLSRVNGDYALAYVLGNKLVLARDPVGVKPLFYSLEKEGKKPKLAFASEKKAFSSQKDQIKSFPPGRVMAFDIRNGRLEEKSLTIDPPQERISEEHEASSRLKAALEKAVEIRLTKTSGIAFSGGIDSTFLAALAKNIDPSISLYAVGLPDSHDLVQAQRAAEVAGMSDSLKTHTLSPEEIEAAIPNVIYSTESTDPMKIAIGLPLYFVAKTAKEDGKRVLLTGQGADELFGGYNRHKALLEHGPKVLDRAIYTDLKNISTINLERDDMVTMANSVELRVPFLDKEVIKTGLAISPELKVLKRDSLYIRKYILRKAADGLLPSELLWKEKKAIQYGTGVQKVLDRLAREAGFSKREGNHIEKYLKKVAENQGFDFIFR

SEQ ID NO: 7868 - protein, 574 aa, Unknown
  Oncidium Gower Ramsey
FGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPLRTGLHLQLSHTLNNKIPVGSVVSINLPIVNQIFNSSRAGRIPNTCPLARFQPYTGRYVPQEVVAVRVPLLHLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETELTPEQRLMVETILKSSNLLATLINDVLDLSKLEDGSFELEATIFNLHTVFREAVNLIKPIAAVKKLSLFVSHAPDLPSCAIGDEKRLLQIMLNVVGNAVKFTKEGTIFITANIAKPDSLRDPDFYPAPTDGHFYLRVQVKDTGCGISPQEFPHLFTKYAHTQNGSDKGYSGSGLGLAICKRFVNLMKGHIWLESEGIGKGCTTIFIVKLGMSEDPTPRYQQKLLPPIRAGQAEADPFGLKPAAPKDELMPKIRYQRSL

SEQ ID NO: 7869 - protein, 1123 aa, Solanum tuberosum
MSSSRPSQSSTTSSRSKHSARIIAQTSIDAKLHADFEESGDSFDYSSSVRVTNVAEGEQRPKSDKVTTAYLHQIQKGKFIQPFGCLLALDEKTLKVIAFSENAPEMLTMVSHAVPSVGEHPVLGIGIDIRTIFTGPSGAALQKALGFGEVSLLNPVLVHCKNSGKPFYAIVHRVTGSLIIDFEPVKPYEVPMTAAGALQSYKLAAKAITRLQSLPSGSMERLCDTMVQEVFELTGYDRVMGYKFHDDDHGEVVSEITKPGLEPYLGLHYPATDIPQAARFLFMKNKVRMICDCRAKHVKVVQDEKLPFDLTLCGSTLRAPHYCHLQYMENMNSIASLVMAVVVNDGDEEGESSDSSQSQKRKRLWGLVVSHNTTPRFAPFPLRYACEFLAQVFAILVNKELELENQFLEKNILRTQTLLCDMLMRDAPLGIVSQSPNIMDLIKCDGAALLYKNKIHRLGMNPSDFQLHDIVSWLCEYHTDSTGLSTDSLYDAGFPGALALGDAVCGMAAVRISDKDWLFWYRSHTAAEVRWGGAKHEPGEKDDGRKMHPRSSFKGFLEVVKTRSIPWKDYEMDRIHSLQLILRNAFKDADAVNSNTISIHTKLNDLKIDGMQELEAVTAEMVRLIETASVPIFAVDVDGQVNGWNTKVAELTGLPVDEAIGKHLLTLVEDSSVDTVNKMLELALQGQEERNVEFEIKTHGPSRDSSPISLIVNACASKDVRDSVVGVCFIAQDITGQKSIMDKFTRIEGDYRAIIQNPHPLIPPIFGTDQFGWCSEWNSAMTMLTGWRRDDVMDKMLLGEVFGTQAACCRLKNQEAFVNFGVILNNAITGQESEKIPFGFFARYGKYVECLLCVSKRLDKEGAVTGLFCFLQLASHELQQALHVQRLSEQTALKRLKVLAYIRRQIRNPLSGIIFSRKMLEGTSLGEEQKNILHTSAQCQRQLDKILDDTDLDSIIEGYLDLEMLEFKLHEVLVASISQVMMKSNGKNIMISNDMVEDLLNETLYGDSPRLQQVLANFLLVSVNSTPSGGKLSISGKLTKDRIGESVQLALLEFRIRHTGGGVPEELLSQMFGSEADASEEGISLLVSRKLVKLMNGEVQYLREAGRSTFIISVELAVATKSS

SEQ ID NO: 7870 - protein, 645 aa, Bacillus thuringiensis
MSVINCEEVKRDEFHTEKYYESYNIFGAHIVTEDEMRGVRFTVWAPHAKAMSVVGDFNEWDYEQHKMLQVTEEGIWSLFIPHIEEREIYKYAIETMAGDVIFKADPYAVYAEVRPNTASVVFDIKGYEWNDKNWSRKKKKKSVYKEAMTVYELHFGSWKKKEDGTLYSYREMAEELIPYVVEHQFTHIEIMPLVEHPYDRSWGYQGTGYYAATSRFGTPYDLMHFVDECHKYGIGVILDWVPGHFCKDAHGLYLFDGTPTYEYKDKDVQENPVWGTVNFDLGKREVRNFLISNALFWMRYFHIDGFRVDAVANMLYWNKEGQEQSNEHAVSFLRELNEAVFAEDEDFLMTAEDSTAWPLVTAPTYEGGLGFNYKWNMGWMNDVLKYMECAPEYRKYIHDKMTFSLLYAYSENFILPLSHDEVVHGKKSLLNKMPGDYWDKFAQLRLLYGYFFTHPGKKLLFMGGEFGQFDEWKDLEDLDWNLHDFEMHRYMHDYFKELIALYKRSKPLWQLDHSREGFQWIDANNNEQSIFSFIRQGDKQEDALVVVCNFTKATYENYKVGVPDFEYYNEILNSDAEQYGGSGQVNKKRLKTIQEPYHNQTAHVEITIPPFGVSILRPVKTRKGSKKQDGSKTKVRSNVTSRGKR

SEQ ID NO: 7871 - protein, 152 aa, Zea mays
MSLVRRSSVFDPFSVDLFDPFDSMFRSIVPSSSSSGSETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 7872 - protein, 122 aa, Arabidopsis thaliana
MASLEMNDLKKIGLGLTGFGVFFTFLGVIFVFDKGLIAMGNILFLAGVTLTIGINPAIQFFTKRQNFKGTISFGLGFLLVVFGWPIFGLLLESYGFLVLFRWVFFSSTTFNGFTNSFLVLIC

SEQ ID NO: 7873 - protein, 338 aa, Xanthomonas campestris
MSRPSLTRFLIEEQHAGRIDPELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQADMRVPEDTAEFAINMSNQRHWEPAMQAYVGDLLAGKDGARGKDFNMRWIASMVADVHRILTRGGIFIYPWDKKDAAKPGKLRLMYEANPMGMLVEQAGGAATTGRERILDIQPTQLHQRVPVFLGSKNEVAEATRYHVEFDKAQG

SEQ ID NO: 7874 - protein, 392 aa, Bradyrhizobium japonicum
MSINIDSGQDSDQEHDDVMYPQVLPFVLIHAGCLAAIWSGVSWQAVAICVALYWLRMFGITAGYHRYFSHRAYATSRAFQFILAFLAQSSAQKSVLWWAAKHRHHHLHSDTAQDVHSPRHKGFVYSHLGWIFYRQHDATDLVKVSDLASYPELMWLHRLELLPAVVLAGLCFLIAGWSGLVVGFMWSTVVLYHATFCINSLAHVHGRRRYVTGDDSRNNWLLALLTMGEGWHNNHHAYQASARQGFYWYEVDLTYYALVALSWLGIVWDLKLPPRQVLRNEHRLGSRVVKQAAEQLAARFDPEHIALAIRTSIHETELSVRDALSLLQHRADLRLSSMPTREQLLAEAQRMFAKTISLDDIVDRAYELLHDSVGFLLATPALSANTNAKSGI

SEQ ID NO: 7875 - protein, 332 aa, Gibberella zeae
MPFDKSSSQEYRPPRWIPTTGLATTCLVEPRHLWDSLYSQEQIAAWKAITDAVHAKGGYIFCQLWALGRVANPNVVPNIWSAGSKPFEAKGAASLPKLTTMTEADIDRFVGHYRQAALNAIEAGFDGVELHGANGYLIDQFLQTNSNDRTDSYGGSLENRFRFPLRVLNAVCDAIGPERVGIRMSPFSRFQGMREADPLSVFVPWAKAIVKAQPSLAFIHAVEPRIEGGSDSPDSHLKTDDTLSPVRDVVSSSNVKFIVAGGFTPETAVKHANQTDDLVGFGRYFILPANPDLPARIKNGWPLTKYDRSLFYTPDRKGYTDYPAYNPDASRL

SEQ ID NO: 7876 - protein, 994 aa, Candida albicans
MSTIPSQVEINFNKIHQRSNSSSSTSSYRIPSGNSCIPRTVEMPSLPPTSTHHQHQQMPSSSSHAHIAKKIHREVRFGAYILGSTLGEGEFGKVKLGWRKDGKHPSQVAIKLIKRSTITKDSDSEIKIHREINSLKLLNHPNIVNLVEVMKSGKYIGIVLEYASGGELFDYILQHKYLKENVAKKLFAQLVSGVDYMHAKGLIHRDLKLENLLLDKHRNVIISDFGFVNSYNRDKNDLMKTSCGSPCYAAPELVLSQTAYEGRKVDIWSLGVILYAMLAGYLPFDDDPENEDGSDIIKLYHYICKTPLTFPEYVSPLARDLLRKIIVSDPKKRISIDDIRNHPWLSSHANLLSIRQPEWDKVHSEKQQPIAVEPPQPNKRYSMINERTNSSSLMSPAPRVTHTQPLSSHARSYSSTSISLLYSSPSATPSMANAVTNGEGATTTTTNGSINESNDTLQLSGTPSPKKPSTVSPVRGHQKSASISNSYSSASIALKAVVHEENRLHNHQQSQQYIPRSSTISTIVESPTKANTATETETTDGHKILLPPPSKDAQKLPHAAKKPRPTSYHPSSMSSALIHNNQNPTDVLKMPSPINFPMTQFISTSPPKSNGSLNDSGNFTNCSPKATSRRNSVVTHVHVNGVLSKENLIHSSSSPDNKRNSVLSYLEDKIDTLELTESHSPSKNTFEEIVDAAIATPEINQVPVFDSQTSPNGIGLDIKHKEFDETSLVVEKKSKETVSDSKSEESTKETQQQENVVMYEPIVPVEEYIKKPEEVNSVEAKQPEEVKSEDKSLQGQKSQQQQQQPEKHSADIGKTKVDLKKSASQKKKVKEESIKKQKDVDSKPIERRHTIAARRHHNDENKENKDVKKRNRFSLLSFYSSYNSSNSNVSLATSKVPSNSENNTTVLKPTSMNTTRKVLEPSNETNIMRKETKQTNSNGSTTSKSTTSSSSSSAPAASSSSSSSTSKRASTATKETSAARKVMDFFKRRSVRVG

SEQ ID NO: 7877 - protein, 474 aa, Arabidopsis thaliana
MVQLSRKATCNSHGQVSSYFLGWEEYEKNPYDVTKNPQGIIQMGLAENQLCFDLLESWLAQNTDAACFKRDGQSVFRELALFQDYHGLSSFKNAFADFMSENRGNRVSFDSNNLVLTAGATSANETLMFCLADPGDAFLLPTPYYPGFDRDLKWRTGVEIVPIQSSSTNGFRITKLALEEAYEQAKKLDLNVKGILITNPSNPLGTTTTQTELNILFDFITKNKNIHLVSDEIYSGTVFNSSEFISVMEILKNNQLENTDVLNRVHIVCSLSKDLGLPGFRVGAIYSNDKDVISAATKMSSFGLVSSQTQYLLSSLLSDKKFTKNYLRENQKRLKNRQRKLVLGLEAIGIKCLKSNAGLFCWVDMRPLLRSKTFEAEMDLWKKIVYEVKLNISPGSSCHCEEPGWFRVCFANMIDETLKLALKRLKMLVDDENSSRRCQKSKSERLNGSRKKTMSNVSNWVFRLSFHDREAEER

SEQ ID NO: 7878 - protein, 415 aa, Arabidopsis thaliana
MANNNVYSVLKSLLLLLHLVFLSKQHVDSASIVKFLPGFEGPLPFELETGYIGVGEEEEVQLFYYFIKSERNPKEDPLLLWLTGGPGCSAISGLLYQNGPLAMKLDVYNGTLPSLVSTTYSWTKTSSMIFLDQPVGTGFSYSRTQLFNKPSDTGEAKRIHEFLQKWLGKHQEFSSNPFYVGGDSYSGLVVPATVQEISKGNCQCCNRPINLQGYVLGNPLTDCVYDCNYRVPFAHKMALISDELYERTCRGEYVNVHPHDTECLKFVEEFNKSYRFMLTTYWANDETVRKALQINKESIGEWTRCYRGIPYNHDIKSSVPYHMNNSIDGYRSLIYSGDHDIQVPFLGTQAWIRSLNYSIIDDWRPWMIKDQIAGYTTSYVNKMTFATVTGGGHTAEFTPKETFMMFQRWINGQPL

SEQ ID NO: 7879 - protein, 371 aa, Magnetospirillum magnetotacticum
MTQPHLFQPLSLRGLTLPNRVAVAPMCQYSAKDGVVQDWHLMHYGSLAASGPGMVVIEATGVTPEGRISPKCLGLYDDATEAGFIRLVAAIKGFGGNGAIGVQLGHAGRKGGAAAPWEGGKFSPDGWQTISASDIAFDEGWPSPKAATIEDLDRLKQAFVIAAQRALRIGFDFIELHSAHGYLLHQFLSPLSNRRDDQYGGSLENRMRFPLEVITAVRAVWPADKPLGLRISATDWVEGGWDADQAVNYAKAFKAAGIDFVCVSSGGLVSYAKVPVGPGYQIELAARIRREAGIPTRAVGLIATPHQAETALTEGAADLIAIGRGFLDNPRWVWHAAQALGAQMTYPPQYLAAGTRAWPGVALARPTLAAE

SEQ ID NO: 7880 - protein, 777 aa, Arabidopsis thaliana
MVSLSNQTRFSFHPNNLVVSEKRRLGISGVNFPRKIKLKITCFAAERPRQEKQKKKSQSQSTSDAEAGVDPVGFLTRLGIADRIFAQFLRERHKALKDLKDEIFKRHFDFRDFASGFELLGMHRHMEHRVDFMDWGPGSRYGAIIGDFNGWSPTENAAREGLFGHDDYGYWFIILEDKLREAVPHGSKYRLYFNTPDGPLERVPAWATYVQPEDEGKQAYAIHWEPSPEAAYKWKYSKPKVPESLRIYECHVGISGSEPKVSTFEEFTKKVLPHVKRAGYNAIQLIGVPEHKDYFTVGYRVTNFFAASSRYGTPDDFKRLVDEAHGLGLLVFLDIVHSYAAADQMVGLSLFDGSNDCYFHYGKRGHHKHWGTRMFKYGDLDVLHFLISNLNWWITEYQVDGYQFHSLASMIYTHNGFASFNNDLDDYCNQYVDRDALMYLILANEILHVQHPNIITIAEDATYYPGLCEPVSQGGLGFDYYVNLSASEMWVSLLDNVPDNEWSMSKPVLQIVSTLVANKEYADKMLSYAENHNQSISGGRSFAEILFGGVDNGSPGGKELLDRGISLHKMIRLITFTSGGRAYLNFMGNEFGHPERVEFPTQSNNFSFSLANRRWDLLESGVHHHLFSFDKELMDLDKSKGILSRGLPSIHHVNDANMVISFSRGPFLFIFNFHPSNSYEKYDVGVEEAGEYTMILNSDEVKYGGQGIVTEDHYLQRSISKRIDGQRNCLEVFLPSRTAQARYEPKVTTRGDVILTWLVQAMMAVKKIINHAFTEVQ

SEQ ID NO: 7881 - protein, 416 aa, Sinorhizobium meliloti
MHAKMPGGLLAGFLLLLVPTQGFGLDLPRSGHPIFDRVVTLVADNFHDPSALDGFGAAVRQELDGGDPLNAKSTEPRVDAAIERILASLDASHTARFTQDSIAYYELADIFRYAIRHDMKRLFPPDGRASYAGVGMVTRMENGLPFVSDVYDGSPADKAGIRVGDEVLSVDGAPYREIESFRGRTGQKVEIRLRRNAGAQPFTTSVAVERLRPLPTFEKAIENSVSVNVSDGRRIGYLRLWTLSSPDGLDIAARELATGRLKDADGVVVDLRGRWGGGPPDAAELFVGDTPNFRLISRSGKDMLANVRWRRPVVAIIDEGSRSGLELFAYALKANGIPLVGTRTAGALLAGRAYLLPDDSMLELAVSDAVIDDGVRLEGRGVEPDVPVPFALPYAGGRDPQREAAMEEMRRILAKG

SEQ ID NO: 7882 - protein, 738 aa, Gibberella zeae
MTEQVTGAIKHAVMGHKNDKIDQLKANMVEPNENSRITSDYGVKQNNTDQWLRVASEDQTGPSLLEDAFGREKIHRFDHERIPERVVHARGAGAHGTFRLFESAADVTKAGLFTDTSRETPVFVRFSTVLGSRGSADTVRDVRGFAIKFYTQEGNFDIPGNNIPVFFIQDAMKFPDVIHAGKPEPNNEVPQAQTAHNNFWDFMFEHPEATHMHTWAMSDRTIPRSYRMMQGFGVNTYTLVNEKGERRFVKFHWTPELGVHSLVWDEALKLAGQDPDFHRKDLQEAIENGAFPKWKFGIQVLDESQEHDFDFDILDATKVWPEDLIPVRYIGELELNQTVDEYFTQTEQVAFCTSHLVPGIGHSDDPLLQGRNFSYQDTQLSRLGTNWEELPINKPVCPVMNFNRDGAMRHTITKGKVNYWPNRFSHQPPATESEGAYVDYAAKIVGMKQRTLSKKFKDHFTQAQLFYNSLSEIEKSHVQAAYSFELDHCDEAIVYERLTERLGEIDGDLANTIAEMVGGKKPANPKPNAGKKAKNLSQLDFVPETPTIKSRRIAIIIADGYDPVAFNAMYGAIKAQSALPFVIAPRRAPIFSAAEDSSSSKGIFPDHHLEGQRSTMFDAIFVPGGAKSIETLSKNGRALHYIREAFGHLKTIGGTGEAVEFINKAIQLSEVALSSTDGSGVVDSYGVVTLKNASPDTLKEIATVASDAKGFLEKFVYNVSCHRNWQRELDGLSTMVAY

SEQ ID NO: 7883 - protein, 490 aa, Cucumis melo
MVLVSSNDNGNAKKVLSKLAKGNGHGEDSSYFDGWKAYDSDPFHPIINPRGVIQMGLAENQLSFEFVEKWMKNNPQASICSVEGIDEFKDIAIFQDYHGLPEFRNAVANFMGKVRGNRVKFDPDRVVMSGGATGAHETMAFCLADPGEAFLVPVPYYPGFDRDLRWRTGVEIVPVKCESSNNFKLTREALETAYEEAEKSNIRIKGLLITNPSNPLGTVYDRQTLETAVSFINEKNIHLVCDEIYAATVFAEPGFISISEVIDNMNDVECDRNLIHVVYSLSKDMGFPGFRVGIIYSYNDAVVACARKMSSFGLVSSQTQYLIASMLSDDVFVDNFLAGSAEKLAVRHRNFTKGLAQVGIGYLKGSGGLFLWMDLRHLLKEKTLEAEMALWKVIINEVKLNVSPGSSFHCSEPGWFRVCFANMDDSTMDISITRIRNFVLQNKEVTTKVKKQKFCWRQSSLELRLSSRRLEDIMSPHSPLPQSPMLRATT

SEQ ID NO: 7884 - protein, 385 aa, Thermoplasma acidophilum
MKQIQLSRNVVDDISFGAIVKIRDQLLEMQRAGKKVYRLESGDPSFPIPEHVRLAIEDALKKNRTHYTDSTGIPELRKAIAEKLVKKNGIRSATPENVLVSNGGMNALYITFRSLIAPGEKVIIPDPMWTEIAEIIKLADGIPIRIPVERYVEEMRKYENDDRVRAVFINSPHNPTGYVFGEKQISDIIDFAESKGIFIVSDEAYEDVIFDGLKHLSPGSLYDDTISLFSMSKSYAMSGLRIGYAHTSNEILYDRMKKLLRCTINGVNSATQYGAVAALTGPQDYIGEMRKEYQKRRDIIYEAVSESRYLEPIKPHGTFYLWNRIKEYPPGVSDSWGMTSYLLEKTGVGSSPGPVFGPAGEGYIRFAFSAATDHIQEAADVLRNF

SEQ ID NO: 7885 - protein, 548 aa, Thermoplasma acidophilum
MVLASEPGYIGTVRIRNRLVMSPMISNMADPDGNTNENHISYLEERAKGGAGLIITEYTYVDRRSGIGSRNQMGMYDERQIPKFSRLTERIHAHGAKIFVQLVHAGAKAIGAINEYKIAPSKTNFDPSVREMDASDIEDVISAYRKAANIAERSGFDGIEIHGAHGYLVDEFLSPWWNKRTDRYGGSFENRIRFAQEVIDAVRSEVDIPVGIRISLYEDEEDGYSPDYGMKIAESIRNIDYVHVSAGNNEPPGSSASFYSPHAHIFQKLRGSTGKTLIVAGSITAREDVDLVLSAADFVAVGRAMLADPYFPMKIITGKGEIRPCIRCNQGCRNLAYGEVRCTVNPYFVVPEPRKIYKGEVVVVGAGVKGLEASLYAAKSGLKVVIYEKEDRIGGQINSIFDASKAREFRQLLDYYGRTIKKYGIDVRLGERYSGDGIYCLPDTVYPDLPDKDEIWIDSNVYMYHDLALRYAAEHKVYLSSYSLTSLDRARRKAYANIARKAGVTIVDTADHYDVSIHDRNQYDIYQAMLSGIEAMRSHIAASENEYL

SEQ ID NO: 7886 - protein, 463 aa, Listeria monocytogenes
MNNNFLWGGATASYQCEGAWDVDGKAESMWDYYLHEAGLENGDVASDHYHRYEEDIRMMKEGGQNSYRFSLSWPRIIKNRQGDINLKGIEFYQNLLDTCKKYDIEPFVTLYHWDLPQYWEETGGWLDHDVCAAFEHYAKVCYDHFGDKITNWTTFNEPKWFVANGYKIGNYPPGYQDTQKTMIAAYNVMYASALGVKAFKEGGYPGQIGIVHSYTPVNGIDESIETKIAMRYADNYCNNWILDTAALGEFPVDLIAELAKSHDISFMKTDELQTIKQNTVDFIGLNYYSRTLVKPYTGGETQLQFNHSGKKGESKVLIKNWFEQVKDPANETTEWDTEIYPKGLQDGLIEAYERYQLPLYVTENGIGVREDVSVPQVDDAYRIAFMNDHINAIFNAIDAGCDVRGYYAWSPFDLYSWKNGVEKRYGLVAVDFENNQIRKPKASYYWFKEMIESQGKLIKRREF

SEQ ID NO: 7887 - protein, 492 aa, Suaeda salsa
MDPYKFRPSSANNSPYFTANSGAPVWNNNNSLTVGHRGPILLEDYHLVEKLANFDRERIPERVVHARGASAKGFFEVTHDVSHLTCADFLRSPGVQTPVIVRFSTVIHERGSPETIRDPRGFAVKFYTREGNFDLVGNNFPVFFIRDGMKFPDMVHSLKPNPKSHIQENWRIMDFFSHHPESLHMFTFLFDDIGIPANYRHMEGSGVNTYTLINKAGKTYYVKFHWKPTCGVKSLLEDEAIKVGGANHSHATQDLYDSIASGNYPEWKLFIQTIDPADEDKFDFDPLDVTKTWPEDILPLQPVGRLVLNKNIDNFFAENEQLAFCPSIVVPGVHYSDDKLLQTRIFSYSDTQRHRLGPNYLQLPVNAPKCSHHNNHYDGFMNFMHRDEEVDYFPSRYDPVRHAERYPIPSNVLNGCREKQCIPKENNFKQPGERYRSMDPARQERFICRVVDALSDPRVTHEIRSIWISYWSQADKSLGMKVASRLNVRPTM

SEQ ID NO: 7888 - protein, 91 aa, Brassica napus
SFKNPRNGRNMFDGTDGHYFNSGNRGYHWMWDPRLFNYGSWEVLRYLLSNARWWLEEYKFDGSRFDGVTSMMYTHHGLQVKFTGNYNEYFG

SEQ ID NO: 7889 - protein, 259 aa, Triticum aestivum
  misc_feature (116)..(116): Xaa can be any naturally occurring amino acid
  misc_feature (200)..(200): Xaa can be any naturally occurring amino acid
MSGLEAARARARRAVADYLSAGTHHRIQESDVFMTVGGTGAITAITTVLGGAPGASILLPRPGFAPYEAACKLVGAEPRFYDLLPRQGWEADLAGVRAMADGATAAIVVINPNNPXCGAVYSTQHLLQIAETAKELGIPVIADEVYAHMVFGASKFVPMASYAHIAPVITIGAISKRFMLPGWRLGWLAFCDPNGTIKHXATEMLLNVTSGPASIIQAAVPKILLDEHDEFHQNVVNLLESAADSLYGRVNQIEALQCY

SEQ ID NO: 7890 - protein, 554 aa, Vibrio vulnificus
MCSVFGILDIKSDAAALRPIALEMSKKLRHRGPDWSGIYASDRAILAHERLAIVGLNSGAQPLYSPDKKLILAVNGEIYNHKEIRARYEGKYDFQTDSDCEVILALYQEMGADLLEELNGIFAFVLYDEEKDQYLVGRDHIGIIPLYQGYDEHGNYYVASEMKALVPVCKTISEFPPGSYYSSTDAGPQRYYIRDWNEYAAVQGNTSSKEELTAALEAAVKRQLMTDVPYGVLLSGGLDSSITSAVAKRYAAMRIEDDEQTEAWWPQLHSFAIGLDGAPDLKAAREVAAKIGTVHHEMTYTIQEGLDAIRDVIYHIETYDVTTIRASTPMYLMGRKIKAMGIKMVLSGEGADEIFGGYLYFHKAPNAQEFHEETVRKLLALNMFDCARANKSLAAWGVEGRVPFLDKEFIDVAMRLNPADKMCGNGKMEKHILRECFEHYLPDSIAWRQKEQFSDGVGYGWIDTLKAVAEEKVTDQQMEAAKFRFPYNTPTTKEGYVYREIFEELFPLPSAAECVPGGPSVACSSAKAIEWDESFKNCIDPSGRAVKAVHNEAY

SEQ ID NO: 7891 - protein, 610 aa, Pseudomonas aeruginosa
MCGLAGWVDYTRKLDDEFPAIFAMTDTLALRGPDAEGIWKHRNALLGHRRLAVIDLSGGVQPMSYRFPTGQEVTLVYTGEVYNHDALRERLRRAGHEFRTRSDTEVVLHAYLQWGERCCEYLTGMFAFAVFDGRDGHLLLVRDRLGIKPLYYARHREGLLFGSEIKSILAHPEFAARLDAVGLVDLLTLSRGTSQTPFREVQELLPGHLLSWRPNSQAKLRRYWEVRRQEHADDLQSTVQRTRELVTRALGSQLHADVPVCSLLSGGLDSTALTGIAQRIAKAEHGGDINSFSVDFVGQAEQFRSDDLRPDQDQPFALLAAQYIGSRHRTVLIDNAELVCERAREEVFRAKDVPFTFGDMDTSLHLMFGEIRRHSTVAISGEGADELFGGYGWFRDPQAVAAARFPWASRVRLPAGFIDAGFNRRCDLLQYQQASYDDGLRQVEHLAGDSPEERRMREFSHLHLKRWMVLLLERKDRLSMCNGLEVRVPYTDHELVEYVYNVPWSIKSRDGEEKWLLKRACADYVPEAVLKRRKSPYPTSANLGYERFLRGSVRRLLEDAANPVFGIVSREFLAAELEHPEGYFNTQVSRHNLETALALEGWLRLYGLSA

SEQ ID NO: 7892 - protein, 337 aa, Glycine max
MEERYETLKELGSWNFGVARLAKDKETGELVAIKYIERGKKIDANNVQREIINHRSLRHPNIIRFKEVLLTPTHLAIVLEYASGGELFERICTAGRFSEDDARYFFQQLISGVSYCHSMEICHRDLKLENTLLDGNPSPRLKICDFGYSKSALLHSQPKSTVGTPAYIAPEVLSRKEYDGKISDVWSCGVTLYVMLVGAYPFQDPEDPRNFRKTIGRIIGVQYSIPHYVRVSPDCRNLLSRIFVADPAKRITIPEIKQYPWFLKNMPKEIIEAERKGFEETTKDQPNQKVEEIMRIIQAARIPGQGSKAGEGGQAGTGSLDIEDDEEIDVSGDYEQV

SEQ ID NO: 7893 - protein, 411 aa, Glycine max
MAASVSTVGAVNRALLNLNGSGAGASAPSSAFFGTSLKKVIASRVPNSKVSGGSFKIVAVEEKKEIEETQQTDKDRWKGLAYDISDDQQDITRGKGLVDSLFQAPQDAGTHYAVMSSYEYLSTGLRQYLDNKMDGFYIAPAFMDKLVVHISKNFMTLPNIKVPLILGIWGGKGQGKSFQCELVFAKMGINPIMMSAGELESGNAGEPAKLIRQRYREAADMIKKGKMCALFINDLDAGAGRLGGTTQYTVNNQMVNATLMNIADNPTNVQLPGMYNKEENPRVPIIVTGNDFSTLYAPLIRDGRMEKFYWAPTREDRIGVCTGIFRTDGIPEQDIVKLVDSVGKKLVNSKDGPPTFEQPKMTLEKLLLYGNMLVQEQENVKRVQLADKYLNEAALGNANEDAIQRGTFFQS

SEQ ID NO: 7894 - protein, 221 aa, Actephila lindleyi
QASRFLFMKNKVRMICDCLAPPVKVIEDKKLGRPLSLCGSTLRSPHGCHAQYMANMGSIASLVMSVTINDANDEMDNDQQGVTKLWGLVVCHHTSPRFVPFPLRYACEFLIQVFGVLVNREVELAAQTREKHILKTQSVLCDMLLRDAPVGIITQSPNVMDLVKCDGAALYYKKKFWLTGVTPTEAQIRDIADWLLEYHGGSTGLSTDSLMEAGFPDAAVL

SEQ ID NO: 7895 - protein, 221 aa, Zea mays
  misc_feature (178)..(178): Xaa can be any naturally occurring amino acid
MGSEGPSVVTVHVTGFKKFHGVAENPTEKIVTNLKSFLEKRGLPKNLVLGSCTVLETAGEGALATLYKVLESAVADRGTGSSAQGQVIWIHFGVNSGAIRFALENQAVNEATFRCPDELGWKPQRVPIVPSDGSISRTRETTLPVNELTKSLRKIGYDVVPSGDAGRFVCNYVYYHSXLRFAEQHGIKSLFVHVPLFLTIDEEVQMHFVASLLEVIAFSSN

SEQ ID NO: 7896 - protein, 225 aa, Androstachys johnsonii
TDIPQASRFLFMKNKVRMICDCLAPPVEVVQDGKLSQPLGLCGSTLRSPHGCHSQYMRNMGTIASLVMSVTINENDDEMEGDQQKGRKLWGLVVCHHTSPRFVPFPLRYACEFLIQVFGVQINKEVELAAQMREKHILRTQTLLCDMLLRNAPVAIITQSPNVMDLVKCDGAALYYRKKFWLLGITPTEAQIRDIAEWLLEYHSGTTGLSTDSLMEAGYPGASIL

SEQ ID NO: 7897 - protein, 437 aa, Neurospora crassa
MATSTTSDLKLSQPLTLPNGLTLPNRLVKAAMAEQMGFGNHLPNPELAAVYATWARGDWGLILTGNVQVDHAHKGDAHDISPNHPGTTPEQTVTAFKAWADAARLNGQSKTPVVVQINHPGRQSPMGAGTRGLWEKAVAPSPVPLVLGEAFVPRLLSKVLFGTPRELTVAEIKDIVQKFAVTARITAEAGFNGVEIHAAHGYLLAQFLSKKTNRRGDEYGGSAENRARIVGEIIKECRRQVTEAVGEEEAKKFVVGIKLNSADWQAGRDGKEEEETDTAEEVLKQIELFEQWGIDFVEVSGGSYEDPQMANGPKPEKSERTMAREAFFLEFAKIIRTKFPKLPLMVTGGFRTRQGMEAALESDDCDMIGIGRPAIINPSLPANLILNPEVPDADARLFDKKRAEPHWIVEKLGMKSIVGAGVEVTWYVSELKKLAKF

SEQ ID NO: 7898 - protein, 641 aa, Cryptococcus neoformans
MASPATQTANAIAAINNRSNLVIPEIDFTQHQLENGEIVSTTERVIKDVQAPAMYVPTDDQFWSTTDKTKPDIAFLKNHFYREGRLTEEQALYILEKGGELLRSEPNLLEVDAPITVCGDIHGQYYDLMKLFEVGGNPADTRYLFLGDYVDRGYFSIECVLYLWSLKMWYPDTLFLLRGNHECRHLTDYFTFKLECKHKYSETVYNACMESFCNLPLAAVMNKQFLCIHGGLSPELHTLDDLRSINRFREPPTQGLMCDILWADPLEDFGSEKTNENFLHNHVRGCSYFFTYNAACQFLERNNLLSVIRAHEAQDAGYRMYRKTKTTGFPSVMTIFSAPNYLDVYSNKAAVLKYESNVMNIRQFNCTPHPYWLPNFMDVFTWSLPFVGEKITDMLIAILNCCTKEELEEEEEEFPLHAPEPTDAESAAERRQIIKNKILAVGRMSRVFSLLREESERVSELKSISGSNALPAGMLASGAEGIKEAIQGFEDARKSDIENERLPPDIIDPDEDKPASPSASPIMPATPEEIPSEIPYDSPITGTPRTPISGAIAFGSPGSPGTPTSPSIGGPPLTAWRPGHGRRTSLGTTKTSPSTRRRSLENTMHLIRDVVGGKDAQGDGQLERLAEVISSPTKGGQGERE

SEQ ID NO: 7899 - protein, 207 aa, Antidesma alexiteria
LLPLEIPLMKNKVRMICDCRAAPVKVIQDNRLVQPLSFCGSTLRSPHGCHAQYMENMGSIASLVMSVTINEDVDEIENDQPKGSKLWGLVVCHHTDSRFVPFPLRYACEFLIQVFGVQISKEVELAAQTREKHILQTQTVLCDMLLREAPVAIITQSPNVMDLVTCDGAALYYRKKFWLLGLTPTEELIKDIAEWLLEYHREVQAYM

SEQ ID NO: 7900 - protein, 195 aa, Vigna unguiculata
MATATVTLGGITDVPGAANSVEIANLARFAVDDHNKKQNGVLEFVRVISAKQQVVSGILYYITLEAKDGETKKVYKTKVWVREWLNPKEVQEFNLVTDSAIGTKDGGVGDVPSDTLHIENLARFAVDQYNKNENANLEFVRVIDAKEQVVEGFIYYITLEAKDGESKNVYEAKVWERSWLNSIELLEFKPVDVAV

SEQ ID NO: 7901 - protein, 462 aa, Ustilago maydis
MPSHQSTNAACADMDTSRFVSGLTPPLVDSIDALKISNFVPTRSGHPPPGSVPESILPEGVKKPALFQTLTLPFAAPEQAGKMTFKNRIIVSPMCQYSANNGLPTPYHIAHLGSFALHGVGNVMVEASGVEPEGRITPQDLGIWSEQHRDAHKALVSVLKSFTDGLGVGLQLAHAGRKASDWSPFYRGEKKQKFVTQEEGGWPDRVVAPSAIAYAQGHVTPRALTTEDINKLQDKFVQSARWAFEAGYDYVELHSAHGYLMHSFLSPLTNQRTDEYGGSLENRARFLLNVARRIRQEFPNKGLWVRVSSTDWADQAHQADSWTVDQTVELAKMLQEARVDLLDVSSGGLVPFQKITVGAGYQLFGAKAVRDALAKIEPDASKRMLVGAVGMMEGSYDSPNGQDRSQIGKLAEQSIQSGECDAVLLARGLMSYPSWTEDASVALMGTRAAGNPQYHRVHVAKK

SEQ ID NO: 7902 - protein, 558 aa, Metallosphaera hakonensis
  misc_feature (416)..(416): Xaa can be any naturally occurring amino acid
MFGANSGKNGTIFSLWAPYCSWVNLKIGDERIPMKKDERGYFLVEVDVTPGTKYKFETDKGEIPDPASRFQPEGVHGPSQVIPTDFSWEDHDWKGLNKNQLIIYELHVGTFSSSWTFDGVVEKLDYLSDLGVTALEIMPVAQFPGIRGWGYDGVYLYAVQNSYGGPTGLKRLVNEAHKRQLGIILDVVYNHVGPEGNYMGLLGPYFSSKYKTPWGLTFNYDDRGSDEVRRFVLENLEYWIKEFHIDGFRLDAVHAIVDTSPTHILEEIADLAHAHGKLVIAESDLNDPRIVNPKEKCGYGVDAQWVDDFHHAIHAFITGERQGYYSDFGELQDIVKSLRDTFVYDGKFSRFRGKTHGKPVYLDGCSFVVYIQNHDQVGNRGGGERLSVLVDEERLKMAASLYILSPYIPMIWMGEXYGERNPFYYFSNFSDPELVRGVREGRKRENGQQTDPQSEETFKSSRLSWNVNQEILSVYKTLIKLRKEYVDCKRDAEVNSGDMWMTVNKGKLLTVFSFKPSVIAIKGRGKLVMGSKSFPREITGETRFEEGFGIYMREVEET

SEQ ID NO: 7903 - protein, 224 aa, Apodiscus chevalieri
DIPQASRFFFMKNRVRMICDCRASPFKVIQDGRLAQPLSLGGSTLGSPHGCHAQYMENMGSIASLVMSVTIHEDNDEVENDQPKGSKLWGLVVCHHTSPRFGPFPLRYACEFLIQVFGVQIGKEVEMASQKREKHILQTQTILCDMLLRDAPVAIIAESPNVMDLVHCDGAALYYRKKFWLLGVTPTEEQIKDIAEWLLEYHSGSTGLSTDSLMDAGYPGLRSL

SEQ ID NO: 7904 - protein, 283 aa, Triticum aestivum
  misc_feature (227)..(227): Xaa can be any naturally occurring amino acid
  misc_feature (251)..(251): Xaa can be any naturally occurring amino acid
  misc_feature (266)..(266): Xaa can be any naturally occurring amino acid
EAVDLYNKHYKRDDTRIGLAFDVMGRVPYGTSFLDKQAEERSWDINLGWFLEPVVRGDYPFSMRSLARERLPFFKDEQKEKLAGSYNMLGLNYYTSRFSKNIDISPNYSPVLNTDDAYASQEVNGPDGKPIGPPMGNPWIYMYPEGLKDLLMIMKNKYGNPPIYITENGIGDVDTKETPLPMEAALNDYKRLDYIQRHIATLKESIDLGSNVQGYFAWSLLDNFEWXAGFTERYGIVYVDRNNNCTRYMKXSAKWVKESTPRKSPXMKILPSLKIGAHMWVHP

SEQ ID NO: 7905 - protein, 280 aa, Glycine max
MKGEYVEQQQQHPKSETPPSMFSKLQPQHHPFPHHPFQLSAEDATTITPSTAQKANSSGGDGATIEVVRRPRGRPPGSKNKPKPPVIITRDPEPAMSPYILEVSGGNDVVEAIAQFSHRKNMGICVLTGSGTVANVTLRQPSTTPGTTVTFHGRFDILSVSATFLPQQSGASPAVPNGFAISLAGPQGQIVGGLVAGGLMAAGTVFVIAASFNNPAYHRLPPEEEGASAGDGHSPPVSGGGDSGHGQAESCGMSMYSCHLPSDVIWAPTARPPPPPPPPY

SEQ ID NO: 7906 - protein, 513 aa, Ralstonia metallidurans
MSGSPSPESEADAARLPYRIDRNFTRGLVWLRRDLRTDDNAALHYALKHCRQVWCVFVFDREILAPLLARGLHADRRVEFILRSLEPLRRALEDSGGGLIVLDGTARQAIPRLAAELEVEAVFANHDYEPAANDRDEAVRRTLAADSRVLLTFKDQVIFERDEILTGQGRPFSVFTPYKNAWLRTVRPFDLRPYPIEKHQETLAPVPQRYRGQLPTLADLGFTATNLAGIAMPTGSDGAHALFDEFLSRIGDYGRRRDFPAVRGPSYLSVHLRFGTISIRTLARAAHDTMLRGGAASEGATVWLSELIWRDFYFMILHHHPRVAEGKSFHAEYDGLRWIAPATGDRYFAAWCDARTGYPLIDAAMLQIRQSGYMHNRLRMVTASFLVKDLGVDWRRGEQYFADQLNDFDLAANNGGWQWAASTGCDAQPYFRIFNPVTQSEKFDPQGQFIRRYLPMLAALPDRYIHAPWTAPNEVLRAAGVTLGKDYPRPIVQHDVARKETLERYGVVKSAKA

SEQ ID NO: 7907 - protein, 639 aa, Pyrus communis
MESCDCIEAQWPPDELLVKYQYISNVFIALAYFSIPLELVYFVQKSAFFPYRWVLVQFGAFIVLCGATHFINVWTFSMHTKTVAIVMTVAKVSCAVVSCRTALMLVHIIPDLLSVKKRELSLKSRAEELDKEMGLMLTQEETGRHVRMLTHEIRGTLDRDTILKTTLVELGRTLGLEECALWMPSRTGMNLQLHHTLNYQIQVGSTVSINLPVVNEVFNSSRAIRVPYTCPLARIRPLVGRYVPPEVVALRVPLLNLSNFEINDWPDLSAKSYAIMVLILPTDSTRKWRDHELELVDVVADQVAVALSHAAILEESMRARAQLMEQNKALDLARREAEMAIHARNDFLAVMNHEMRTPMQAIIALSSLLLETELTPEQRLMIETVLKSSNLLETLINDVLDLSRLDDSSLELDNEIFNLHGVFREVMNLVQPIASVKKLSMTLILAPDLPVCAVGDENRLMQTILNVAGNAVKFTKQGYISIYYASVAKPEVFKRLATTGVYPESIEGHFYLRVQVKDSGCGILPEDIPHVFTKFSQPRNGSNRINEGAGLGLAICKRFVNTMGGHIWIESEGIDKGSIVAFIVKLGICDNHSDTTTHQVQMPPKGQANYGSGDLVGRKPSFRVRFGASSSIARYQRSL

SEQ ID NO: 7908 - protein, 266 aa, Brassica napus
  misc_feature (139)..(139): Xaa can be any naturally occurring amino acid
  misc_feature (154)..(154): Xaa can be any naturally occurring amino acid
  misc_feature (200)..(200): Xaa can be any naturally occurring amino acid
MAPSAASAASFFPVQLAALSLLLPPSSFAAAPPLPTRHLPPPSQLPPVAPPRFSRRSRPRTPNSDAEVIALSPKTLMATNRFICEVCNKGFQREQNLQLHRRGHNLPWKLKQKSTKEVKRKVYLCPEPTCVHHDPSRAXLGDSTGTPKLLSGTXAEKKWKCTECSKRYAWQSDWKAHSKTGHSDWNRRSKTCGTTRVDSXLTHRAFCDAIVTLRARALPSLTSLKSHHFTYGQNTNNPNNTSSMILGLSHMGPSQNLDHESGDRLR

SEQ ID NO: 7909 - protein, 388 aa, Scenedesmus obliquus
  misc_feature (1)..(1): Xaa can be any naturally occurring amino acid
  misc_feature (43)..(43): Xaa can be any naturally occurring amino acid
  misc_feature (56)..(56): Xaa can be any naturally occurring amino acid
  misc_feature (134)..(134): Xaa can be any naturally occurring amino acid
  misc_feature (253)..(253): Xaa can be any naturally occurring amino acid
XVTSEQLLFLEAWRAVDRAYVDKSFNGQSWFKLRETYLKKEPXDRRAQTYDAIRKXLAVLDDPFTRFLEPSRLAALRRGTAGSVTGVGLEITYDGGSGKDVVVLTPAPGGPAEKAGARAGDVIVTVDGTAVKGXSLYDVSDLLQGEADSQVEVVLHAPGAPSNTRTLQLTRQKVTINPVTFTTCSNVAAAALPPGAAKQQLGYVRLATFNSNTTAAAQQAFTELSKQGVAGLVLDIRNNGGGLFPAGVNVARXLVDRGDLVLIADSQGIRDIYSADGNSIDSATPLVVLVNRGTASASEVLAGALKDSKRGLIAGERTFGKGLIQTVVDLSDGSGVAVTVARYQTPAGVDINKIGVSPDVQLDPEVLPTDLEGVCRVLGSDAAPRLFG

SEQ ID NO: 7910 - protein, 638 aa, Pyrus communis
MESCDCVDAQWPPDELLVKYQYISDVFIALAYFSIPLELVYFVQKSAFFPYRWVLMQFGAFIVLCGATHFINVWTFSMHTKTVAIVMTVAKVSCAVVSCATALMLVHIIPDLLSVKSRELRLKNRAEELDREMGLMPTQEETGRHVRMLTHEIRSTLDRDTILKTTLVELGRTLGLEECALWMPSRTGMNLQLHHTLNYQIQVGSTVSINLPVVNEVFNSSRAIRVPYTCPLARIRPLVGRYVPPEVVALRVPLLNLSNSEINDWPDLSAKSYAIMVLILPTDSTRKWRDHELELVDVVADQVAVALSHAAILEESMRARAQLMEQNKALDLARREAEMAIHARNDFLAVMNHEMRTPMQAIIALSSLLLETELTPEQRLMIETVLKSSNLLETLINDVLDLSRLDDGSLELDNEIFNLHGVFREVMNLVQPIASVKKLSMTLILAPDLPVCAVGDENRLMQTILNVAGNAVKFTKQGYISIIASVAKPESSRDLATTGVYPESIEGHFYLRVQVKDSGCGILPEDIPHVFTKFSQPRNGSNRINEGAGLGLAICKRFVNTMGGHIWIESEGIDKGSIVAFIVKLGVCDNHSDTTTHQVQMPPKGQANYGSGDLVGRKPSFRVRFGASSSIARYQRSL

SEQ ID NO: 7911 - protein, 263 aa, Aspergillus nidulans
MSPQCTLPCSRHFHLHTETTSAKNYSSSCIAHRTTILAEHSVPGSSSTAASSLASIILPKISHEQSQKLTYTHERLFVHYISDSPSGPADTTTSEPSSYAPLSYIVVATAEQGRRIPFAYLLEMKRRFLSTYPPSNTDFASLPAYGCAAFNNELRGLLQTFNTAPPADSLASAKKEIDSVRDIMTENIERVLERGERIDLLVDKTDRLGGSAHDFRMRSRGLRRRMWWKNAKLMVLLGVVVVFLIYLFVGMGCGLPAWGRCVG

SEQ ID NO: 7912 - protein, 621 aa, Rhodothermus marinus
MSWLTEEDIRRWESGTFYDSYRKLGAHPDDEGTWFCVWAPHADGVSVLGAFNDWNPEANPLERYGGGLWAGYVPGARPGHTYKYRIRHGFYQADKTDPYAFAMEPPTGSPIEGLASIITRLDYTWHDDEWMRRRKGPASLYEPVSIYEVHLGSWRHKRPGESFSYREIAEPLADYVQEMGFTHVELLPVMEHPYYGSWGYQVVGYYAPTFRYGSPQDLMYLIDYLHQRGIGVILDWVPSHFAADPQGLVFFDGTTLFEYDDPKMRYHPDWGTYVFDYNKPGVRNFLISNALFWLEKYHVDGLRVDAVASMLYRDYSRKEWTPNIFGGRENLEAIDFIKKFNETVYLHFPEAMTIAEESTAWPGVSAPTYNNGLGFLYKWNMGWMHDTLDYIQRDPIYRKYHHDELTFSLWYAFSEHYVLPLSHDEVVHGKGSLWGKMPGDDWQKAANLRLLFGHMWGHPGKKLLFMGGEFGQHHEWNHDTQLEWHLLDQPYHRGIQLWVCDLNHLYRTNPALWHDGPEGFEWIDFSDRDQSVICYLRKNAGRMLLFVLNFTPVPREHYRVGVPIGGPWHEVLNSDAVAYGGSGMGNFGRVEAVPESWHGRPFHLELTLPPLAALILEPEHG

SEQ ID NO: 7913 - protein, 413 aa, Arabidopsis thaliana
MASSSADNLTDKNIVFRKLKSKSENKVCFDCSAKNPTWASVTYGIFLCIDCSATHRNLGVHISFVRSTNLDSWSPEQLRTMMFGGNNRAQVFFKQHGWTDGGKIEAKYTSRAADLYRQILAKEVAKAIAEETNSGLLSSPVATSQLPEVSNGVSSYSVKEELPLSKHEATSATSSPKASNTVVPSTFKKPIGAKRTGKTGGLGARKLTTKPKDNLYEQKPEEVAPVIPAVSSTNNGESKSSAGSSFASRFEYNDDLQSGGQSVGGTQVLNHVAPPKSSSFFSDFGMDSSFPKKSSSNSSKSQVEESDEARKKFTNAKSISSAQYFGDQNKNADLESKATLQKFAGSASISSADFHGHDQDDSNIDITASDLINRLSFQAQQDLSSLVNIAGETKKKLGTLASGIFSDIQDRML

SEQ ID NO: 7914 - protein, 388 aa, Scenedesmus obliquus
MVTSEQLLFLEAWRAVDRAYVDKSFNGQSWFKLRETYLKKEPMDRRAQTYDAIRKLLAVLDDPFTRFLEPSRLAALRRGTAGSVTGVGLEITYDGGSGKDVVVLTPAPGGPAEKAGARAGDVIVTVDGTAVKGLSLYDVSDLLQGEADSQVEVVLHAPGAPSNTRTLQLTRQKVTINPVTFTTCSNVAAAALPPGAAKQQLGYVRLATFNSNTTAAAQQAFTELSKQGVAGLVLDIRNNGGGLFPAGVNVARMLVDRGDLVLIADSQGIRDIYSADGNSIDSATPLVVLVNRGTASASEVLAGALKDSKRGLIAGERTFGKGLIQTVVDLSDGSGVAVTVARYQTPAGVDINKIGVSPDVQLDPEVLPTDLEGVCRVLGSDAAPRLFG

SEQ ID NO: 7915 - protein, 495 aa, Pyrus communis
MASSASENRLLLSRIATNEKHGENSPYFDGWKAYDQNPFHLTENPEGVIQMGLAENQLSFDLVEEWIRKNPKASICTAEGIEKFRSVANFQDYHGLPEFRQAIASFMWKARGGRVTFGPHRVVMSGGATGANELVMFCLANRGDAFLIPSPYYPAFYRDLGWRTGVQIVPVDCDSSNNFKITKEALEAAYGKAQNNNINVKGLIITNPSNPLGTTLDKDTLESLVTFINQKNIHLVCDEIYAATVFSSPKFTCITEVIQNMNCNPNLIHIVYSLSKDMGFPGLRVGIVYSYNDDVVNIGRKMSSFGLVSSQTQHMLASMLSDEDFVEKFLTTSAKRLAKRHGVFTDGLEEVGINCLKSNAGLFCWMDLRRLLRDQTFDGEMVLWRVIVNEVKLNVSPGSSFKCVEPGWFRVCFANMDDDTVEVALKRIRAFVGQAKKAQEQAQVKSPKKRWQSNLRLSFSSSSRRFEQEGVSVMSPRMMSPHSPMPHSPLLRATT

SEQ ID NO: 7916 - protein, 793 aa, Nocardia farcinica
MRIAVIGGGPAGLYFSALMKQLDPSHEITIWERNAPDDTFGFGVVFSDETLGGIEHADEQIYRGMSEQFARWSDIDIHYRGQVRTSGGQGFAAMSRKELLRLLQRRCTDLGVTIHFRTPAPDVEDLAATHDLVLASDGINSAVRSTFADVFEPSLDPRRNKYMWLGTDLVFEAFEFFVKHTPHGIMQVHAYPFSAQQSTFIVEMHESVWREAGFAAFADREFAPGENDEQSIALIAELFAAELDGHRLQANNSRWISFTTVRNRTWRHGNIVLIGDAAHTAHFSIGSGTKLAMEDALALAACLHENDSVAAGLAAYETERKPVVESVQRAAQASLEWFESIAQYTDQHPDQFAFNLLTRSRRITYDNLRLRDDGFVEAIDGWYLSTQDAAAAAPRPPMFYPLRLKDVELPNRILVSPMDMYSAVDGVPTDFHLVHLGSKALGGAGLVMTEMVCVSPEGRITPGCAGLYTPEQERAWARVVDFVHGHTRAKIGVQLGHSGRKGATKVMWEGIDDPLESGGWETVGPSAIPYGPASRTPREITRAEMDRVTREFADAAAAAARAGFDLLELHCAHGYLLSAFLSPLANRRTDEFGGSLDNRLRFPLRVFDEIKQVWPADRPLSVRISATDWAEGGNTVDDAVEIARAFAAHGVDVLHVSSGQVVKHEKPAYGRSYQTPFADRIRQEVGVPHGVAVVAVGAISSHDDVNSVLLAGRADLVAIGRAHLWDPQWTLHAAVEQGYRGEAAEWPAPFRAGNRKPPTGRTDGPPPRLELIRATGTPAPRRRWTPARVTAAV

SEQ ID NO: 7917 - protein, 446 aa, Pyrus communis
MAIDIEQRQQPSPRLSKIAVSDTHGEDSPYFAGWKTYDENPYHESSNPSGVIQMGLAENQVSFDLLENHLEENSEASTWGSKGSKGVSGFRENALYQDYHGLLSCRKAMASFMEQIRGGRAKFDPARVVLTAGATRAIELLTFCIADPGDALLVPTPYYPGFDRDLRWRTGVNIVPIHCESSNNFQITPQALEAAYKVTEAKNMRVRGVLFTNPSNPLGATSQRTVLEETLDFVTQKSIHLVSDEIYSGSAFSSSEFISVAEILEDRQYKDAERVHIVYSLSKDLGLPGFRVGTVYSYNDKVVTTARRMSSFTLISSQTQHLLASMLSDKEFTENYIKTNRERLRKRYDMICEGLKKSGIECLKGNAGLFCWMNLMPFLDEPTRESELTLWDSMLHEVKLNISPGSSCHCSEPGWFRVCFANMSEQTLGIALTRIHNFMEKRERAC

SEQ ID NO: 7918 - protein, 468 aa, Streptococcus pneumoniae
MTKTLPKDFIFGGATAAYQAEGATHTDGKGPVAWDKYLEDNYWYTAEPASDFYNRYPVDLKLAEEYGVNGIRISIAWSRIFPTGYGQVNAKGVEFYHNLFAECHKRHVEPFVTLHHFDTPEALHSNGDFLNRENIEHFVDYAAFCFEEFPEVNYWTTFNEIGPIGDGQYLVGKFPPGIQYDLAKVFQSHHNMMVSHARAVKLYKEKGYKGEIGVVHALPTKYPLDPENPADVRAAELEDIIHNKFILDATYLGRYSAETMEGVNHILLVNGGSLDLREEDFTALEAAKDLNDFLGINYYMSDWMEAFDGETEIIHNGKGEKGSSKYQIKGVGRRVAPDYVPRTDWDWIIYPQGLYDQIMRVKKDYPNYKKIYITENGLGYKDEFVDNTVYDDGRIDYVKQHLEVLSDAIADGANVKGYFIWSLMDVFSWSNGYEKRYGLFYVDFETQERYPKKSAHWYKKVAETQIID

SEQ ID NO: 7919 - protein, 310 aa, Prochlorococcus marinus
MVSSVIEATAPLRRPVSADKALAASEKLQVKTKKELRYPRKFKRRWGTVGFMGAIHALTIFALLPRFWSLQNIAALLILYWVTACLGVTLGYHRLLSHRAFKVPHWLERFFATCGALSCQHGPIDWVGLHRHHHTFSDTDADHHNSKKGFWWSHMGWMFEPIPALQTVPNFSGDLIQDPYYRFLNKNFLLLQIPLGALLYWIGHGSESGGWSMVLWGIPFRLVVVYHVTWLVNSATHCWGNVAFDSGDGSKNNWWVAALTFGEGWHNNHHAYPSSARQGLFKGQIDLTWQHIRLLHALGLAKKIRLPMKP

SEQ ID NO: 7920 - protein, 220 aa, Triticum aestivum
MWSTDSDLDESASTTTAAASSLSSSSCSLQPQTPPPPRCRRSRNRRRAQRRVKNCPEAEVEESEAEAEEVWCGAQWEAAWPRRARPVVLAGEDAAPDRAGAGAGDSGVGRARSLTDDDLEELKGCVDLGFGFSYNEIPELCGTLPALELCYSMSQRFLDEHQAPSKVEDLAPEPPAVVPPSPVQPIPNWKISCPGDSPDEVKARLKYWAQAVACTVKLCS

SEQ ID NO: 7921 - protein, 429 aa, Zea mays
MRGSVRDMYGSATDDDRISHPQRRRSRAPRPLAASVHHPCTHPNETTQLNVSTQPVSSRHSTGFPPTAAAPPPVTVPRACPRRDHLTTPTYDATSHAPSHTRHRFKTLTPLTHHTRTVSPQRARARRPSNHRENKSQPNSPVSQRSLSLHYSTMSSMELLHAVVPEKQSEEEVAPAATTTSSSATATGGDEGAHVLQGWAKRKRSRRQRSEEENLALCLLMLSRGGHHRVQAPPTPVPSAAPAAAEFRCSVCGKSFSSYQALGGHKTSHRVKLPTPPPPPPAVTVPAAVPVPEAPAPTTVVVPPLPPVEVGREPATSSTAASSDGAASSRVHRCSICHKEFPTGQALGGHKRKHYDGGVGSAAASTDVPAAPAETSAEVGSSAARAFDLNLPAVPEFVFRCGKPGKMWEEDEEVQSPLAFKKPRLLMTA

SEQ ID NO: 7922 - protein, 670 aa, Penicillium janthinellum
AAAQRRQNDSSVFLAIMVAAAVESESSLTDGDAGALLLQDISEWDEVFRFDRLEAVERAAHAAAAAAFGAFVARGDWTASAAAAFQAAGKQIAFMAAFSTVAGAKGSATVRDADAFAAKFASAAALQELVGNNSPISFFIFDLLFAAILFASKAKAANQAAFAAAAELAAESLFVRLPSLHQVSFFALAGFAAVAAHRHMNGYGSHTFKLVAKDGSVYCSKFWYKADQGQAAEVWKDAEEVAAEDVDYFRDLNFQAEAAGRYPLWELASQVMTFSDFEIDPFNENIPTKVVPRESVPLIVDAELLLNRNPLNMFAEVEQVFMDVAAASKGADEVEDPLIQRQFAYIDTHLSELTASYGIPVCRPYATVLNDQEDGARYDDVQDVLVIAPNAFSASAVEVQIPAAAAFNLAAARVAAAGDVRVNAVVEADQRKQSRQFWASDVNAQKKRLVDAFRMEVASAVSASIQVDVTVEFSFVAAAAAARIAAAVGSAAAGALANRRQIKVIASLAVLAKADAKVRQKNALESSSQAVAVDAKAAAQDIVDSSDAANVVTVAREFAVLPQTAAADAAEFVAAASAKAFSSFPAMEVISVAAAAGAVAEPARASLDLNMAMFFSRIVASRGAAANAIAALVKASRDGVFVAAVLAKAAANNRAAEAIFKFEVRQAVDA

SEQ ID NO: 7923 - protein, 223 aa, Baccaurea javanica
DIPQASRFLFMKNKVRMICDCMAPPVKVIQDMNLAQPLSLSGSTLRSPHGCHAQYMSNMGSIASLVMSVTINEDDDEMKSDQPKGRRLWGLVVCHHTSPRFVPFPLRYACEFLIQVFGVQINKEVELAAQMREKHILQIQTVLCDMLLRDAPVAIITQSPNVMDLVKCDGAALYYRKKFWLLGVTPTESQIKDIAEWLLEYHSGCTGLSTDSLMEAGYPGASI

SEQ ID NO: 7924 - protein, 225 aa, Glycine max
MGQDQNQRSLIYAFVSRGTVILAEYTEFSGNFNTIAFQCLQKLPASNNKFTYNCDGHTFNYLVDNGFTYCVVADESIGRQVPVAFLERVKDDFVAKYGGGKAATVAANSLNKEFGSKLKEHMQYCVEHPEEISKLAKVKAQVSEVKDVMMENIEKVLDRGEKIELLVDKTENLHHQAQDFRNSGTKIRRKMWLQNMKIKLIVLAILIALILIIVLSVCRGFNCGK

SEQ ID NO: 7925 - protein, 195 aa, Geobacter metallireducens
MRRHTELRTMSHKDTGESVEPRRTTGSGTSHETKGITKSETEGSSREVSVLSPIREMERWFEESLSRPFFGMHWMPFRQMFSEVGERTELMPAVDMFEEGGHLVVKAELPGITKENLNLRIVDNNLILSGERSSEEKIERGNYLRLERSHGSFSRTLSLPDGLDTEHIKAGFKDGVLEVRIPRTESSTVREITVE

SEQ ID NO: 7926 - protein, 226 aa, Escherichia coli
SENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKA

SEQ ID NO: 7927 - protein, 576 aa, Listeria monocytogenes
MQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDGKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPSVFKSMLNSVARIMPEGMRGKSFLERGTTPMEERYIGNAKMFTEKEKQILLPKYQAGHDYTNITDPFYAETTNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLGLLDDHCAGKFDYSRKIWTVVIFMIWYDVYVADKYDFGK

SEQ ID NO: 7928 - protein, 223 aa, Baccaurea lanceolata
  misc_feature (47)..(47): Xaa can be any naturally occurring amino acid
DIPQASRFIFMKNKIRMICDCMAPPVKVIQDKNLAQPLSLSGSTMRXPHGCHAQYMSNMGSIASLVMSVTINEDDDEMKSDNPRGRRLWGLVVCHHTSPRFVPFPLRYACEFLIQVFGVQINKEVESAAQMREKHILQIQTVLCDMLLRDAPVAIITQSPSVMDLVKCDGAALYYRKKFWLLGVTPTESQIKDIAEWLLEYHSGSTGLSTDSLMEAGYPGLQS

SEQ ID NO: 7929 - protein, 283 aa, Lactobacillus sakei
MTTLTTTYTLANGVQIPVLGFGTWQTPDGDTAIKSVKAALEAGYRHIDTAQAYQNEASVGTAIQESGVARQDLFLTTKIWNANHSYDLTMQSFEESLQKLQTDYVDLLLIHWPNPIDFRDNWETANAETWRAMEELYNAGKAKAIGVSNFRAHHLEALKKTAKVQPMVNQIFLAPGELEAETVQYSRDNGLLLEAYSPLGTGKIFDVPEMKTLAAKYQRSIPQIASRWSLQHGFLPLPKSVHANYIQENTQLFDFELTPEDMQTIDQLDGVVGKAKDPDTATF

SEQ ID NO: 7930 - protein, 259 aa, Escherichia coli
KLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELT

SEQ ID NO: 7931 - protein, 447 aa, Arabidopsis thaliana
MAASSSSAASFFGVRQDDQSHLLPPNSSAAAPPPPPPHHQAPLPPLEAPPQKKKRNQPRTPNSDAEVIALSPKTLMATNRFICEVCNKGFQREQNLQLHRRGHNLPWKLKQKSTKEVKRKVYLCPEPSCVHHDPSRALGDLTGIKKHYYRKHGEKKWKCDKCSKRYAVQSDWKAHSKTCGTKEYRCDCGTLFSRRDSFITHRAFCDALAQESARHPTSLTSLPSHHFPYGQNTNNSNNNASSMILGLSHMGAPQNLDHQPGSVPSLFSSSMQSPNSAPHMSATALLQKAAQMGSTSSNNNNGSNTNNNNNASSILRSFGSGIYGENESNLQDLMNSFSNPGATGNVNGVDSPFGSYGGVNKGLSADKQSMTRDFLGVGQIVKSMSGSGGFQQQQQQQQQQQQQQQHGNSRERVGSSSDSADRSSMNVNTGGGPASTSPPYGIHHASF

SEQ ID NO: 7932 - protein, 194 aa, Bischofia javanica
FHFMKNKVRMICDCLAAPVKVIQDKKLTEPLSLCGSTLRSPHGCHAQYMANMGSIASLVMSVTINEDDDEMESDQPKGRKLWGLVVCHHTSPRFVPFPLRYACEFLIQVFGVQISKEVELAAQMKEKHIFQTQTVLCDMLLRDAPVAIVTRSPNVMDLVRCDGAALYYRKKFWLLGVTPTEAQIRDIAEWLLEY

SEQ ID NO: 7933 - protein, 224 aa, Magnetospirillum magnetotacticum
MDETIGMTLQQFGDFGDFSLTVLVTSPPWYENCYLVVHKPTNSLAIVDPGGDAERILEAVAATGAKPQVIWLTHGHPDHLGAAHQLETALGISTRAHADEAQVISSSSDLNRTFTGQPQKGPASLETFAGEPTETLGGAPVRVIHTPGHTPGGICLDFGGFVLTGDTLFRNGVGRTDLPGGSEQQLWASINRLLGLLDDEAMLFSGHGPEWATREARRWWRMVG

SEQ ID NO: 7934 - protein, 928 aa, Pseudomonas fluorescens
MRWLRIALGFTVTLLTLLCLNPALAAQGSGWAVLLDEQADLQLSDIRSPRYTNQFSPIELDKLTAAEPDGALWLRFKLQPGTHEQILRIFAPDLSHLNLYVLEGDKLIEQVNTGSGPSQAQKPLPSSDFMLPLPQSAKPLDVYVRLVSEHELRPFITLQSAVMGAADQSQTLIYGLLFGCLAMLILHNLTRFAYTRSRSSLWLAACEGLLTLSLLMLLNLFGPWLPAWEALQTPGAYIALLLTAPCGMMFAYRFFAPLGAHPLNRLLLGNILLISLFGLLLLFVDTLPLNIITYGLVALAGLSMLFVGGYHWHKGYRPARLFVAAMVIFNLGTLVILPALLGLTLVAPQGLIVTLLSVVCIAGLLMSIALGERQRNITENRFSVSRDLAASTAEVNAKAEFLAKISHEIRTPMNGVLGMTELLLGTPLSVKQRDYVQTIHSAGNELLTLINEILDISKLESGQIELDDVQFDLNALIEDCLSIFRAKAEQQNVELISFIQPQVPRVISGDPTRLRQALLSLLENALKKTDEGEVLIVVALDERSSKPRLRIAVQDSGQPMEAEEREALLHTELHSKNFLATTRLGGNLGLVIARQLILLMHGEFGIKSGTNQGSTLWLTLPLDAERLEHPTADLDGPLQGARVLVVDDNDTCRKVLVQQCSAWGLNVSAVPSGKEALALLRTKAHLRDYFDVVLLDQNMPGMTGMQLAAKIKEDPSLNHDILLIMLTGISNAPSKVIARNAGIKRILAKPVAGYTLKTTLADELNQRDKAPAAPYNQPAHAAQTPAPVTVPSDFRILVAEDNSISTKVIRGMLGKLNLQPDTASNGEEALQAMKANRYDLVLMDCEMPVLDGFSATQQLRAWEVGNQRVRTPVVALTAHILAEHKERARQAGMDGHMAKPVELSQLRELVEHWVTQRDLRERSTAHTS

SEQ ID NO: 7935 - protein, 195 aa, Breynia cernua
LRSLFMKNKVRMICDCQAPPVKVVQDKRLAQPLSLGGSTMRSPHGCHAQYMANMGTTASLVMSVTIEEDEETVNDQQIGRKLWGLVVCHHANPRFVPFPLRYACEFLMQVFGVQVNREVELAAQTTEKHILQTQTVLCDMLLRDAPVAIVTQSPNVMDLVKCDGAALYYRKKFWMLGVAPTETQIKDITEWLLEY

SEQ ID NO: 7936 - protein, 327 aa, Vigna unguiculata
PRVRAAATETAGGIIDVSGSANCLEIAILARFAVDDHNKKQNGVLEFVRVISAKQQVVSGILYYITLEAKDGETKKVYKTKVWVREWLNPKEVQEFNLVTDSAIETKDGGVGDVPSDTLQSGRRESDEEQRNMATATVTLGGITDVPGAANSVEIANLARFAVDDHNKKQNGVLEFVRVISAKQQVVSGILYYITLEAKDGETKKVYKTKVWVREWLNPKEVQEFNLVTDSAIGTKDGGVGDVPSDTLHIENLARFAVDQYNKNENANLEFVRVIDAKEQVVEGFIYYITLEAKDGESKNVYEAKVWERSWLNSIELLEFKPVDVAV

SEQ ID NO: 7937 - protein, 457 aa, Rubrobacter xylanophilus
MRFPEGFLWGAATAAYQVEGAVGEGGRGPSIWDTFSHTPGRVYRGDTGDVACDHYHRLEEDLDLMARFGLGAYRFSVAWPRIQPEGRGPANRSGLDFYRRLVEGLGERGIEPVLTLYHWDLPQALEDQGGWTSRQTSERFAEYAALVYEALGGSVRFWITLNEPWVSAWMGYGLGVHAPGRRSTADALAATHHLLLGHGLALEALRALGGGGRLGITLNLSPVRAASAEPADAEAARRVDGNANRLYLDPLFRGSYPQDMLEHYRGASDFSFVRDGDLQRISAPVDFLGVNYYMRHTVRAAPGGGVRGPSTGMRFGELGAETVLPEGVGTTAMGWPVEPDGLAEILVRVKEEYRDLPVFVTENGCAVHDYIDPEGEVNDVERVAYLDAHLRAAHAALERGVDLRGYMVWSLLDNFEWAEGYSKRFGLVYVEYGSQRRVPKRSARWYAAVIRRGGPEG

SEQ ID NO: 7938 - protein, 741 aa, Pyrus communis
MEACNCIEPQWPADELLMKYQYISDFFIALAYFSIPLELIYFVKKSAVFPYRWVLVQFGAFIVLCGATHLINLWTFSMHSRTVAIVMTMAKVLTAVVSCATALMLVHIIPDLLSVKTRELFLKNKAAELDREMGLIRTQEETGRHVRMLTHEIRSTLDRHTILKTTLVELGGTLALEECALWMPTRTGLELQLSYTLRQQNPVGYTVPIHLPVINQVFSSNRAVKISPNSPVARLRQLAGRHIPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTPEQRLMVETILRSSNLLATLVNDVLDLSRLEDGSLQLEIATFNLHSVFREVHNLIKPVASVKKLSVTLNIAADLPMYAIGDEKRLMQTILNVVGNAVKFSKEGSISITAFVAKSESLRDFRAPDFFPVQSDNHFYLRVQVKDSGSGINPQDIPKLFTKFAQTQTLATRNSGGSGLGLAICKRYVNLMEGHIWIESEGLGKGCTATFIVKLGFPERSNESKLPFGPKLQANHVQTNFPGLKVLVMDDNGVSRSVTKGLLAHLGCDVTAVSLIDESLHVISQEHKVVFMDVSMPGIDGYELAVRIHEKFTKRHERPALVALTGSIDKITKENCMRVGVDGVILKPVSVDKMRSVLSEILEHRVLFEAM

SEQ ID NO: 7939 - protein, 278 aa, Unknown
  Nostoc sp. PCC 7120
MLREFASRDELIAYLREQFPQAAERSDYVSDTKGGRQAAQKALQKVNPATYAKTRNFLTGDVTRLSPYIRYGVLSLGEIRNYVLDNVKHPDDAKKLINELGWRDYWQRLYIKLGNGIWEDQEEYKTGYTPAEYASDLAADIKEGKTGLVCIDSFSRELQETGYLHNHMRMWLAAYIVHWRRIRWQEGAKWFLEHLLDGDPASNNMSWQWVASTFSQKPYFFNRENLERYTQSIYCQKCPLYGHCNFEGSYEELEQQLFPKGKFTKQPNSQSWQRGKKK

SEQ ID NO: 7940 - protein, 638 aa, Pyrus communis
MESCDCIEAQWPPDELLVKYQYISNVFIALAYFSIPLELVYFVQKSAFFPYRWVLVQFGAFIVLCGATHFINVWTFSMHTKTVAIVMTVAKVSCAVVSCATALMLVHIIPDLLSVKKRELSLKSRAEELDKEMGLMLTQEETGRHVRMLTHEIRSTLDRHTILKTTLVELGRTLGLQECALWMPSRTGMNLELSHTLNYHIQAGSSVSIDLPEVNEAFNSSQAIRIPYTCPLARIRPLVGRYVPPEVVALRVPLLNLSNFQINDWPDVSAKSYAIMVLILPTDGTRTWREHELELVDVVADQVAVALSHAAILEESMRARKQLTEQNDALDLAWREAEMAIHARNDFLAVMNHEMRTPMHAFIALSSLLLETELTPEERLMIETALKDSNLLETLVNDVLDLSRLEDDSLELDIEKFNLHGVFREVMNLVQPVASVKKLSMTLILSPDLPVYAVGDENRLLQTILNVAGNAVKFTKQGYISITASVAKSESSRDWQPPEFYPASTDGYFYLRVQVKDSGCGVLPEDIRHLFTKFSQPRNGSNRINNGAGLGLAICKRFVNTMGGHIWIESEGIDRGSIVAFIVQLGICDNHSDTTTHQVQMPPKGQANYGSGDVIGHKPAFRDCFGVTSSIARYQRSL

SEQ ID NO: 7941 - protein, 471 aa, Listeria monocytogenes
MHTNTGFPADFLWGGAAAANQFEGAYNVDGKGLSVQDVTPKGGFGHITDGPTPDNLKLEGIDFYHRYKDDVKLFAEMGFKVFRTSIAWSRIFPNGDETEPNEAGLQFYDDLFDELLAHNIEPLITLSHYETPLHLSKTYDGWVNRKMIDFYENYVRTVFNRYKGKVKYWLTFNEINSILHAPFMSGGISTSPDKLSQKDLYQAVHHELVASALATKIGHEIMPEAQIGCMVLAMPTYPLTSNPDDIIAVMEAERKNYFFSDVHVRGTYPGYMKRYFRENNIELDVTEEDLEILKNTVDFISFSYYMSTTETADESKRKAGAGNILGGVQNPYLEASEWGWQIDPQGLRVVLNEFWDRYQKPLFIVENGLGAIDQLEKDENGNYTVNDDYRINYLSAHLSQVKEAIKDGVDLMGYTSWGCIDLVSASTAEMKKRYGFIYVDRNNDGTGTLNRYKKKSFDWYKNVIATNGEDL

SEQ ID NO: 7942 - protein, 458 aa, Triticum sp.
MSGGGRPPAAQKILQSLRPPPVFSTPSRPPFASPDDYHRFHAPTTPSATGSGGIGSGGVGGDIDEGLVIRTQLKRKATREENNAAESSDCMIVTTGVTGNPLLTPVSGKAVKNSKSKTKNNKAGPQTPTPNVGSPLNPSTPAGTCRYDSSLGLLTKKFINLLKQAEDGILDLNNAAETLEVQKRRIYDITNVLEGIGLIEKTLKNRIRWKGLDDSGVELDNGLSGLQTEVENLNLQEQALDERISDMREKLRGLTEDENSQRWLYVTEDDIKGLPCFQNETLIAIKAPHGTTLEVPDPDEAGDYLQRRYRIVLRSTLGPIDVYLVSQFDDGFENLGGAATPPRHTNVPKPGPCEDLHATNATQSSKSINVEYNIQHRQNTPQDPSSSNDYGGMTRIIPSDVNTDADYWLLTEGDVSITDMWETAPEVQWDTAVFLPEDVSIPHAHHSPRMQVPSMDQP

SEQ ID NO: 7943 - protein, 508 aa, Oryza sativa
MDGNAKGGGHSEALKNYNLGRTLGIGSFGKVKIAEHKLTGHRVAIKILNRRQMRNMEMEEKAKREIKILRLFIHPHIIRLYEVIYTPTDIYVVMEYCKFGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVDPMKRITIREIREHQWFQIRLPRYLAVPPPDTAQQAKMIDEDTLQDVVNLGYGKDHVCESLRNRLQNEATVAYYLLLDNRFRATSGYLGADYQESLERNFNRFASSESASSNTRHYLPGSSDPHASGLRPHYPVERKWALGLQSRAQPREIMIEVLKALQDLNVSWKKNGQYNMKCRWSVGTQATDMLDVNNSFVDDSIIMDNGDVNGRLPAVIKFEIQLYKTRDEKYLLDMQRVTGPQLLFLDFCADFLTKLRVL

SEQ ID NO: 7944 - protein, 744 aa, Vibrio fischeri
MNKGKASLADLIFRSIFIIFSILTVGITIHTYQLSVNTINEEVKRNLQQTSGIINNFFEHRLSILQIRQDTDAESLAIYDQYIESDYKNKLNTYFSNIEAKSPYNSPDFRFIEVNNKLYWDDGNSSFLSLNENCLKIIIKKNLNINTWYYIKMKEPLSEADFLIRKTPIVNNDSGRIVAFIYNAVMLNNNISFLNKLKKLTNSQDVFIINDNKILASSVSSNTEIYQEVTSILNGTRKRIPSKILNFTPINIKSMSGEISILSLKNKDNIELLEQRFIYSVVLSFFVLIAIAVLIRGLFEHKILLSLNSLLKYTNTVSKNETRSEYQGCGILEFDQIGEKLEQTFSELIEAKEDSYKAQRAAEKLAQVKSDFLARMSHEIRTPLNGILGISSLLKSSNLTREQQKQVNILHQGGEHLLAVLNDILDFSQIEQEKLKINSAPFKLSDVLENINAIYFPLCKNKNVLFSIENHVNPDVFINSDQVRLTQILFNLLSNAAKFTEKGKVKLTLSLNKHNSDYYLQFSVDDTGVGICAEEQTRMFEPFEQSGFSESRKFGGSGLGLAIVKQLLDLLKGKITINSTLGVGSTFSVLIPVLICEDKADISDAKAENQITSLPTGLKILLIEDNKSNAYIAKAYCQKYGLNVTWRNDAAQGIAELSKSEFDLILMDNQMPGMSGIKATKYIRNHLKIMTPIYAYTADALEESNQEFFSAGANYIITKPIKEKSILDALAFYKSENGLPPFDS

SEQ ID NO: 7945 - protein, 185 aa, Oryza sativa
MADGPGSPGGGGGSHESGSPRGGGGGGGGGGGGGGVREQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 7946 - protein, 205 aa, Fucus distichus
MSRNDSPFDMQIKLLMIGDTGVGKTCLLLRYANDSFSQTFITTIGIDFKIKNIDLDSKRIKLQIWDTAGQERFRTITTSYFRGAQGILLVYDVTDKKSFNSIRNWVAQIQQHADVAVNKILIGNKCDMDEDREVSKEEGANLAAEYGIQFFETSAKNDINVEKGFITIAREVKDRLMADGPGGGGGHGRTVDINGQASKKKTGCC

SEQ ID NO: 7947 - protein, 164 aa, Zea mays
MMPRRALLFAAVLLAASAAAVSGFHLGGDESGLVRGVLAALRERAEAEDAARFAVAHYNKNQGAALEFTRVLKSKRQVVTGTLHDLILEAADAGKKSVYRAKVWVKPWEDFKSVVEFRLVGDSESEPEPSVASDVSSGQDIVQEEARLHTIENDGLSGDFTSSS

SEQ ID NO: 7948 - protein, 140 aa, Zea mays
PIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 7949 - protein, 305 aa, Methanosarcina barkeri
MDFISNLFGKDKTQNLFEACKLGQIENVEKFLKSDKVDINSQDAYGKTALNYAVNKGYRDVVELLIKGGADPNIQDENGDTALISAAKVERGDIVELLIKSGADLNIQDRNYETALKFAVKVGYRKIVKLLLEGGADPNIQDRNGETALISAANRGQKDIVELLIKGGAEVNLQDENLNTALIAAAKIGHKSIVELLLKAGDDLDLQDKNGNTALTYAADRGYRDILELLLNSGASLDIQEENGLTALMLSAQAGDKDIVELLIKSGADLNLQDENGNTALDIAAEIEFTEIVELLRQSDASFRS

SEQ ID NO: 7950 - protein, 511 aa, Nicotiana tabacum
MDGSTVQGGSSVESFLRNYKLGKTLGIGSFGKVKIAEHTLTGHKVAVKILNRRKIKNMEMEEKVRREIKILRLFMHPHIIRLYEVVETPSDIYVVMEYVKSGELFDYIVEKGRLQEDEARKFFQQIISGVEYCHRNMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGMISLPSHLSAGARDLIPRMLIVDPMKRMTIPEIRMHPWFQAHLPRYLAVPPPDTMQQAKKIDEDILQEVVKRGFDRNSLVASLCNRVQNEGTVAYYLLLENQFRASSGYMGAEFQETMEYGYHQINSSEVLLPCWQHLPGIMDFQQVGARQFPVERKWALGLQSRAHPREIMTEVLKALQGLNVRWKKIGPYNMKCQWVPGVPGHHEGMSNNSIHIQFFGDDSTVIENGGVTIPNAVKFEVQLYKTREEKYLLDLQRVQGPQFLFLDLCAAFLAQLRVL

SEQ ID NO: 7951 - protein, 203 aa, Breynia stipitata
LRSLFMKNKVRMICDCQAPPVKVVQDKQLAQPLSLCGSTMRSPHGCHAQYMANMGTTASLVMSVTINEEDEETVNDQQIGRKLWGLVVCHHTNPRFVPFPLRYACEFLMQVFGVQVNREVELAAQTTEKHILQTQTVLCDMLLRDAPVAIVTQSPNVMDLVKCDGAALYYRKKFWMLGVAPTETQIKDITEWLLEYHGESTGL

SEQ ID NO: 7952 - protein, 361 aa, Yarrowia lipolytica
MPSNLFTPIQVGNCHLLNRIVFAPLTRCRNVKTVPSDLQVTHYAQRGQDPGTLLISEATMISEKSGGYLGHENLPGIWSSEQTEGWRKVVQAVHDAKSFMFIQLWDLGRASDPETIKALGYDRVSASDHYTEDGKNFVRGLEVKEIKERVDFYVQAAQNAIQAGADGVEIHAANGYLPDQFLRWNTNTRNDEYGGSVEKRARFVFEIVAAVVAQVGQKKTSIRLSPWTRFGDMAVDEHKSREQFEYVVTQLQTQYPDLAYIHVIEGRTDGHQDLEVPQWMNNDWIQNIWKGPIIRAGGYTPESAVAEAQTNDRTLVAFGRMFTSNPDLVDRVRHGKALTKYDRSTFYTQTGEGYVDWKNAD

SEQ ID NO: 7953 - protein, 544 aa, Bacillus licheniformis
MAKDIKFSEEARRSMLRGVDALADAVKVTLGPKGRNVVLEKKFGSPLITNDGVTIAKEIELEDAFENMGAKLVAEVASKTNDVAGDGTTTATVLAQAMIREGLKNVTAGANPVGVRKGIEQAVAVAVESLKEISKPIEGKESIAQVASISAADEEVGSLIAEAMERVGNDGVITIEESKGFTTELEVVEGMQFDRGYASPYMVTDSDKMEAVLENPYILVTDKKITNIQEILPVLEQVVQQGKPLLLIAEDVEGEALATLVVNKLRGTFNAVAVKAPGFGDRRKAMLEDISILTGAEVITEDLGLDLKSTQINQLGRASKVVVTKENTTIVEGAGDTEQIAARVNQIRAQVEETTSEFDKEKLQERLAKLAGGVAVIKVGAATETELKERKLRIEDALNSTRAAVEEGIVSGGGTALVNVYNKVAALEAEGDELTGINIVLRALEEPIRQIAHNAGLEGSVIVERLKNEEIGVGYNAATGEWVNMIDKGIVDPTKVTRSALQNAASVAAMFLTTEAVVADKPEENKGGAGMPDMGGMGGMGGMM

SEQ ID NO: 7954 - protein, 207 aa, Bridelia retusa
PSRFLFMKNKVRMICDCLAPPVKVIQDKRLAQPLSLCGSTLRSPHGCHSQYMTNMGTIASLVMSVTINEDDDEMDSDQERGIKLWGLVVCHHTSPRFVPFPLRYACEFLIQVFGVQVSKEVQLAAQAREKHILQTQTVLCDMLLRDAPVAIITKSPNVMDLVKCDGAALYYRKKFWLLGVTPTEAQIKDIADWLLEYHGESTGLKVH

SEQ ID NO: 7955 - protein, 171 aa, Glycine max
  misc_feature (149)..(149): Xaa can be any naturally occurring amino acid
  misc_feature (157)..(157): Xaa can be any naturally occurring amino acid
  misc_feature (162)..(162): Xaa can be any naturally occurring amino acid
LEKRNQNLTYILNTHHHYDHTGGNLELKAKYGAKVIGSEKDKDRIPGIDITLSEGDTWMFAGHQVLVMETPGHTSGHVSFYFPGSGAIFTGDTLFSLSCGKLFEGTPEQMHSSLQKIVALPDVTKVYCGHEYTLSNSRFALSIEPGNEXLQEYAASXADLRXKNTPTVPTT

SEQ ID NO: 7956 - protein, 240 aa, Medicago truncatula
MGRGRVQLKRIENKINRQVTFSKRRAGLLKKAHEISVLCDAEVALIVFSHKGKLFEYATDSCMEKILERYERYSYAERQLVANDSESQGNWTIEYTRLKAKIDLLQRNYRHYMGEDLGSMSLKELQSLEQQLDTALKLIATRRNQVMYESISELQKKEKVIQEQNNMLAKKIKEKEKIAAQQQAQWEHPNHHGVNPNYLLQQQLPTLNMGGNYREEAPEMGRNELDLTLEPLYTCHLGCF

SEQ ID NO: 7957 - protein, 224 aa, Cleistanthus perrieri
DIPQASRFLFMKNKIRMICDCLAPPVKVIQDKSLAQPLSLCGSTLRSPHGCHSQYMANMGSIASLVMSVTINEDDDEMDSDQERGIKLWGLVVCHHTSPRFVPFPLRYACEFLIQVFGVQVSKEVKLAAETREKHILQTQTVLCDMLLRDAPVAIITRSPNVMDLVKCDGAALYYRKKFWLLGVTPTEAQIKDIADWLLEYHGESTGLSTDSLLEAGYPGATVL

SEQ ID NO: 7958 - protein, 224 aa, Cleistanthus oblongifolius
DIPQASRFLFMKNKVRMICDCLAPPVKVIQDERLAEPLSLCGSTLRSPYGCHSQYMENMGVIASLVMSVTINENDDEMDSDQERGIKLWGLVVCHHTSPRFVPFPLRYACEFLIQVFGVQVSKEVQLAAQAREKHILQTQTVLCDMLLRDAPVAIITRSPSVMDLVKCDGAALYYRKKFWLLGVTPTEAQIKDIADWLLEYHGESTGLSTDSLMEAGYPGAAVL

SEQ ID NO: 7959 - protein, 204 aa, Drypetes madagascariensis
ADIPQASRFLFKQNRIRMICDCNADPVRLIQSEEIKQPLLLVNSTLRSPHGCHTQYMTNMGSIASLVMAVVINGNNSSKLWGLVVCHHTSPRYVPFPLRYACEFLMQAFGLQLYMELQLAEQLVEKKILRTQTLLCDMLLRDAPFSIVTQSPSIMDLVKCDGAALYYGGKCWLLGVTPTETQVKNIAEWLLTSHGHSTGLSTDS

SEQ ID NO: 7960 - protein, 165 aa, Solanum tuberosum
MAEPASPGGGGGSHESGGDPSPQSNLREQDRYLPIANIGRIMKKALPANGKIAKDSKDTVQECVSEFISFITSEASDKCQKEKRKTINGDDLLSALATLGFEDYIEPLKVYLTRYREMEGDAKGSARVGDASVRKDVVGSQLGSNTQFMYEGSFAQGLDYGNSQL

SEQ ID NO: 7961 - protein, 468 aa, Streptococcus pyogenes
MTKTLPKDFIFGGATAAYQAEGATHTDGKGPVAWDKYLEDNYWYTAEPASDFYNRYPVDLKLSEEFGVNGIRISIAWSRIFPTGKGEVNPKGVEYYHNLFAECHKRHVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDSGYSGEIGVVHALPTKYPFDANNPDDVRAAELEDIIHNKFILDATYLGKYSDKTMEGVNHILEVNGGELDLREEDFAALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDDGRIDYVKKHLEVISDAISDGVNVKGYFMWSLMDVFSWSNGYEKRYGLFYVDFETQERYPKKSAYWYKKVAETQVIE

SEQ ID NO: 7962 - protein, 487 aa, Brevibacterium linens
MSTSGEDLTLVWFRDDLRVADHEALTAARADGRVIAVWIRETRDEEGLGPRPLGGACRWWAHESLTVLHEELSDLGIPLLFAAGRAEKIIVQLASSLGVTAVRWTRRYASASRALDGQIKTVLNDQGFTVHSHTGALLVEPWTAAPQSSDHYKVFTPFWKAVAGRDVGDVLPKPQAQSPLSQTLLSRAHECPAVMELDGLGLLDGTETGAGEAAAASGPRWWQDTIAGHWSPGLRAAEDQLDDLSAIIDGYTTSKDVPSDAASTSRLSPRLRHGELSPRQLLQAARTTSSLTQDDRAAWIRQLYWREFSWHLTYHYPHIDSAPIRPEFHNFPYEDDDDALTHWRAGTTGYPLIDAGMAQLWQTGWMHNRVRMVTASFLTKNLLQHWWFGEQWFWDTLVDADEANNPVSWQWVAGSGADAAPYFRVFNPERQRERFDPDDAYIEDWLPYTPATAPPPLVDLRQSRQAALSAYDHMKNRSTTRDNPGES

SEQ ID NO: 7963 - protein, 741 aa, Pyrus communis
MEACNCIEPQWPADELLMKYQYISDFFIALAYFSIPLELIYFVKKSAVFPYRWVLVQFGAFIVLCGATHLINLWTFNMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPIHLPVVNQVFSSNCAVKISPNSPVARLRQLAGRHIPGEVVAVRVPLLHLSNFQINDWPELSTKRYALMVLMLPSDSARQWHVHELELVEVVADQVAVALSHAAILEESMRARDLLMEQNIALDLASREAETAIRARNDFLAVMNHEMRTPMHAIIALSSLLQETDLTPEQRLMVETILKSSNLLATLINDVLDLSRLEDGSLQLDIATFNLHSIFREVHNMIKPVASIKRLSVALNIAADLPVYAIGDEKRLMQIILNVVGNAVKFSKEGSISITAYVAKSESLRDFRAPDFFPVQSDNHFYLRVQVKDSGSGINPQDIPNLFTKFTQTQTLASQNSGGSGLGLAICKRFVNLMEGHIWIESEGLGKGCTATFIVKLGFPERSNESKQPFAPKLQANHVQTNFPGLKVLVMDDNGVSRSVTKGLLVHLGCDVTTVSSIDEFLHVISQEHKVVFMDVCMPGIDGYELAVRIHERFTKRHERPVLVALTGSIDKMTKENCMRVGMDGVILKPVSVDKMRSVLSELLEHRVLFEAM

SEQ ID NO: 7964 - protein, 541 aa, Thermobifida fusca
MAAKLIAFDEEARRGLERGMNQLADAVKVTLGPKGRNVVLEKKWGAPTITNDGVSIAKEIELEDPYEKIGAELVKEVAKKTDDVAGDGTTTATVLAQALVREGLRNVAAGANPIGLKRGIDAAVARISEELANLSKEVETKEQIASTASISAGDPQIGEYIAEAMDKVGKEGVITVEEGQTFGLELELAEGMRFDKGYISPYFATDLERMETVLEDPYILIANQKISNNNEFLPVIEKVLQAGRPLVVIAEDVEGTALQTLVVNKIRGTFKSVAIKAPGFGDRRKAMLQDIAILTGGQVITEEVGLKLENTELDMLGRARKVVVTKDETTIVDGAGDASAIAGRVNEIRAEIERTDSDYDREKLQERLARLAGGVAVIKAGAATEVELKERKHRIEDAVRNAKAAVEEGILPGGGVALLQASIAAFEKLELEGDEAIGASIVRRAVEEPLKQIAINAGYEGGVVVEKVKSLEPGIGLNAATGEYTDLFKDGVIDPTKVTRSALQNAASIAGLFLTTEAVIAEKPEKPAANNAGGDMGGMDF

SEQ ID NO: 7965 - protein, 344 aa, Schizosaccharomyces pombe
DLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 7966 - protein, 246 aa, Prochlorococcus marinus
MEFNKAQNIIGLRVLNDNVIWLWEKDKSVVVIDPAIHEPVIRYIDENNLYIKAILQTHHHSDHIGGTKYLIERWPNVQVIASSKDKKRIPFQNISVEDGETLNILGEEIKIIEVLGHTNSHIAFFVNGESPVLFIGDTLFSGGCGRIFEGTYQQMYSSLERIKSLPKNTLIYCAHEYTKANLLWALNLKPKDQDIKNKLLQVEKKLSINELTIPFLLDEEMKINLFLRAKNLKEFTFLRENKDLWV

SEQ ID NO: 7967 - protein, 486 aa, Solanum tuberosum
MGLVSENYNKKLLSKIATNDGHGENSAYFDGWKAYENDPFHPTQNPHGVIQMGLAENQLCFDLIQEWIVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESSNNFKVTKEALEEAYKKAQESNIKVKGLLINNPSNPLGTILDKETLKDILRFINDKNIHLVCDEIYAATAFSQPSFISISEVMSEVVGCNDDLVHIVYSLSKDLGFPGFRVGIIYSYNDVVVNIARKMSSFGLVSTQTQRLIASMLSDTIFVENFIAKSAMKLSQRHDLFTKGLGQVGITTLKSNAGLFIWMDLRRFLEKSTFDDELKLWHIIINKVKLNVSPGCSFHCSEPGWFRVCFANMDDATMQVALKRIRHFVYLQPSKGVEVATKKQYCRTRSKLEISLSFRRLDDFMNSPHSPMSSPMVQARN

SEQ ID NO: 7968 - protein, 226 aa, Crocus sativus
MGRGKIEIKRIENTTNRQVTFCKRRNGLLKKAYELSVLCDAEVALIVFSTRGRLYEYANNSVKGTIDRYKKACTDTSNSGTVSEANSQYYQQEASKLLQQIAQLQNSNRNLMGESLSTMSPRELRQLEGKLEKGINKIRAKKNELLYAEIEYMQKREMELQNDNMYLRNKISENERAQQHMNMLPSATATEYEAMPPFDSRSFLQANLVDPNHHYSHQQQTALQLG

SEQ ID NO: 7969 - protein, 371 aa, Glycine max
MASPLLTPYKMGKFNLSHRVVLAPLTRQRSYDNVPQPHAILYYSQRTSNGGLLITEATGVSDTAQGYPQTPGIWTKDHVQAWKPIVDAVHAKGGVFFCQIWHVGRVSDSVYQPNGQAPISSTDKPLTPQIRSNGIDQVQFTPPRRLRTDEIPHIVNDFRLAARNAIEAGFDGVEIHGAHGYLLEQFMKDKVNDRTDEYGGSLENRCRFALEVVEAVVNEIGADRVGIRLSPFAEYSESGDSNPKELGLYMMNALNKYGILYCHMVEPRMKTVGEKTECPHSLVPMRKAFNGTFIAAGGYDRQDGINAVAENRADLVAYGRWFLANPDLPKRFALNAPLNKYHRETFYTSDPVLGYTDYPFLDDEESNAVAS

SEQ ID NO: 7970 - protein, 622 aa, Debaryomyces hansenii
MSEQQGSDNRHHHHHHHHNNHHGDHSGQHDGHNNKVHQPQPIDPKANPANRIGKYQVLKTLGEGSFGKVKLAQHTTTGQKVALKIINRKTLAKSDMQGRVEREISYLRLLRHPHIIKLYDVIKSKDEIIMVIEYAGKELFDYIVQRGKMPEDEARRFFQQIIAAVEYCHRHKIVHRDLKPENLLLDEQLNVKIADFGLSNIMTDGNFLKTSCGSPNYAAPEVISGKLYAGPEVDVWSSGVILYVMLCGRLPFDDEFIPALFKKISNGVYTLPNYLSQGAKDILTRMLVVNPLNRITIHEIIEDEWFKQNIEEYLLPPDLSKTKHKKIEVDEDVITALQSTMGYDRDEIVNVINKCNQHNAPQQQSNEIIDAYLLMRENRTLVKDLKNSKLNNMDTFLSQSPPPSWTNNANNNSNMNINVNHSTKAPGVQQSLTYQTLAAVPDLSTLPNSTIAILPSSLPSIHRAYMMESNMDTQLKIAPVSHKKLKTRWHFGIRSRSYPLDVMGEIYRALKNLGAEWSKPTEEELWTIRVRWKYGPCILPNEKSQEEQQKDIPDMMKMQIQLFQLEPNNYLVDFKFDGWENSSNKDVSIKQDVDEMSSFSAYPFLHLATRLIMELAVNSQTN

SEQ ID NO: 7971 - protein, 228 aa, Crocus sativus
MGRGKIEIKRIENTTNRQVTFCKRRNGLLKKAYELSVLCDAEVALIVFSTRGRLYEYANNSVKGTIDRYKKACTDTSNSGTVSEANSQYYQQEASKLLQQIAQLQNSNRNLMGESLSTMSPRELRQLEGKLEKGINKIRAKKNELLYAEIEYMQKREMELQNDNMYLRNKISENERAQQHMNMLPSATATEYEAMPPFDSRSFLQANLVDPNHHYSHQQQTALQLGFV

SEQ ID NO: 7972 - protein, 547 aa, Nitrosomonas europaea
MAAKEVRFGDSARQAVISGVNVLADAVKVTLGPKGRNVVLERSYGAPTITKDGVSVAKEIELKDKFENMGAQMVKEVASKTSDTAGDGTTTATVLAQSIVKEGMRYVAAGMNPMDLKRGIEKAVTGAVEELKKLSKPCSTSKEIAQVGSISANSDTEIGRIIAEAMDKVGKEGVITVEDGSGLENELDVVEGMQFDRGYLSPYFVSSADKQIAALESPFVLLHDKKISNIRDLLPVLEQVAKAGKPLLIIAEDVDGEALATLVVNNIRGILKTCAVKAPGFGDRRKAMLEDIAILTGGTVIAEEVGLSLEKTRLEDLGQAKRIEVGKENTTIIDGAGDVKTIEARVAQIRKQIEEASSDYDREKLQERVAKLAGGVALIKVGAATEVEMKEKKARVEDALHATRAAVEEGIVPGGGVALLRTINAVSKIKGDNHDQDSGIKIVLRAMEEPLRQIVTNCGDEASVVVNKVKEGQGTFGYNAATGEYGDLVAMGVLDPTKVTRSALQNAASVAGLILTTDAMVAELPKEDSPGAGAGMGGMGGMGGMDM

SEQ ID NO: 7973 - protein, 700 aa, Oryza sativa
MSVSSSSMGGGGGGDAGGRTVVWFRRDLRVEDNPALAAAARAGGEVVPAYVWAPEEDGPYYPGRVSRWWLSQSLKHLDASLRRLGAGKLVTRRSADAVVALLQLVRDTGATRLFFNHLYDPISLVRDHRLKEMMAAEGIIVQSFNADLLYEPWEVVDDEGQSFTMFAPFWNRCLSMPYDPAAPLLPPKRINSGDLSMCPSDDLIFEDDSERGSNALLARAWSPGWQNADKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDAANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPATEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 7974 - protein, 142 aa, Triticum aestivum
  misc_feature (94)..(94): Xaa can be any naturally occurring amino acid
  misc_feature (98)..(98): Xaa can be any naturally occurring amino acid
VACFLTRGDLYHRIYSPISFGKKYDPNGDYIRHFIPVLKDMPKEYIYEPWTAPLSVQEKARCIVGKDYPKPVVDHEAASKECRRRMGEAYASNXLGGXPVKGNSSNSSRRKFSDGWARNPCPLIHVKQTVKADPRARTVLRN

SEQ ID NO: 7975 - protein, 470 aa, Escherichia coli
  misc_feature (333)..(334): Xaa can be any naturally occurring amino acid
MKAFPETFLWGGATAANQVEGAWQEDGKGISTSDLQPHGVMGKMEPRILGKENIKDVAIDFYHRYPEDIALFAEMGFTCLRISIAWARIFPQGDEVEPNEAGLAFYDRLFDEMAQAGIKPLVTLSHYEMPYGLVKNYGGWANRAVIDHFEHYARTVFTRYQHKVALWLTFNEINMSLHAPFTGVGLAEESGEAEVYQAIHHQLVASARAVKACHSLLPEAKIGNMLLGGLVYPLTCQPQDMLQAMEENRRWMFFGDVQARGQYPGYMQRFFRDHNITIEMTESDAEDLKHTVDFISFSYYMTGCVSHDESINKNAQGNILNMIPNPHLKSSEXXWQIDPVGLRVLLNTLWDRYQKPLFIVENGLGAKDSVEADGSIQDDYRIAYLNDHLVQVNEAIADGVDIMGYTSWGPIDLVSASHSQMSKRYGFIYVDRDDNGEGSLTRTRKKSFGWYAEVIKTRGLSLKKITIKAP

SEQ ID NO: 7976 - protein, 203 aa, Drypetes madagascariensis
QISPQARFLFKQNRVRMICDCHAIPVRVIQSEELRQPLCLVNSTLRSPHDCHTQYMANMGSIASLAMAVVINGNDSTKLWGLVVCHHTSPRYVPFPLRYACEFLMQAFGLQLYMELQLAAQLVEKNILRTQTLLCDMLLRDAPFGIVTQSPSAMDLVKCDGAALYYGGKCWLLGVTPTESQVKDIAEWLLNDHEDSTGLSTDS

SEQ ID NO: 7977 - protein, 734 aa, Bdellovibrio bacteriovorus
MAFKMNRTLTLLLFSTGVAATLTVFILKFLALKEYRETIALYEKTEALISMIQNVEKSTLDLETGQRGYVLTQNEQFLKPYLDANDAIEKEFELLEKSAPATLKASPEYQSMSALVRQKMEISENVINQVRVGKLSSAIALVKSGQGKGVMDQLREAVNTVITNERARVLALKKESEITAQRNQLWQVLGTAMAFLLIIVAYVMTEFEGRQRRQLEKQLVEARNEALQASHMKSSFLANMSHEIRTPMNGILGMTEVLLDQNPESGIKKKIQIIRESALNLLSLINGILDLSKIESGKLELEESYFEPRKLVQEVINTVEYSAKSKGLDLHASVSEQTPAAFSGDVLRLRQILINLLGNAIKFSSEGTVSLIVNSFRSDQSRTMLQIQVKDQGLGMDEATLKKIFSPFEQADKSTTRKFGGTGLGLSITKQLVELMNGKIEVESKPNEGSIFWVTLPLEAINVMPENQRPRESQSYSSSQAPLKILVAEDNMTNQEVVRVMLNRLGHKFDIVNNGKEALEKTLSGTYDIILMDCHMPVMDGYVAAQKITERFPQWCQGPAVIAVTANAIRGDKEACLAAGMCDYLSKPLTLAELDEKLALWSRHLKYAATQVVDPKAMENLRQISPDMADDLMKQILQAWGKEAPAYVVEMIEAEKRGDLKDLADRAHYLKSSCVNAGLRVMGQLCSDIEKQARAGTKEELRYLLLQLRSEYKMACTHLWRSEMLEVPQQGIST

SEQ ID NO: 7978 - protein, 639 aa, Cryptococcus neoformans
MASPATQTANAIAAINNRSNLVIPEIDFTQHQLENGEIVSTTERVIKDVQAPAMYVPTDDQFWSKVDKTKPDIAFLKNHFYREGRLTEEQALYILEKGGELLRSEPNLLEVDAPITVCGDIHGQYYDLMKLFEVGGNPADTRYLFLGDYVDRGYFSIECVLYLWSLKMWYPDTLFLLRGNHECRHLTDYFTFKLECKHKYSETVYNACMESFCNLPLAAVMNKQFLCIHGGLSPELHTLDDLRSINRFREPPTQGLMCDILWADPLEDFGSEKTNENFLHNHVRGCSYFFTYNAACQFLERNNLLSIIRAHEAQDAGYRMYRKTKTTGFPSVMTIFSAPNYLDVYSNKAAVLKYESNVMNIRQFNCTPHPYWLPNFMDVFTWSLPFVGEKITDMLIAILNCCTKEELEEEDEEFPLNAPEPTDAESAAERRQIIKNKILAVGRMSRVFSLLREESERVSELKSISGSNALPAGMLASGAEGIKEAIQGFEDARKSDIENERLPPDIIDPDEDKPASPSASPIMPATPEEIPSEIPYDSPITGTPRTPISSAIASGSPGSPGTPTSPSIGGPPLTAWRPGHGRRTSLGTTKTSPSTRRRSLENTMHLIRDVVGGKDAQGDGQLERLAEVISSPTKGGQGE

SEQ ID NO: 7979 - protein, 473 aa, Salmonella enterica
MPTHLVWFRRDLRLQDNLALAAACRDASARVLALYISTPAQWQAHDMAPRQAAFISAQLNALQTALAEKGIPLLFHEVADFNASIETVKNVCRQHDVSHLFYNYQYEFNERQRDAAVEKTLPSVICEGFDDSVILAPGAVMTGNHEMYKVFTPFKNAWLKRLKEDIPPCVPAPKIRVSGALSIPLTPVSLNYPQQAFDAALFPVEENAVIAQLRHFCSQGADEYASRRDFPAVDGTSRLSASLATGGLSPRQCLHRLLAEQPQALDGGPGSVWLNELIWREFYRHLMTWYPALCKHQPFIRWTKRVAWQENPHYFQAWQKGETGYPIVDAAMRQLNATGWMHNRLRMITASFLVKDLLIDWRLGERYFMSQLIDGDLAANNGGWQWAASTGTDAAPYFRIFNPTTQRERFDRDGEFIRQWLPALRDIPGKAIHEPWRWAEKAGVVLDYPRPIVEHKQARIATLSAYEAARKGA

SEQ ID NO: 7980 - protein, 158 aa, Zea mays
  misc_feature (67)..(67): Xaa can be any naturally occurring amino acid
MADDGGSHEGSGGGGGVREQDRFLPIANISRIMKKAVPANGKIAKDAKETLQECVSEFISFVTSERXKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 7981 - protein, 225 aa, Flueggea suffruticosa
DIPQASRFLFMKNKVRMIFDCQAPPVKVVQDKRLAQPLSLCGSTLRSPHGCHAQYMANMGTIASLVMSVTINEDDDDETDIDQQVGRKLWGLLVCHHTSPRFVPFPLRYACEFLMQVFGVQVNREVELAAQTREKHILQIQTVLCDMLLRDAPVAIVIQSPNVMDLVECDGAALYYRKKLWLLGVTPTEAQIKDITEWLMEYHGESTGLSTDSLMEAGYPGAAVL

SEQ ID NO: 7982 - protein, 312 aa, Prochlorococcus marinus
MNSVIFQETAKLKKPVPAEKVIELSEKLVEPSRHSKKYPPRLHKTWGTIVFMVAIHILSLIALQPKFWSLPAVTSLLFFYWVTACLGVTLGYHRLLSHRSFIVPRWLERFFATCGAISCQHGPIDWVGLHRHHHSFSDTEVDHHNSKKGFWWSHMGWMFKDVEALKAVPKLSADLIKDPYYRFLNKYFLFLQIPIGLSLFAIGQKLGVGGWALVLWGIPLRLVVVYHITWLVNSATHCWGKAPFESGDSSKNNAWVAALTFGEGWHNNHHAFPNSAKQGLFRGQIDITWEHIKILAKFGLAKKVKLPSRSYY

SEQ ID NO: 7983 - protein, 211 aa, Glochidion eucleoides
  misc_feature (1)..(2): Xaa can be any naturally occurring amino acid
  misc_feature (5)..(5): Xaa can be any naturally occurring amino acid
XXLEXLRSLFMKNKVRMICDCQAPPVKVVQDKQLAQPLSLGGSTMRSPHGCHAQYMANMGTIASLVMSVTINEEDEETVNDQQMGRKLWGLVVCHHTTPRFVPFPLRYACEFLMQVFGVQVNREVELAAQTPEKHILQTQTVLCDMLLRDAPVAIVTQSPNVMDLVKCDGAALYYRKKFWMLGVTPTETQIKDITEWLLENHGESTGLEVK

SEQ ID NO: 7984 - protein, 220 aa, Glochidion puberum
TIRSLFMKNKVRMICDCQAPPVKVVQDKRLAQPLSLGGSTMRSPHGCHAQYMANMGTIASLVMSVTINEEDEETVNDQQMGRKLWGLVVCHHTTPRFVPFPLRYACEFLMQVFGVQVNREVELAAQTTEKHILQTQTVLCDMLLRDAPVAIVTQSPNVMDLVKCDGAALYYRKKFWMLGVTPTETQIKDITEWLLENHGESTGLSTDSLMEAGYPGAAIL

SEQ ID NO: 7985 - protein, 679 aa, Pseudomonas syringae
MTAAHYPHLLAPLDLGFTTLRNRTLMGSMHTGLEERPGGFERMAAYFAERARGGVGLMVTGGIAPNEEGGVYDGAAKLTNAEEAEQHRIVTRAVHEAGGKICLQILHAGRYAYSRKQVAPSAIQAPINPFTPRELDEEGIEKQIADFVTCSTLARSAGYDGVEIMGSEGYFINQFLAAHTNHRTDRWGGSYENRMRLAVEIVTRVREAVGADFIIIFRLSMLDLVEGGSTWEEIVQLAKAVEQAGATLINTGIGWHEARIPTIATKVPRAAFSKVTAKLRGSVKVPLITTNRINTPEVAERILSEGDADMVSMARPFLADPDFVNKAAAGHAERINICIGCNQACLDHTFGGKLTSCLVNPRACHETELNYLPTRQVKKIAVVGAGPAGLAAATVAAQRGHEVTLFDSASEIGGQFNIAKRVPGKEEFSETLRYFRNKVEETGVQLRLGTRIKAEDLLGAGFDEVILATGIAPRTPAIPGIDNQKVLSYLDVILQRKPVGRSVAVIGAGGIGFDVSEFLVHQGVATSLDREAFWKEWGIDTTLEARGGVAGIKPDVHAPARQVYLLQRKSSKVGDGLGKTTGWIHRTGLKNKQVQMLNSVQYLKIDDAGLHIRIGEDGEEKLLAVDNIVICAGQDPLRELYDDLVSAGQSVHLIGGADVAAELDAKRAIDQGSRLAAAL

SEQ ID NO: 7986 - protein, 206 aa, Gonatogyne brasiliensis
DIPQASRFLFMKNKVRMICDCLAPPVKVIQDKGLAQPLSLSGSTLRSPHGCHAQYMANMGSIASLVMSVTINEDDDEMDSDQERGIKLWGLVVCHHTSPRFVPFPLRYACEFLIQVFGVQVSKEVQLAAQTREKHILQTQTVLCDMLLRDAPVAIITRSPNVMDLVKCDGAALYYRKKFWLLGVTPTEAQIKDIAEWLIEYHGGST

SEQ ID NO: 7987 - protein, 75 aa, Populus tomentosa
MAYQNEPQESSPLRKLGRGKVEIKRIENTTNRQVTFCKRRNGLLKKAYELSVLCDAEVALIVFSSRGRLYEYSNN

SEQ ID NO: 7988 - protein, 756 aa, Geobacter metallireducens
MTIRMNGPLLLATLLLAAPAFALTMLPPPDMDHTPLHAAAKECDLATARTWAANPAYRDRKDRNDSTPLSLAAENGCLEVVRLLVESGAKVDAKGAFEQTPLLHAAEQGHAKVVAYLLGKGADVNAWTKKGDTPLILAMRGAFFHRGPEGDPRETLEALLKHGAEVNAAGEYGRTALIWAVRHADARLVWPLLRKGADPSAKDKDGDTAITLAQELKLDYLSQLLKDPKRPDLAILGPNTPLSDAVKRGNAADVVAVLDKGADVNGRFGNGSTALMQAASMGRADMVELLLKRGAQIDAKNGTDFTPLMFAASTGHDEVVKTLLAKGADVNASSLGRPALVFAAMNKHLESVRLLLERGADPDIIIGGTPLLTMAIKDGPAEIAGLLIARGAPVNVVDEGGKTPLMHACEKGDMATVKALLARGGDVNILGKDSEGALTIAIAGGHDGIVRLLLERGATVRTDDLQAAIKARNVSLASRLIDKGADVKDALLTALPKADLEMVKLLVKKGADPNARDYYQKTPLILEAGNWSDANPEVVRHLLEHGADINAQDDKGMSALLMAAGQGNAAVAQVLLAKGADITLTNRDGKTAWLLAAERGDRKMLELLEKAGAGRDYAGMSWTGYDAAMKEPFITVVDDRTQWEDLWKRAFDKPAPIVDFDNFAVACVFLGAEAEWLYSIHFDEPSVKDGVMQITYRLFMNRIAMEAERGFGRPSFGGQYRMEVYAKQKGVTMRIVKGKGEGDYEPLPLTPPPWRE

SEQ ID NO: 7989 - protein, 541 aa, Bradyrhizobium japonicum
MAHKQVLFHSAAREKILRGASLLADAVRVTLGPKSKSVLIQKGWGAPIVCNDGVTIAKEFDLKDAEENLGAQVLRQLAEKTGDVVGDGTSTSTILAHAILSDGVRNVVAGASAIDLKRGLDRGTQAAIAALRAMATPVKSRAEKVQVATISAHNDASIGELVADAIEKVGGDGVISVEESKTTETLLDVVEGMKFDRGFLSPYFITDADRMESVLQDPYVLLCDHKIGALRDLVPLLEQVAKSGQPLLIIAEDIEGEALATLIVNQLRGVLKACAVKAPGFGDRRKAMLEDIAILTGAQVISEEIGLNLENATLQQLGRAARVVADKENTTLIGSGGDRTRIDARLGQIRVEIEKTTSDYDREKLEERLAKLSGGVAVIRVGAPTEAEMKAKKEALDDAISSTKAAVAEGIVPGGGLALLRAVAAVAKEEAACEGDERTGVQILRRALEAPARQIAENSAADGGVVVARMLEGEGSIGFDASRKVYVDLVAAGIVDPVKVVRTALENAVSVASVLLLTEATMTEIPEPKRERLPEPDLAVQ

SEQ ID NO: 7990 - protein, 1410 aa, Thiomicrospira crunogena
MLKHSLSALLLLSALLPFSAQALTLNSSEQQWIKDHPQITLGSDYNWPPYDFKDSAGKHNGISADILDRIRQITGLKIKVRSGVWSTILEQAEQGTLDGLACAVKTPDRAEHLYFTAPYTSMPLGIFMQDKSTSTSIKTMDDLTTQTVTINRDSYMHEWLKQNYPHLKLYLVNSNAEALEAVSFGKANVYIGNMAVATYLIKKNYLTNIQAVAKINHFKTDTAIAIHKDKPILFGIIKKALKEISQKERNTILEKWFIKSKTTYIDLSNQEIAWIKAHPVIKVAGEPDWAPFDFVADNTYQGIANDYLNLIAQKTGLNFHIDIHSWEQNLTLLKKQQVDVLPAAYFSAERTSYAKFTTPYYKPLTYFFVRHDLKASSLNDLENTTIAMPKGYLHIDFLKQRFPNITILETDTLNEAINAVIQNKAQVLYENYAVLSYILSQSGINTIKPLAPAKQANQSLHFMIRDSAPELASIMNKALASITPQERKDIEERWLTIAPNKINITLTPAEQNWLNQHAQVSFTGYPDHLPYEGFKSNANQPIQHQGIVSDFIHSLESHLPLQFIPRAYKSWPDTLKAIHQTPVDIISAEIDTPELLAQYRPIIPYLTTPMVIVMKNQDTFVNTLRQLTTETIALVSNDATSEKLLKQYPNQHFKTWPNAKSVLEAVAFNKADAAILSLAKASYLIKQNHYTSLKIVGKTDVQKQFTLFVNKRYPELFSILQKSMPAITEEHGSGILSQWTKIKFASKFDYALFFQMFSFLLVVIGIIFFWNRRLTKEVKQRLQAEKRLKENETQLQGLIDSIPLMIMVTNHQGKILSANRQTLKNYQLNFQELSELNSTTFYSDPDDRQQILNALQAGEQIHQKIISMKDADGIPRKMMLSVLPIHFNQQPANLSIAIDLTERIQFEKELQQAKEQAESASQTKSQFLANMSHEIRTPMNAIIGFTELLNEQVTEPRLKRYIRTIQAAGKTLLTLINDILDLSKIEAGKMDLDKKAVNPHSLFDEIGQIFMINIQRKGLDFLVDIDKTLPEGLLLDGVRLRQILFNLLGNAVKFTEQGYVKLKVSACDVDEHHSKLDILIQVSDTGIGIPEDQQARIFNAFEQRENQDVQKFGGTGLGLAITQRLVNMMGGDIWVESTPGQGTTFNLLIHHVDISATNQSDQPNSDERPVPQLIEFHPTTILVVDDIDDNRALIKQNFVDTDVTVYEAQNGEEAINCFHSEKGISLILMDLRMPIMNGYQAAEIIKQKSPSTPIVALTASVMTETADAPKRQHFDDYLRKPVFKADLFNILKKYLPHEILTPTPEFSETQEVLSDKAKLNAPQFLEAIQEQLSPTQKTILKTNNIEEIQRFAQTCEALADQYDSKTLKTYATQLLEATESFDIKAMQQLLKYYETLEARLDKLLNDAISP

SEQ ID NO: 7991 - protein, 300 aa, Rubrobacter xylanophilus
MQNFSRLLSPIEVGPAILRNRVLVSAHQPGLAENGVPGDRYIAYQRTLASGGPGLQITGATAVHPTGVYHGAHFLLNFDDRIIPGYQRMADAVHSEGGKILAQLGHAGALAMSSLTERPLWAPSPVAGELVRETPHAMSHEEIAEVVAAFGEAARRVREGGLDGIEITASHGALIAAFLSPYSNQRGDEYGGNLDGRIRFLLEVLDAVSEQAGPDLIVGVRIAGDEGVKGGIDLSQAQEIARRLEATGKVHYISVIAGTNLDRFQRVAHWPATPAPHGLFVHLARGSRKWWRSPCSPLDA

SEQ ID NO: 7992 - protein, 577 aa, Gloeobacter violaceus
MSSVCNGEIMTTTKDPSESKVQPQSEAKADAKTGMIRFQLLAPYNEKAALVGSFSNWEEIPMEKDDKGCFFVEIDLPDGEHQYKFKLVSKSFFCEGETVAIADPYARQVDEKNRENTVIRIKDGKQITDEYVWEHDDVPLSPDDHLIIYELHVSAFGGDTFIDAIQQLDYLVDLGVNCVQLMPVTEYPGEHYWGYNPRHPFAPESSYGKPEDLKAFVDACHERGFRVILDIVLNHSESESPLTRIDFTYWFYAPGTEPDEPGNVWGPKFNLEFYDEHYKRNPAREYLYDLVDYWVREYHIDGYRIDAAAQIKYFDFLGEVARRSKANSGGKPFYLVGEHIPENPAITGADGPMDGAYHETYYWMIDDLMVRNMFDTDQIVDSINPLHHGYPGPSNAVNFYENHDKPRLLQRLRDAGINEEGSFKRLECAAALLMTSVGLPMLYQGQAMGQAYPQDEEVHAVEWTLLDHDRHVALLERYKGLIDLRRETQALWTNEIDFFHIDQEARVIAYVRFNAEGSRVAVVAHLGDGNLGDYQVPCFPEDGHWFEKTRLYEVDVEGGILNVHLSDWDVHVFRNGG

SEQ ID NO: 7993 - protein, 664 aa, Rubrobacter xylanophilus
MAHVNTDARNSLRLLFSPLKIGRREVKNRIVSTAHATGFDNEGILNERHLRYHERKAAGGAGLIMTFGSASVYRESSASYGSVSLWNPENEPFLRDLAERVHAHGALIMSQATHMGRRGDSALSGYPLQAPSAVPEGVHREIPHVLRTEEIPPIVEAFAEAAARLERCGWDGIEITSLGGHLIEQFWSPVINKRTDRYGGDLAGRMRFSVEVIEAVAEAVSDDFIVGFRMTGDPKTDVIGLTPEDMLEIATRLDDLGRIDLFNISGGTGATYEAQAATVPGDTYARGCYCPLARRMKEHLSVPVLAAGRILDPEQAEEAIAAGDCDLVAMTRAIIADPDLPNKARGGESFRIRPCIACNEGCIGRLYSGMPIVCTVNAAIADDSLDDFARSERRRRVVVIGGGAAGMEAARVSAERGHEVILLERAERLGGQVATAVVAPERPHYGRHLKWLERELARLGVDVRLKTEATAEGVLELDPGVVVVAAGSKAVVPPEVAGIDARCATDIDVLDGNIEVEPGARVLVYDREGKFRGGSIANFVAEAGVSRVELATPLFAACGDLDETQQPAMYRRLAKNSVVLSPNQELMGKRNRRLLLRDAWSGRERTVEDVDLVVFVGYQEAESGLFEALRDSAPELELRLVGDAVAPRRLHDAVLEGVRAGNAV

SEQ ID NO: 7994 - protein, 75 aa, Populus tomentosa
MEYQNESLESSPLRKLGRGKVEIKRIENTTNRQVTFCKRRSGLLKKAYELSVLCDAEVALIVFSTRGRLYEYSNN

SEQ ID NO: 7995 - protein, 442 aa, Unknown
  Bradyrhizobium sp. BTAi1
MFCSSCGLHGERTRRSGRVSKVIFSAGVSQIKILLHFQKPSERERMVCLLLEGLVKLLEPVRIGRHLLKNRIVMAPLARARGDERRAPKDIVGTYYSQRATAGLIVTEACHVSPTSATRARATANHDAHQTLAWKQVVDAVHAAGGVIFQQIYHVGRKSLLSGMPNGQVPVAPSAIAAYGGIMKEDGLEEFPVPRALALHEIAPIVEDHRQAVRRAGEAGFDGVEILAGNGFLIDQFLRDSTNKRTDSYGGSKENRARFLFEVVDAAIAELGADRVGVRLSPHFRADHIDDSDPVGTFSYVVSELDRRGIAFIHLLEGTSYDNSGDIPLYQRLVKKPSAGGGGAGPRSGEPFLAPILRPLFRGALILNSGYTRDSAEQAVRSSAADAISFGRLYISNPDLPERFRLNAPLTEPDTATYYTNGPEGYIDYPSLGDRVARVPAA

SEQ ID NO: 7996 - protein, 594 aa, Salmonella enterica
MSSKIFCKSWGAEYIAADVVRFRLWATGQQKVMLRLAGKDQEMQASGDGWFTLDVSGVTPGTEYNFVLSDGMVLPDPASRAQKTDVNGPSYVIDPGSYAWRNTGWKGSRWEQAVVYEMHTGTFTPEGTFHTAIAKLPYLAELGVTVIEVMPVAQFGGERGWGYDGVLLYAPHSAYGTPDDFKAFIDTAHGYGLSVILDIVLNHFGPEGNYLPLLAPAFFHKERMTPWGNGIAYDVDAVRRYIIEAPLYWLTEYHLDGLRFDAIDQIEDSSARHVLVEIAQRIREDITDRPIHLTTEDSRNIISLHPRDQDGNAPLFTAEWNDDFHNAVHVFATGETQAYYNDFADAPEKHLARALAEGFAYQGEISPQTGEPRGVKSTGQPPVAFVDFIQNHDQVGNRAQGDRLITLAGAERTKVLLATLLLSPHIPLLFMGEEYGESRPFLFFTDFHGDLARAVREGRAKEFADHAGENVPDPNAPETFQRSKLNWKQQHSEEGKAWLAFTRELLLLRQKHIVPLLSAARESSGTVLQTAPGFIAVSWRFPGGTLSLALNISATTVLLPDLPGKTLFAWPNESTGSLSQHSLIVRLAQGESAS

SEQ ID NO: 7997 - protein, 317 aa, Triticum aestivum
  misc_feature (257)..(257): Xaa can be any naturally occurring amino acid
  misc_feature (269)..(269): Xaa can be any naturally occurring amino acid
  misc_feature (281)..(281): Xaa can be any naturally occurring amino acid
  misc_feature (283)..(283): Xaa can be any naturally occurring amino acid
  misc_feature (287)..(287): Xaa can be any naturally occurring amino acid
  misc_feature (291)..(291): Xaa can be any naturally occurring amino acid
  misc_feature (297)..(297): Xaa can be any naturally occurring amino acid
  misc_feature (307)..(307): Xaa can be any naturally occurring amino acid
MALSRAQTNSGESLISSTFASRYVRTALPRFRIPEQSIPKDAAYQIINDELMLDGNPRLNLASFVTTWMEPECDKLIQNSVNKNYVDMDEYPVTTEFQNRCVNMIAHLFNAPIGEDETAVGVGTVGSSEAIMLAGLAFKRKWQNKMKAEGKPHDKPNIVTGANVQVCWEKFARYFEVELKEVKLREGYYVMDPAKAVELVDENTICVAAILGSTLNGEFEDVKMLNDLLVAKNAKTGWDTPIHVDAANGGFIAPFIXPELEWDFRLPLXKNIKRQAGQQYXLXYAGXSGWXYWREQXRTCPNKLIFXNKLTSGAEQT

SEQ ID NO: 7998 - protein, 896 aa, Desulfitobacterium hafniense
MDSRLHLVDNLPALLWSSDRAGNYDYVNQAWLEFTGLTFVEVRGEGWLSCVHPEDSPGVMNVLEHSRRHKAPFEAEYRLRRYDGEYRHCLSRGQPYDDPKGELAGYTGVIIDITERKAAEIMTRENAEKFREIFNRITDCVFIHEVKDDGQIGKIQEVNDMACELIGLTRAEIIDLSREVIKVKSPLTLANEFTQKLLSKNYLVFEGMLLTHQGKEIPVEVKAHYHVLNGRRMLLSIARDISNQKRIHKILLASHNKYRQLFDNITDAVFVYELQKDGYPGLLIEINEKARRLMGYHEETFMFSAGPCIRPSSPQLTLDDVWQSLERTHSASFEGICTNLEGEDIPVEVNCHTFPLNGSKVMLTLLRDITERKQIEQERKRTEAEFQQAKEKAEAANRAKSEFLANMSHEIRTPINGIIGMIDLTLLTSLEKTQRENLKIAKNCAYSLFKIINDILDFSKIEAGKLTVEEIEFNLKEVIEQIIKTHSPEAERKGLDLAYTLSANLPDYYKGDPERIKQVLNNLLSNALKFTERGEVSLAVKRLQGDEDVSDLKFTVMDTGIGIAEEDQLHLFEEFNQVDGSITRKYGGTGLGLAISRKLVEMMGGRIWVESEKGKGSSFGVVLRLKHGDKDTLRFKSTQNNDQSREGSTARSYRILLAEDHIVNSIVITEMLKIQGHRVDIAMDGEEALALYHQNPYDVILMDIQLPRLDGIEVTKRIRASEGAQSRTPIIALTAYALQGDREGFLQAGMDEYIPKPVMMEELIMVLDRVVTKFASGEGQAQQEEVVITDEGVYLKDISSFPESVNKDLELSEMAYDFKKLRIALNNGDSVALEHIAHRIKERCSVIGAHKLKALAFKIELAARRGNPGEAKDYLHDLDSEYNQLSGGMLNENTRS

SEQ ID NO: 7999 - protein, 922 aa, Pisum sativum
MVYTISGIRFPVLPSLHKSTLRCDRRASSHSFFLKNNSSSFSRTSLYAKFSRDSETKSSTIAESDKVLIPEDQDNSVSLADQLENPDITSEDAQNLEDLTMKDGNKYNIDESTSSYREVGDEKGSVTSSSLVDVNTDTQAKKTSVHSDKKVKVDKPKIIPPPGTGQKIYEIDPLLQAHRQHLDFRYGQYKRIREEIDKYEGGLDAFSRGYEKFGFTRSATGITYREWAPGAKSAALVGDFNNWNPNADVMTKDAFGVWEIFLPNNADGSPPIPHGSRVKIHMDTPSGIKDSIPAWIKFSVQAPGEIPYNGIYYDPPEEEKYVFKHPQPKRPQSIRIYESHIGMSSPEPKINTYANFRDDVLPRIKKLGYNAVQIMAIQEHSYYASFGYHVTNFFAPSSRFGTPEDLKSLIDRAHELGLLVLMDIVHSHSSNNTLDGLNMFDGTDGHYFHPGSRGYHWMWDSRLFNYGSWEVLRYLLSNARWWLDEYKFDGFRFDGVTSMMYTHHGLQVSFTGNYSEYFGLATDVEAVVYMMLVNDLIHGLFPEAVSIGEDVSGMPTFCLPTQDGGIGFNYRLHMAVADKWIELLKKQDEDWRMGDIVHTLTNRRWLEKCVVYAESHDQALVGDKTLAFWLMDKDMYDFMALDRPSTPLIDRGIALHKMIRLITMGLGGEGYLNFMGNEFGHPEWIDFPRGEQHLPNGKIVPGNNNSYDKCRRRFDLGDADYLRYHGMQEFDRAMQHLEERYGFMTSEHQYISRKNEGDRVIIFERDNLVFVFNFHWTNSYSDYKVGCLKPGKYKIVLDSDDTLFGGFNRLNHTAEYFTSEGWYDDRPRSFLVYAPSRTAVVYALADGVESEPIELSDGVESEPIELSVGVESEPIELSVEEAESEPIERSVEEVESETTQQSVEVESETTQQSVEVESETTQ

SEQ ID NO: 8000 - protein, 826 aa, Pisum sativum
ATTTTTTHNSKNKQYLAKQKPVELTLGYQNPNGCKVCSFGSKGSIYQKVSSGFKGVSVMTDDKSTMPSVEEDFENIGILNVDSSLEPFKDHFKYRLKRYLHQKKLIEEYEGGLQEFAKGYLKFGFNREEDGISYREWAPAAQEAQIIGDFNGWNGSNLHMEKDQFGVWSIQIPDADGNPAIPHNSRVKFRFKHSDGVWVDRIPAWIKYATVDPTRFAAPYDGVYWDPPLSERYQFKHPRPPKPKAPRIYEAHVGMSSSEPRINSYREFADDVLPRIRENNYNTVQLMAVMEHSYYASFWYHVTKPFFAVSSRSGSPEDLKYLIDKAHSLGLNVLMDVIHSHASNNVTDGLNGFDVGQSSQQSYFHAGDRGYHKLWDSRLFNYANWKSSFLLSNLRWWLEEYKFDGFRFDGVTSMLYHHHGINMAFTGDYNEYFSEETDVDAVVYLMLANSLVHDILPDATDIAEDVSGMPGLGRPVSEVGIGFDYRLAMAIPDKWIDYLKNKKDSEWSMKEISLNLTNRRYTEKCVSYAESHDQSIVGDKTIAFLLMDEEMYSSMSCLTMLSPTIERGISLHKMIHFITLALGGEGYLNFMGNEFGHPEWIDFPREGNGWSYEKCRLTQWNLVDTNHLRYKFMNAFDRAMNLLDDKFSILASTKQIVSSTNNEDKVIVFERGDLVFVFNFHPENTYEGYKVGCDLPGKYRVALDSDATEFGGHGRVGHDADQFTSPEGIPGIPETNFNNRPNSFKVLSPPHTCVVYYRVDERQEESNNPNLGSVEETFAAADTDVARIPDVSMESEDSNLDRIEDNSEDAVDAGILKVEREVVGDN

SEQ ID NO: 8001 - protein, 223 aa, Heywoodia lucens
DIPQASRFLFMKNKVRMICDCLAPPVKVIQDKKLAQPLSLCESTLRSPHGCHAQYMENMGSIASLVMSVTINEDDDEMDNDQQRGRNLWGLVVCHHTSSRFVPFPLRYACEFLIQVLGVQVNKEVELAAQMREKHILQTQTVLCDMLLRDAPWAIITQSPNVMDLVKCDGAALYYRKKFWLLGVTPTEAQIRDIADWLLEYHGGSTGLSTDSLMEAGYPDAAV

SEQ ID NO: 8002 - protein, 145 aa, Methanothermobacter thermautotrophicus
MFEKRRLMAEKMMEDMIKNMREMQKEFEKKIAEYAENIPEKLSMDVMETDDAIIIKTDLPGVKKEDINIELTENTISISAVFEEEVEIKEADFIKKERKYGEAKREMRLPEKIRVEDASAKFENGVLTVELPKVEVKKKQTLKVE

SEQ ID NO: 8003 - protein, 209 aa, Keayodendron bridelioides
  misc_feature (1)..(1): Xaa can be any naturally occurring amino acid
XTSSSRFLFMKNKVRMICDCLAPPVKVIQDKRLAEPLSLCGSTLRSPHGCHAQYMANMGSVASLVMSVTINEDDDEMDSDQARGIKLWGLVVCHHTSPRFVPFPLRYACEFLMQVFGVQVSKEVQLAAQAREKHILQTQTVLCDMLLRDAPVAIITRSPNVMDLVKCDGAALYYRKKFWLLGVTPTEAQIKDMAEWLLEYHGGSTGLKV

SEQ ID NO: 8004 - protein, 395 aa, Legionella pneumophila
MIFGILNLTFWGYVLATFVLTQITIASVTLYLHRYQTHRALTMHPIVSHFFRFWIWLTTGMVTRVWVAIHRKHHAMTDVEGDPHSPQIFSLKKVFWQVPELYREAAKDKDMIEKYSHGTPNDWIERNLYSRYSSKGILLMFLIDLLLFGFPGITIWAIQMIWIPLSAGVVNGVGHYWGYRNFECFDRSTNVFPLGFLIGGEELHNNHHTYASSAKFSVKWWEFDLGWFYIRCLSFLRLAKVKKLPPKLIRDNSKQYVDLNTIKAITSNRFQVMSDYYKRVTIPILKNEKQNYNYIKNKKEWYLFKGAKRLLRQETKKANYHLLALLNRFEQLQLVYNYRQSLQQIWLKKVSSQNELIESLNQWCKKAEESGLDVLRQFSLRIKSYVLIGTDSSSV

SEQ ID NO: 8005 - protein, 225 aa, Lachnostylis bilocularis
  misc_feature (3)..(3): Xaa can be any naturally occurring amino acid
LIXPQASRFLFMKNKVRMICDCLAPPVKVIQDKRLSQQLSLGGSTLRSPHGCHAQYMANMGSIASLVMSVTINEDDDEMDSDRERGIRLWGLVVCHHTSPRFVPYPLRYACEFLIQVFGVQVSKEVQLAAQMREKHILQTQTVLCDMLLRDAPVAIITQSPNVMDLVKCDGAALYYRKKFWLLGVTPTEAQIKDIAEWLLEYHGGSTGLSTDSLMEAGYPGAAVL

SEQ ID NO: 8006 - protein, 203 aa, Leptopus cordifolius
LRFLFLRNKVRMICDCLAPAVEVIQDKRLGQPLSLCGSILRSPHGCHAQYMENMGSIASLVMSVTINEDEDEIDNDQQSGRKLWGLVVCHHTSPRFVPFPLRYACEFLIQVFGVQVNKEVELAAQMKEKHILKIQTVLCDMLLRDAPVGIITQSPNVMDLVKCDGAALYYRKKIWLIGVTPTKAQIRDIADWLLEYHGGSTGL

SEQ ID NO: 8007 - protein, 85 aa, Oryza sativa
  misc_feature (66)..(66): Xaa can be any naturally occurring amino acid
HSNPVGNENYLHLYELGRLVVTEHNKKGNSLLEFEKLVSLKQQVVSCTFFYFTIYVNEGDAKKLYXLRFWEKPLMDFKCLQEFKP

SEQ ID NO: 8008 - protein, 75 aa, Populus tomentosa
MAYQNEPLESSPLRKLGRGKVEIKRIENTTNRQVTFCKRRNGLLKKAYELSVLCDAEVALIVFSSRGRLYEYSND

SEQ ID NO: 8009 - protein, 227 aa, Triticum aestivum
MDHAAEAQRTDLMTIDCGVSIGTIFGIYMIKDKDNATLEDVLQPGTDMIAAGYCMYGSSCTLVLSTGNGVNGFTLDPSLGEFILTHPNIKIPNKGKIYSVNEGNARNWDAPTAKYVERCKFPQDGSSPKSLRYIGSMVADVHRTLLYGGIFLYPADKKSPNGKLRVLYEVFPMSFLMEQAGGQSFTGKQRALEIVPAEIHQRSPIFLGSYDDVEEIKSLYASESSTA

SEQ ID NO: 8010 - protein, 263 aa, Brassica napus
NNSPLFNSFHHKKKASLNCPSCFLPERSSVSNILMALEAISSPRLASPVPPLFEDSSRFHGVEHWTKGKRSKRSRSDFPHKNLTEEEYLANCPGRPTRPGDRSNRNPLPPPPVTVAEKSSTYTCSVCDKSFSSYQALGGHKASHRKNLSQTLSGGGDDQSTSTTSAVTTGSGKSHVCSICHKSFPSGQALGGHKRCHYEGNNNSSSSVANSEGAGSTSHVSSGHRGFDLNIPPVPEFSLVNGDDEVMSPMPAKKPRFDFSEKA

SEQ ID NO: 8011 - protein, 411 aa, Arabidopsis thaliana
MSLTLEFLLLLIVLFLSHHAHSGSIVKFLPGFEGPLSFELETGYIGIGEEEEVQLFYYFIKSEKNPEEDPLLLWLSGGPGCSSLTGLLFENGPVALKFEVYNGSVPSLVSTAYSWTKMANIIFLDQPVGAGFSYSRTPLVDKTSDTGEVKRIYEFLQKWLSKHQQFFSNPFYVGGDSYSGMIVPPLVQEIAKGNYQINLQGYILGNPITDTESEQNYQIPYAHGMALISDELYKSMERICKGNYVNVDSLNTKCYKLIKDYQKCLHKLNKYHILLPDCDITSPDCFLYRYTLMTFWANNKSVREALQVNKGSIGEWVQCNYKNISYNYDIKSSVAYHMKNSIDGYRSLIYNGDHDMMVPFLATQAWIRSLNYSITDDWRPWMINDQIAGYTRSYSNKMTFATIKASLLVST

SEQ ID NO: 8012 - protein, 201 aa, Glycine max
MTSTSSSAPHYSSLPSPSSSNSTASYFVTRPATTTRSSFATRRPWEEVFALFSFTRPYSIGEATMRVRRNLDHFRVNYFMMVLFVLFLSLLWHPVSIIVYLVALVAWFFLYFFRDEPVVVFGNVVDDRVVAAVLAAATVLGLVLSGVWVNVVGSGIVGVGVVVLHAAFRSTEDLYVDEHDGGLLSFVGGTPTKRTGGYTLI

SEQ ID NO: 8013 - protein, 682 aa, Desulfitobacterium hafniense
MSNQDPLFSPIRIGKMELKNRIVLPAMHLNYCPDGEVTERLIEFYRVRARGGVGLVIVGGCGIDRVGNTLGMIQLDEDRYIPGLQKLVEAVHQEGAKVMTQLYQAGNYASSLLTGNQPVAPSPLPSKLTKEIPHELTVEEIKELVQTFAQAAVRTQKAGFDGVEILAGTGYLISEFLSPATNKRTDEYGGDLPNRMRFALEIMAAIRQGVGPDFPVVVRIAGHDFIPGGHTNKEARTFAKALAAAGVDAINVTGGWHETLVPQITMNVPPAAFRYLVRGIKQAVDLPVFASNRITTPELARDILTSGDADLVGFARPILADPNLPLKAQGLDPSPLRPCVACNQGCLDHVFRGIPVACLVNAEAGREAELKVRGVSSSSRKVLVVGAGPAGLEFARAASSQGHNITVWEKSGLLGGQLNLAAAPPDRQDFHRFTEYLARACKAQGVRIYTNQEADVENILAGIAEEGFTDIILATGALPMAPPFPVEEGVEIAQAWDVLAGKETGEHVVIVGGGSVGVETALYLAGQGTLDAEILRFLIVNQAESTETLARLLFQGRKRVTLVEMTKGVGRDLGSSTRWAMLADLQRHQVKVLTNTMVKAVRADGVWVEGPEGESLIPGDTVVAAVGSVANQELLKALQDKLPAHVTLQQIGDATKPAKVLDAVHAGYKAALSLGQTGYAQE

SEQ ID NO: 8014 - protein, 754 aa, Prochlorococcus marinus
MIETIQADWIQSEAINLENCCNDNPLKILGPHFYEEQWVIRVWMPEADEVKINFKNNTYKAESINHKWLFEAILPENPESNYEINISRGGITHTQHDPWSYIEEWMGEVDRHLFAEGNHHHIWEKMGAHLIEEKNQKGVMFCIWAPNAKSISIIGDINSWDGRHHPMQKRLGGIWELFMPTMEEGDTYKYEIRTQQGHIYEKADPYGFLHEIRPQNGSIVSKLKNFNWNDNAWITNRDSSSQINKPISVYEMHLGSWLHESTDNKYIEDNGNPRNPVPAADLKPGTRLLTYPELTEKLIPYVKDRGFTHIELMPISEHPFDGSWGYQVTGWYAPTSRFGTPNEFREFVNKCHEEGIGVILDWVPGHFPKDKHGLAFFDGCHLYEHGDSRIGEHKEWGTLIFNYSRNEVRNFLVANLVYWFEEFHIDGIRVDAVASMLYRDYLRPDGEWIPNENGGNENIEAVKFLQQANHVLFQHFPGALSIAEESTTWPMVTKPTDMGGLGFNLKWNMGWMHDMLDYFEIDPWFRQFHQNSVTFSITYNYTENFMLALSHDEVVHGKSHLLHKMPGDDWKKYANTRALLTYMWTHPGKKTIFMGMEFGQRQEWNVWDDLQWDLLEFEPHKGIRNLVDDLNALYKNEPALWKNDFDPYGFQWIDCNDKSNSVISFMRRENDTNEWLVIVANFTPNTHDSYKVGVPVEGFYKEIFNSDGSRYGGSNKGNMGGKEAINYNIHDYQNALELALPPLSVSIFKHQSKK

SEQ ID NO: 8015 - protein, 376 aa, Catharanthus roseus
MALLDQASNLSPMPFDFTRKRKSRRRDGTKNVAETLAKWKEYNEKLDALDGGKPARKVPAKGSKKGCMKGKGGPENSHCKYRGVRQRTWGKWVAEIREPNRGSRLWLGTFRNAIEAALAYDEAARAMYGPCARLNLPNYRASEESSSLPTTSGSDTTTASGISEVSVYEDKKFTPVVSGLKQDDKGESLESADSKPQLLVDAGTPMSAVKEEPKEYQVMDSQSEGQFGDEEPPSKLVCKEVDFGQDQAVVPAVKNAEEMGGEMGGDILKGCSLSEMFDVDELLSVLDSTPLHASDFQHGMGNGNVKAEAAYNYAPSWDSAFQLQNQDPKLGSQQHMAQTPPEINSGLDFLQPGRQEDSYFTLGDLDFLDLGAELGL

SEQ ID NO: 8016 - protein, 467 aa, Psychrobacter arcticus
MIAKKALGLPLKGLRFAIKSGDTLIKTASTQVTRFKTRFDENKAKNSLDEMPVAKRNYASVSEQTELSTNADSIDMREFEFTKAPINWIPATILVATPIAAAIITPWYLFTHQVSAPVWGVFGAFMVWTGISITAGYHRLLSHRAYKAHPIVKNFLLLGSTFAVQGSAFDWVSGHRTHHRHVDDRLEDPYSAKRGFFFSHMGWMLRNYPSGKFDYKNIPDLTKDRTLQIQHKYYGLWVAALNVGAVAAIGWLLGDVWGTLVIVGLLRLVLTHHFTFFINSLCHMFGSRPYTDTNTARDNFFLAIFTWGEGYHNYHHFFQYDYRNGVKWWQYDPTKWLIAGLSKLGLTSELRTVDDTTIKHAEVQMQFKAAQQQIDTATSSGIDIPHAMKSFQDRIKFEYDAFTQTVEEWQALKAKTIELKKTEFADRLHEVEDELKNDYAKIEEKILAHNSNLKTAFRSIDKSAKAA

SEQ ID NO: 8017 - protein, 191 aa, Xylella fastidiosa
MASPCLSVALKALCFRGASTHLSINRVRRLSMNVVRYTPWPGQAVLQNEIKQVFDRFFEHNGDTDESAVVTAQWVPRVDIKEEPNQFVLYADLPGIDPADIEVQMDKGILSIKGERKTESSSQTEHFSRIERRYGSFHRRFALPDSADADGITASGSHGVLRILIPKQAATTPRRIQVGNAVSSDVALQSM

SEQ ID NO: 8018 - protein, 547 aa, Brassica napus
MKFRGLDLIVFLLAVVSCKANKEITCEENEPFTCNNTDRLNSKGFPKDFIFGVSSAAYQIEGGRGRGLNIWDGFTHRFPEKGGSDLGNGDTTCESYTMWQKDIDIMDEMNATGYRFSFAWSRIIPKGKVSRGVNKGGLEYYHRLIDGLIAKNITPFVTLYHWDLPQTLQDEYEGFLNRQVIEDFRDLADLCFKEFGGKVKNWLTINQLYSVPTRGYSTGADAPVRCSPKVDARCYGGNSSTEPYIVAHNQLLAHTAVVNLYRTKYRFQRGRIGPVMITRWFLPFDETNKASIDAAERMKEFFLGWYMEPLTRGRYPDIMRRMVGNRLPNFTEAEARLVAGSYDFLGLNYYATQFVQPTPNPLPVTSERYTAMMDPGTRLTFVNSRGEKTGPLFEELKGGNSYYYPPGIYYVMDYFTTKYRNPLIYITESGFSTSGDQTRQEAVADSKRIDYLCSHLCFLRKVIMEKRVNIKGYFAWALGDNYEFGKGFTVRFGLSYVNWTDVSDRNLKDSGKWYQRFINVTTKITAHQDFLRSGLSFEDKMKTLTDA

SEQ ID NO: 8019 - protein, 223 aa, Leptopus colchicus
LYLKSRFLFMKNKVRMICDCLAPAVEVIQDKRLGQPLSLCGSTLRSPHGCHAQYMENMGSIASLVMSVTINEDEDEIDNDQQSGRKLWGLVVCHHTSPRFVPFPLRYACEFLIQVFGVQVNKEVELAAQMKEKHILNIQTVLCDMLLRDAPVGIITQSPNVMDLVKCDGAALYYRKKIWLIGVTPTKAQIRDIADWLLEYHGGSTGLSTDSLMEAGYPDAAVL

SEQ ID NO: 8020 - protein, 193 aa, Meineckia phyllanthoides
FMKNKVRMICDCLAPPVQVIQDKKLAQPLSLSGSTLRSAHGCHSQYMANMGSIASLVMSVMINEDDDELDNDQRRGKRLWGLVVCHHTSPRFVSFPLRYACEFLIQVFGVQVSKEVELSAQTREKHILQTKTVLCDMLLRDAPVGIITQSPNVMDLVRCEGAALYYRKKFWLIGVTPTEAQIRDIADWLLEYH

SEQ ID NO: 8021 - protein, 549 aa, Anaplasma marginale
MANVVVTGEALDKSIREVVRILEDAVGCTAGPKGLTVAISKPYGSPEITKDGYKVMKSIKPEEPLAVAIANIITQSASQCNDKVGDGTTTCSILTAKVIEEVSRAKAAGADTISIKNGILKAKEAVLTALLSMKREVASEDEIAQVATISANGDKNIGGKIAQCVREVGKDGVITVEESKGFKDLEVERTDGMQFDRGYLSPYFVTNAEKMLVEFENPYIFLTEKKINLVQSILPVLENVARSGRPLLIIAEDVEGEALSTLVLNKLRGGLQVAAVKAPGFGDRRKDMLGDIAVIAGAKYVVNDELTVKVEDITLDDLGTAKTVRITKDTTTIIGSVDSNADSITSRISQIKSQIEVSSSDYDKEKLKERLAKLSGGVAVLKVGGSSEVEVKERKDRVEDALHATRAAVEEGVVPGGGAALLYTLASLDGIKGKNDDEQLGINIIKRAVCAPIKRIIKNSGSEEAPCVIQHLMKQNDKELIFNVDTMNYANAFASGVMGPLKVVRIAFDLAVSLAAVFMTLNAVVVDVPSKEDTAGGGAAGGMGGMGGF

SEQ ID NO: 8022 - protein, 324 aa, Candida parapsilosis
MSTATASPAVKLNSGYEIPLVGFGCWKLTNDVASDQIYRAIKSGYRLFDGAEDYANEQEVGEGIKRAIKEGIVKREELFITSKLWNSFHDKKNVEVALMKTLSDLNLDYVDLFYIHFPIAQKPVPIEKKYPPGFYCGDGDKWSIEEVPLLDTWRALEKLVDQGLAKSIGISNFSAQLIYDLIRGCTIKPVALQIEHHPYLTQPKLVEYVQLHDIQITGYSSFGPQSFLEMDLKRALDTPVLLEEPTVKSIADKHGKSPAQVLLRYQTQRGIAVIPRSNSPDRMAQNLSVIDFELTQDDLQAIAELDCNLRFNEPWDFSNIPVFV

SEQ ID NO: 8023 - protein, 149 aa, Cocos nucifera
RTLRELKLLRHMDHENVVAIRDIIPPPVREIFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIF

SEQ ID NO: 8024 - protein, 227 aa, Nicotiana tabacum
ERVPERVVHARGASAKGFFEVTHDITHLTCADFLRAPGVQTPVIVRFSTVIHERGSPETLRDPRGFAVKFYTREGNFDLVGNNFPVFFIRDGMKFPDMVHALKPNPKSHIQENWRVLDFFSHVPESLHMFTFLFDDIGIPQDYRHMDGSGVHTFTLINKAGKSTYVKFHWKPTCGVKSLLEEEAARIGGANHSHATQDLYDSIAAGNYPEWKLFIQTMDPDHEDRFD

SEQ ID NO: 8025 - protein, 208 aa, Margaritaria cyanosperma
DIPQASRFLFMKNKVRMICDCQAPPVKVIQDKRLAQPLSLCGSTLRSPHGCHAQYMANMGTIASLVMSVTINEDDDEMDNDQQIGRKLWGLVVCHHTRPRFVPFPLRYACEFLMQVFGVQVNREVELAAQLREKHILQTQTVLCDMLLRDAPVAIVTQSPNVLDLVKCDGAALYYRKKFWLLGVTPTEAQIKDITEWLLEYHGQSTGL

SEQ ID NO: 8026 - protein, 224 aa, Petalodiscus fadenii
DIPQASRFLFMKNKVRMICDCQAPPVKVIQEKRLAQPLSLSGSTLRSPHGCHAQYMANMGSIASLVMSVTINEDDDEMDNDQQRGRKLWGLVVCHHTSPRFVPFPLRYACEFLIQVFGVQVNKEVELAVQRREKHILQTQTVLCDMLLRDAPVAIITQSPNVMDLVKCDGAALYYRSKFWLLGVTPTEAQIRDIAEWLLEYHGESTGLSTDSLMEAGYPGAANL

SEQ ID NO: 8027 - protein, 516 aa, Burkholderia mallei
MRMPHMISRHSMRWLSRALVAVSASGALAAHASTLTRDNGAPVGDNQNSQTAGANGPVLLQDGHLIQKLQRFDRERIPERVVHARGTGAHGVFVATRDISDLTRAKVFEPGTQTPVFVRFSSVIHGGTSPETLRDPRGFATKFYTAEGNWDLVGNNLPVFFIRDAMKFPDMVHSLKPAPDTNIQDPDRFFDFFSHQPEATHMITRVYSDAGTPASYREMDGNSVHAYKFVNAHGGVTYVKFHWKSLQGQKNLTAAQAEAIQGKDFNHMTRDLIAAIDAGRYPKWDLYVQTLKPDQLDQFAFDPLDATKVWPGVPEVKIGTMTLNRNPGNVFQETEQAAFAPSNLVPGIEPSEDRLLQGRLFAYADTQLHRVGVNGAQLPVNRPRAPVANYNRDGAMNGGAARGTVNYEPGAQAALAADPAFAASRAPLAGSTQQARIAKTRNFDQAGAFYRSLSASERANLVANLAGDLKQVRNDGVKYTMLSYFQKADAEYGRKVTAALGADQGRVDALTAKLAD

SEQ ID NO: 8028 - protein, 75 aa, Populus tomentosa
MEYQNESLESSPLRKLGRGKVEIKRIENTTNRQVTFCKRRSGLLKKAYELSVLCDAEVALIVFSSRGRLYEYSNN

SEQ ID NO: 8029 - protein, 68 aa, Triticum aestivum
  misc_feature (45)..(45): Xaa can be any naturally occurring amino acid
MGGLFRSGYLASRVSDRLLLYTRMGATVHTARHSYENVETSYTIXDIDGADYSLRMFTDDRQYLVAFR

SEQ ID NO: 8030 - protein, 771 aa, Rubrobacter xylanophilus
MKIVCIGGGPAGLYFGISLKLRQPEHEVTVIERNPCGVTFGWGVVFSDQTLGNLHANDPKSARRIQESFAHWDDIAVHVGGKEITRSGGHGFVGIARRRLLEILTERAVELGVEVQFEREVEDLSEFADADLIVASDGANSKVRERYAEKFGPSIDVRRNKYIWLGTRKLFDAFTFAFEKTEAGWVWIHAYRFDRDTSTCIVECSPETWKGLGFDRMEPEESIALCEEIFAPYLDGHGLINNMRHLGKAPWLNFRRISNERWFYDNIVLIGDAAHTAHFSIGSGTKLALEDAIALAEKLQEHGAGRQPYGWALKDALESYEAERRLEVLKLQSAARNSTEWFENVPRYINSLEPMQFAYSLLTRSQRVSHENLRLRDRNWLEKMERWFAGRYLGKPPKDPVPPMFTPFSLRNMELMNRVVVSPMAMYSAEDGTPNDFHLVHWGTRAQGGAGLVFTEMTCVTPQGRISPGCCGMYKPEHEAAFKRIVDFVHTHTHAKFALQLGHSGIKGSTRRGWEGADQPLEEGNWEVIGPSPVPWSEDNQIPREMTYEDMEEVKEAFVRATKMGERAGFDMLELHCAHGYLLSSFITPLLNRRTDEYGGSLENRLRYPLEVFRAMREVWPEEKPMSVRISATDWVDGGITADDAVEIARAFWEAGADLIDVSAGQTSPDARPVYGRMFQTPFSDRIRNELGIATMAVGNIWEADHVNSIIAAGRADLCALARPHLYDPYWTLRRAIELGYDGVPWPDQYLSGKAQLKRNVERASQMAQVI

SEQ ID NO: 8031 - protein, 164 aa, Thermococcus kodakarensis
MRKMVWRRDRYWDPFDIMREIQEEIDAIFRDFMRGPRLWSYREPGERIEVSETWREPFADIFDRGDRFVITVELPGVRKEDIKLRVTEDTVYIEAQMRREKELEQEGAIRIERYYSGYRRVIRLPEEVIPEKAKARYNNGVLEIEIPKKKPTKPEKEGVEVKIE

SEQ ID NO: 8032 - protein, 1229 aa, Nitrosomonas europaea
MILTSLTQRFAIWFTLVALLPIALVGYGLLHIFEGEIRKSAIQQVSSIADKKVEQIDSYLRERILDATFIQTSDTTRQAIDEFSQIFSQFGVDSETYRALDARHQAHYERYLEGTGYYDLFLISPDGWIVFSVSHESDFATSLLTGPYQDSGLGQVFRQTKETHQSSLSSFEYYPPSHGAIAAFVAVPIMIEGNFHGVLALQIYSEHIFDVLTNNVGLGESGETVVTYMENKHLARVMAPLREDPDAALKRTISLDEPQFSLAIRNSLSGEHGGGVVTDFHGNPVIAAWRYLPRVDWGMVVQIDTEEAFASVMQMRVMGLVVLGLTFLMAILGALLFNRRVVTPLKNLNECAQAINAGNLQHHIPDEGWDEIGQLASAFNMMTERLDISYRHLEARVAERTARLEQLNAELAIKEEETRSVVEHMVDCVVTTDERGVMLSVNPVMEKLFGYTVEEAIGQNVAVLVPKPDRDMHEYYMQRYCHTGYGQQYVGRPQQPGGHHVGLGREVEGVHKDGTLLPVYLAVSEYFVGDKRHFTGIMRDMREHVKIRQDLEQARRDAELANQAKSAFLAAMSHEIRTPMNGVIGMIDVLSQTSLSSYQKEMTDLIRESAFVLLEIIEDILDFSKIEAGRLEIEQRPISLEKVVERACGTLTHMAASKEVELILFVDPALPKNVAGDALRLRQILINLINNAIKFSSGMSRPGCVIVKAVPADRANGDVVTVLFQVIDNGIGMDDATRERLFTPFSQGDTSTTRRFGGTGLGLTICRRLVELMKGDITVESQPGKGSTFKARIPFRMIQEGAVQQDEPDEVDLSGLSCIVMGSEDGLSPQLATYLKYAGAAVERISGLSATLERIGQLPAGEWLLVADASDGEFPVDELRAAFGDRPDASAGDQLRFVIVRRGRRHRGRMEEEGVVTLDGNVLYRRVFLHAVAVAAGRAKLEEDQTAAVEVVSKVVPLSREEALQQGRLILVAEDNEINQKVIHQQLTLLGFAADIVINGREALQSWKNGEYALILTDLHMPEMDGYQLTQSIRSEKTGHYQIPIIALTANALKGEAEKCRALGMDDYLSKPVQLEQLKSVLEKWLPRSKQTEQQEERILPPSAATGKVVVDINVLKSLVGSDQAVINEFLQDFLHDTRKIAEQLHSAITGGQADKAKFAAHKLKSSARSVGALALGEWCAQMEMAAKEGDVEKLVELLPGFEQELAQVESYIKKVLAQPDVEAQKDEI

SEQ ID NO: 8033 - protein, 193 aa, Oryza sativa
MEGIGQSFRSTLGIFSTFKQCVICNYASYTTPIELGIEQILEARMLGIEHCLSWMGSHFPSPQEIGIGLTGFGVFFSFLGIIFFFDKGLLAMGNILFLSGLGLTIGLKSTLQFFTKPKNYKGTISFGAGLLLVLIGWPFFGMLLEAYGFIVLFSGFWPTLVVFLQKIPFIGWIFQQPFVASYLGSYRGKRVPV

SEQ ID NO: 8034 - protein, 671 aa, Streptomyces coelicolor
MSRYPHLLSPLDLGFTTLPNRVLMGSMHVGLEEAERGFERMAAFYAARARGGVGLIVTGGIAPNDEGRPYEGGARLTTGAEAEQHRVVTDAVHREGGRIALQILHFGRYAYHADLVAPSALQAPISPHVPRELTDAEVERTIDDYVRTARLAREAGYDGVEIMGSEGYLINEFIAARTNHRSDRWGGSYENRMRFPVEIVRRVREAVGADFIVVYRLSMLDLVPGGSTLDEVITLAKAVEAAGATIINTGIGWHEARIPTIATSVPRGAYTWVTKRLMGEVSVPLVTTNRINTPEVAEALLAEGTADMVSMARPMLADPDFVAKAAAGRAEAINTCIGCNQACLDHTFSGQITSCLVNPRACHETELVLAPTRRRKRVAVVGAGPAGLACAVSAAERGHEVTLFDAASEIGGQLNVARKIPGKQEFDETLRYFRTQLAAHGVDVRLNTRVGVADLTGHDEVVVATGVTPRTPDIPGVDHPSVVGYLDVLRDAAPVGERVAILGAGGIGFDVAEYLTDGGDKAHEDPETYFRLWGVDTDYRAPGGLAAPERPAPPRTVHLLQRKTSKVGAGLGKTTGWIHRTELRHRGVTMVPGVRYDRIDDAGLHITVGDESTVLEVDTVVLCTGQEPSRGLYDDLVAAGHRAHLIGGADVAAELDAKRAVKQGTELAAAL

SEQ ID NO: 8035 - protein, 380 aa, Zygosaccharomyces rouxii
MATHEEFIRTQVFGTVFEITNRYTDLNPVGMGAFGLVCSATDTLAGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKDHVHQFSIITDLLGSPPRDVINTICSENTLKFVTSLPHRDPVPFQERFKTVEPDAVDLLERMLVFDPKKRITAADALVHPYLAPYHDPTDEPTAEAQFDWDFNDADLPVDTWRVMMYSEILDFHKIGGGDGQIDTNAAFDDQVAAATAAPMAQHTNQTNQ

SEQ ID NO: 8036 - protein, 236 aa, Mannheimia succiniciproducens
MLVPIPALNDNYIWLYGRENLPVIAIDVAECKNLSAYLTQHHLQLEAVLLTHYHDDHTGGVEELKRYYPDIPVYGPAETADKGATHIVNEGNIQTAHYRIEVVPSGGHTANHVSYLIDNHLFCGDTLFSAGCGRVFTGDYGQMFESITRLKQLPDKTVICPAHEYTLSNLVFAEAFAPNEKVKSAVKNQRISVESLRAQNKPSLPTTLALEKNINPFLQAENLADFIYLRKAKDNF

SEQ ID NO: 8037 - protein, 149 aa, Cocos nucifera
RTLRELKLLRHMDHENVIAIRDIIPPPVREIFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDGGLVGCIF

SEQ ID NO: 8038 - protein, 774 aa, Arabidopsis thaliana
  misc_feature (349)..(349): Xaa can be any naturally occurring amino acid
  misc_feature (376)..(376): Xaa can be any naturally occurring amino acid
MAASSLSLSSPLSNPLRRFTLHHLHLSKKPLSSSSLFLCSAAKMNDHIHRVPALTEEEIDSVAIKTFERYALPSSSSVKRKGKGVTILWFRNDLRVLDNDALYKAWSSSDTILPVYCLDPRLFHTTHFFNFPKTGALRGGFLMECLVDLRKNLMKRGLNLLIRSGKPEEILPSLAKDFGARTVFAHKETCSEEVDVERLVNQGLKRVGNSTKLELIWGSTMYHKDDLPFDVFDLPDVYTQFRKSVEAKCSIRSSTRIPLSLGPTPSVDDWGDVPTLEKLGVEPQEVTRGMRFVGGESAGVGRVFEYFWKKDLLKVYKETRNGMLGPDYSTKFSPWLAFGCISPRFIYEXGGPRNVQGKWSQDQKLFESWRDAKTGXNMKELSTTGFMSNRGRQIVCSFLVRDMGLDWRMGAEWFETCLLDYDPCSNYGNWTYGAGVGNDPREDRYFSIPKQAQNYDPEGEYVAFWLQQLRRLPKEKRHWPGRLMYMDTVVPLKHGNGPMAGGSKSGGGFRGSHSGRRSRHNVIMDNETKATTFSKSTGLPRKRFYRARAHSNPLSDSHFPIPISPAHVDYSLHFPKFVEADNKFIKKVEFADIGCGFGGLLISLATLFPDTLMIGMELRDKVTEYVKERILALRRTSSEGQYENISVVRTNSMKYIPNYFEKGQLSKMFFLFPDPHFKEKNHRRRVISTHLLDEYAYVLRAGGIIYTITDVEELGEWMKSCLEKHPMFESLTQEELVSDPVVELLCSATEEGQKVARNGGQTFRAVFRRIAYVS

SEQ ID NO: 8039 - protein, 148 aa, Cocos nucifera
TLRELKLLRHMDHENVVAIRDIIPPPVREIFNDVYIAYELMDTDLHQIIRSNQALSEEHCQYFLYQILRGLKYIHPANVLHRDLKPSNLLLNANCDLKICDFGLARTTSETDFMTEYVVTRWYRAPELLLNSSEYTAAIDVWSVGCNV

SEQ ID NO: 8040 - protein, 501 aa, Aspergillus nidulans
MGQNDDQKTYRYNESPVYTTSNGCPVMDPQASQRVGPNGPLLLQDFNLIDLLAHFDRERIPERVVHAKGAGAYGEFEVTDDISDITVIDMLKGVGKKTKTFVRFSTVGGEKGSPDSARDPRGFACKFYTEEGNWDWVFNNTPVFFLRDPSKFPMFIHTQKRNPQTNLKDATMFWDYLSTHQEAVHQVMHLFSDRGTPYSYRHMNGYSGHTYKWIKPDGTFNYVQLHLKTDQGNKTFTDAEATRLAAENPDWHTQDLFNAIARGEYPSWTCYVQTLSPEQAEKFRWNIFDLTKVWPQSEVPLRRFGRFTLNKNPENYFAEVEQAAFSPSHLVPGVEPSADPVLQARLFSYPDTHRHRLGTSNYQSIPVNCPLRAFTPFHRDGAMSVNGNHGANPNYPSTFRPLQYKPVKASQEHEKWAGSVVTEQLPVTDEDFVQANGLWKVLGRQPGQQENFVGNVAGHLCNAHPRVRQATYGMFRRVNADLGKRIEKATEKKATEARARL

SEQ ID NO: 8041 - protein, 234 aa, Glycine soja
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVADTTTATAQGVFYMEEEEQVLDMPELLRNMVLMSPTHCLGYEYEDADLDAQDAEVSLWNFSI

SEQ ID NO: 8042 - protein, 280 aa, Campylobacter coli
MQELISYIQKAVIEISNALKFPDTSYSQNQNSTGDTQLKFDVLSDEIITNTLSQCPSIKAIISEEKDEILNINENAKFIVAYDPLDGSSLMDVNFAIGSIFAIYEEKASAKNLKAALYSMYGARLELVICEDKPKLYRLDKNNEFVFVKDLQMQEKGKINATGGTQKFWEEKHAKFIKKLFDEGYRLRYSGAMVSDINQILLKGGGIFSYPATSDAPKGKLRAFFEVFPLAFIIEKAGGKTTNGKNHSLLELDFDEIHATTPCFFGSKYEISELLKAYNE

SEQ ID NO: 8043 - protein, 1298 aa, Neurospora crassa
MTDGPTLAAIAALVKSLAVDPATTQTSGLRPSTHVRLPGPYTREKGDLERELSALVVRIEQLETAAIAASPPAMPDTPNAPTDALFSNGTLSPSSETPDARYPAPLPRNGFIDEALEGLREHVDDQSKLLDSQRQELAGVNAQLIEQKQLQEKALAIIEQERVATLERELWKHQKANEAFQKALREIGEIVTAVARGDLSKKVRMNSVEMDPEITTFKRTINTMMDQLQVFSSEVSRVAREVGTEGILGGQAQIEGVDGTWKELTDNVNVMAQNLTDQVREIASVTTAVAHGDLTKKIERPAKGEILQLQQTINTMVDQLRTFASEVTRVARDVGTEGILGGQADVEGVQGMWNELTVNVNAMANNLTTQVRDIIKVTTAVAKGDLTQKVQAECRGEIFELKKTINSMVDQLQQFAREVTKIAREVGTEGRLGGQATVHDVQGTWRDLTENVNGMAMNLTTQVREIAKVTTAVAKGDLTKKIGVEVQGEILDLKNTINTMVDRLGTFAFEVSKVAREVGTDGTLGGQAQVDNVEGKWKDLTENVNTMASNLTSQVRGISTVTQAIANGDMSRKIEVEAKGEILILKETINNMVDRLSIFCNEVQRVAKDVGVDGIMGGQADVAGLKGRWKEITTDVNTMANNLTAQVRAFGDITNAATDGDFTKLVEVEASGEMDELKKKINQMVYNLRDSIQRNTQAREAAELANKTKSEFLANMSHEIRTPMNGIIGMTQLTLDTDLTQYQREMLNIVNSLANSLLTIIDDILDLSKIEARRMVIEEIPYTLRGTVFNALKTLAVKETEKFLDLTYRVDHSVPDHVVGDSFRLRQIILNLVGNAIKFTEHGEVSLTIQKASSVQCSTEEYAIEFVVSDTGIGIPADKLDLIFDTFQQADGSMTRKFGGTGLGLSISKRLVNLMGGDVWVKSEYGKGSKFFFTCVVRLANDDISLIAKQLNPYKSHQVLFIDKGRTGHGPEIAKMLHGLGLVPIVVDSERNPALEKARAAGQAPYDVIIVDSIEDARRLRSVDDFKYLPIVLLAPVVHVSLKSCLDLGITSYMTTPCQLIDLGNGMVPALENRATPSLADNTKSFEILLAEDNTVNQRLAVKILEKYHHVVTVVGNGEEAVEAVKRKKFDVILMDVQMPIMGGFEATAKIREYERSLGSQRTPIIALTAHAMMGDREKCIQAQMDEYLSKPLQQNHLIQTILKCATLGGQLLEKNRERELTRAADAVTGGRRDNGMYSASQAAQHAALRPPLATRGLTAADSLVSGLESPSIVTADKEDPLSRARASLSEPNIHKAS

SEQ ID NO: 8044 - protein, 404 aa, Unknown
  Shewanella sp. MR-4
MRPIIKSNKLDTVCYDIRGPVHKEARRLEDEGHRILKLNIGNPAPFGFEAPEEIVRDVILNLPSAQGYCESKGLFSARKAIVQHYQAQGIKGVDIEDVYIGNGVSELIMMAMQGLLNTDDEVLIPSPDYPLWTAAANLAGGKAVHYRCDEEADWFPDLDDIKSKISSRTRGIVLINPNNPTGAVYSKELLLQVIELCREHNLILFADEIYDKILYDEAKHIPAASLSDDILTVTFNGLSKAYRAAGFRVGWMMLSGNLKAAKSYIEGLEMLSSMRLCANVPNQHAIQTALGGYQSINELILPSGRLTVQRDTCYELLNQIPGVSVKKPKGALYAFPKLDMKKFNLRDDERLVLDLLRDKKILLVHGSAFNWPEPDHLRVVFLPYKEDLTKALTEFGNFLETYKQ

SEQ ID NO: 8045 - protein, 488 aa, Listeria seeligeri
MTDRRNLTTNQGVPIGDNQNSMTAGLKGPTLLEDYVLIEKLAHFDRERVPERVVHARGAGAHGKFVTKKSMKKYTKAQFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMITYLFSDEGTPASYREIRGSSVHAFKWINEEGKTVYVKLRWVPKAGIVNLSTDQAAQIQAKEFNHASRDLYEAIENGDYPEWDLYVQVLDPKDLDNYDFNPLDATKDWFEDVFPYEHVGTMTLNRNPDNIFAETESVGFNPGVLVPGMLPSEDRVLQGRLFSYSDTQRHRVGPNYLQLPINSPKTPVDNNQRDGQMPFKQQTSSINYEPNSYDTEPKENPAYIEPEQEIRGDISGRLVAEKPNNFGHAKEVWKRYSDAERAALVKNIVDDWEGVREDIKIRNLRNFYQVEPEFAERVAAGTGINLAEHVIDLK

SEQ ID NO: 8046 - protein, 854 aa, Methanosarcina mazei
MGIFSLRRWTELENTLVLYREAECDLEEKDRMYRALFEQSSDAVIISDGKKVLDINKKGCEIFGFGQKRPFNVSLMSFIQAEYLPELQQAFKETFRQGSSNFEMRYQKPEGEIVDIKVNLSLIDRKDNIVQLVAQDITVSKNIERSEQENRERLKAILDNTLCGILLIESSSRKIINANPIALKTAGYSDKELIGMTCYRLIDQHGEENCAALSLDQAGDLSESILLTATGKTLPILRSVVPVSIGGTGYFVESFIDLSDRKQAEEELLQAKIAAESANRSMSEFLATMSHELRTPLTAIIGFSELMLGGSTGEFDELNKKFLGNISTSGKHLLSLINSILDLSKIEAGKMELQSDYFSLQDIFSNTKNILSPLALKKNISMDFNVEPGFFVYADRTRFKQIMYNLVSNAVKFTQKGGSVEVLGIVSEKGVRVSVSDTGIGISKDEIKQLFKPFKQIDSTLSRKYEGTGLGLVLSKKFVEMHGGRIWVESEPGKGSTFTFEVPVKTLKSGEIFRAHETAETAHETAETCETNAIEAPVITGKAVESGKPVEPIVLNELTESGAEIPVKMPKMEDISVDFKSCGSDVSAPLVMVVEDDRLSRELLVFTLKEAGYRVVQAATGEEALSLAQKLKPFVITLDLMLPEMNGWDVLENLKKDSVTSGIPVLVLSITEKNDCKMLWGAFDHLVKPVDKSVLLSSLDRLKTNLKKDSPKILIADDQESMLELMSSMIEFEGYVISLAQGGKEAIDKASTEIPDAIILDLNMPDVSGFEVIKALKKNPQTVDIPVIVCTSKDLSMQEMKMLNSSVSFVMQKEDLNKRKLLELIRRLEPENCGIFTSPAYQEVFQSDSFRTEG

SEQ ID NO: 8047 - protein, 145 aa, Glycine max
MGSEGPPAAVTVHVTGFKKFHGVSENPTETIVNNLTEYLKKKGLSKGLVIGSCSILETAGQGALIPLYKTLQSAITSKESESSSSNKIIWLHFGVNSGATRFAIERQAVNEATFRCPDEMGWKPQKVPIVPSDVAITRIRKTTLP

SEQ ID NO: 8048 - protein, 275 aa, Brucella suis
MTVPTVKLNDGNHIPQLGYGVWQISNDEAVSAVSEALKAGYRHIDTATIYGNEKGVGKAINGSGIARADIFLTTKLWNSDQGYESTLKAFDTSLKKLGTDYVDLYLIHWPMPSKDLFMETWRAFIKLKEEGRVKSIGVSNFRTADLERLIKESGVTPVLNQIELHPQFQQDELRLFHGKHDIATEAWSPLGQGKLLEDPTLKSIAEKHAKSVAQIILRWHIETGNIVIPKSITPARIKENFDIFDFTLNGTDHDAITKLDMADGRIGPNPSVFSA

SEQ ID NO: 8049 - protein, 590 aa, Triticum aestivum
MCGILAVLGCADWSQAKRARVLSCSRRLKHRGPDWSGLFQCEGNFLAQQRLSVVSPLSGDQPLYNEDRTVVVVANGEIYNHKKIRKQFAAKHTFTTGSDCEVIIPLYEEYGENFVNMLDGVFSFVLYDTRNKTYMAARDAVGVNPLYFGRGSDGSVWIASEMKALHEDCPKFELFPPGNLYSSAAGGFRRWYNPQWFAEHVPATAYQPLVLREAFEKAVIKRLMTDVPFGVLLSGGLDSSLVASVTKRHLIETEAAKKFGTELHSFVVGLEGSPDLKAAREVADYLGTIHHEFHFTVQDGIDAIEEVIYHNETYDVTTIRASTPMFLMARKIKALGVKMVLSGEGSDELLGGYLYFHFAPNKEEFHKETCRKVKALHQYDCLRANKATSAWGLEVRVPFLDKEFIDVAMSMDPEWKLYDANLGRIEKWVLRKAFDDEKEPYLPRHILYRQKEQFSDGVGYNWIDGLKAFTEQQVTDEMMKNAAEEYPYNTPINKEAYYYRMIFERLYPQDSARETVPWGPSIACSTPAAIEWVAQWKASNDPSGRHIASHNDAAPAHAHANWNGAVANGKANGNGTANGNANANGTLVPC

SEQ ID NO: 8050 - protein, 549 aa, Anaplasma centrale
MANVVVTGEALDKSIREVVRILEDAVGCTAGPKGLTVAISKPYGSPEITKDGYKVMKSIKPEEPLAVAIANIITQSASQCNDKVGDGTTTCSILTAKVIEEVSRAKAAGADTISIKNGILKAKEAVLTALLSMKREVASEDEIAQVATISANGDKNIGGKIAQCVREVGKDGVITVEESKGFKDLEVEKTDGMQFDRGYLSPYFVTNAEKMLVEFENPYIFLTEKKINLVQSILPVLENVARSGRPLLIIAEDVEGEALSTLVLNKLRGGLQVAAVKAPGFGDRRKDMLGDIAVIAGAKYVVNDELAVKVEDITLDDLGTAKTVRITKDTTTIIGSVDSNADSITSRISQIKSQIEVSSSDYDKEKLKERLAKLSGGVAVLKVGGSSEVEVKERKDRVEDALHATRAAVEEGVVPGGGAALLYTLASLDEVKGKNDDEQLGINIIKRAVRAPIKRIIKNSGSEEAPCVIQHLLKQNDKELIFNVDTMNYANAFASGVMDPLKVVRIAFDLAVSLAAVFMTLNAVVVDIPSKEDTAGGGAAGGMGGMGGF

SEQ ID NO: 8051 - protein, 157 aa, Triticum aestivum
  misc_feature (2)..(2): Xaa can be any naturally occurring amino acid
  misc_feature (93)..(93): Xaa can be any naturally occurring amino acid
  misc_feature (107)..(107): Xaa can be any naturally occurring amino acid
  misc_feature (113)..(113): Xaa can be any naturally occurring amino acid
  misc_feature (123)..(123): Xaa can be any naturally occurring amino acid
  misc_feature (125)..(125): Xaa can be any naturally occurring amino acid
  misc_feature (129)..(129): Xaa can be any naturally occurring amino acid
  misc_feature (134)..(134): Xaa can be any naturally occurring amino acid
  misc_feature (138)..(138): Xaa can be any naturally occurring amino acid
  misc_feature (140)..(140): Xaa can be any naturally occurring amino acid
KXTLVCAYESSSLPATVRTQAVEAGLHCFDMEGISSDKDAKGRQRVNHVTVFERPGLHEFLQKTSEFADLILFTAGLEGYAKPLVDRIDAHNXFCRRLYRPSTVTTXYRDHVXDLSCLSKDSXEXCLSXSHPYXFLLXPXNGIPCLLFSWTAMDDQL

SEQ ID NO: 8052 - protein, 608 aa, Magnetospirillum magnetotacticum
MCGICGYVGAERPGLIQAMIAEIRHRGPDGEGCDSALGIHLGHARLAILDPSHGAQPLTGADGRYTVSYNGEIYNYPDLRRELEALGHRFETTCDTELLPLGFAAWGEGLFARLDGMFAFALRDNADGRLWLVRDQLGIKPLYYSLAGGELAFASSARALTRHPQVSRRLRPDAIQEFLQFRWVRSGRHLFSDVEILPPGGVLRWTEGEARLDRFWTPARRGPARNALPRDWAAEVELVLEDSVRRQLRADVALGIFLSGGVDSAMIGHYAARNAANRLTAFTFSTGDRVDETAQAAAMARDFGFDHRVVSLTASDFADFPQAVACLDNPVGDAVVLPTWKLCREAAREVKVVLTGEGADEMFAGYAHLPILRKLDQLGSVAGVLRLLAPLIRLMPVGLLNHLFDYQASLGRLGRDAAAELLAVAGDSGKMLARASAIMGDAEMAQATTLGPPPPRPKADLSLGGLLLDLTRGWLPEEILHKMDQLSMAHGLEARVPYVTTALYDLLLRCPDQMAMGKTLLRHVASQSGLAAARRRKVAFHLPVETLWRPQLEEMCREYLSPAMIRRHAILNEAFVGRSLSLLKAGEFLASKRLVAMVSLHAWLDAHT

SEQ ID NO: 8053 - protein, 549 aa, Anaplasma centrale
MANVVVTGEALDKSIREVVRILEDAVGCTAGPKGLTVAISKPYGSPEITKDGYKVMKSIKPEEPLAVAIANIITQSASQCNDKVGDGTTTCSILTAKVIEEVSRAKAAGADTISIKNGILKAKEAVLTALLSMKREVASEDEIAQVATISANGDKNIGGKIAQCVREVGKDGVITVEESKGFKDLEVERTDGMQFDRGYLSPYFVTNAEKMLVEFENPYIFLTEKKINLVQSILPVLENVARSGRPLLIIAEDVEGEALSTLVLNKLRGGLQVAAVKAPGFGDRRKDMLGDIAVIAGAKYVVNDELAVKVEDITLDDLGTAKTVRITKDTTTIIGSVDSNADSITSRISQIKSQIEVSSSDYDKEKLKERLAKLSGGVAVLKVGGSSEVEVKERKDRVEDALHATRAAVEEGVVPGGGAALLYTLASLDEVKGKNDDEQLGINIIKRAVRAPIKRIIKNSGSEEAPCVIQHLLKQNDKELIFNVDTMNYANAFASGVMDPLKVVRIAFDLAVSLAAVFMTLNAVVVDIPSKEDTAGGGAAGGMGGMGGF

SEQ ID NO: 8054 - protein, 241 aa, Glycine max
IRLETLRIQRLRKKFYFHFQDYVDLIIWKVQFLDRHHLLIKFGSVDGGVSRNADHHPAFVAVYNMDTTEIVSFYQNSPDELYLLFEQFCDHFHATSRNSMYMNFISSHSNNIHALEQLRSIKDKASSSAQFVKKMLASLPFSCQSQSPSPYFDQSLFRFDDKLISATDRHRQSTDHPIKFILRRHPYSLKFKIKPGPEAGSMDGRAKKISSFLFHPILPLALSVQQTLFLQPSVVNIHFRR

SEQ ID NO: 8055 - protein, 484 aa, Rhizobium sp.
MKKLTNATGAPVADNFNIQTAGPRGPALLQDIWLLEKLAHFDRELIPERRMHAKGAGAYGTFTVTHDITRYTKASIFSSVGKETPLFVRFSSVAGERGSADAERDIRGFAVKFYTDEGNWDIVGNNTPVFFFRDPLRFSDLNHVVKRDPSPALRNATSNWDFWTLLPEALHQVTSVMSDRGLPTSFRHMHGFGSHTFSLIDRDNKRVWVKFHFVCQQGIENLSDAEAEAVVGKDRESNLRDLYEVIEQGNFPRWKLCIQVMEEEQALNYRHNPFDLTKVWPHAARVIEVGIMELNRNSRKANFAEIEQAAFSPANVVPGVSFSPDRISRARLFSYGDAQRYRLWLNFNHIPVNAPRCPASSYHRSYHRDGAMHADGNLGGTASYFPNSVGEWQDSPERAEPPLPLEGFDQHYDHRLEEDHYEQPGNLFRLLDPARNELLFDNTARAMNGVPQRIRQRHMTIAPKPSPAYGFGVAEALERLVPLG

SEQ ID NO: 8056 - protein, 419 aa, Yarrowia lipolytica
MDEEEHKDHQEEEDPHHFAFSDNYSEAVLGGEISATVFDVTGKVVHVAHKMTKYEFLLEHGLYPRDLRNIDPSPVSIIPSILARGRKGAGRCILVNLLHIKALILHDKVLIFDTHSKNKSDTHRLGMFLYELENKLKPTINPEKMHTDMTVLPFELRVLEAILVNVMTTLDGELQVHLKTLNEILVGLEDHVDREQLKELLIGNKNVSRFYQKAVLIRDVLEELLESDDDLQQLYLGTHPKEGLAEVELLIESYCKQADEIVQQASNVRSHIRSTEEIVNIIVDANRNALMLLELKVTIVTVGFAVGAFVAALYGMNLENFIEETNEGMVLVVGVACLGGLLVTWFNLTKLHKTQKIAMFSNAATHTASKPYMLQWIIGLLRRKRTKSRFDNIDMSRPKMKGKKSNILHQLTKMTGKRR

SEQ ID NO: 8057 - protein, 357 aa, Gluconobacter oxydans
MTSLFEPIELGSIYAKNRILMAPLTRGRGTRDHVPTPIMAEYYAQRAGAGLIISEATGISREGLGWPYAPGLWSQEQVEAWKPITAAVHAKGGKIVAQLWHMGRMVHSSVTGQQPVSCSATKAPEALHTYDGKQAPEVARPLTKEDIARILNDYENAARNALQAGFDGVQIHAANGYLIDEFLRDGTNHRSDEYGGSPENRIRFLREVTERVIATIGAHKTSVRLSPNGDTVGCIDSHPEQVFVPAAKLLNDLDIAFLELREPGPNGTFGKTDQPKLHGPIREVFRKPLVLNQDYTREEAIETVATGVADAISFGRPFLANPDLVRRLEDNLPQNKDDIRTWYSQGAEGYTDYPLAR

SEQ ID NO: 8058 - protein, 401 aa, Unknown
  Shewanella sp. MR-7
MKQLIRNIVCLGLGLSLGLSISLSSQENAKSYQSDFDYPLLQDVLETVETYYVKTVSKDELVQAAIKGIFEHLDPYSSFLNHQELLDLKDSNRGEYFGFGFEVASDKDHISIIAPFANSPAEQAGIQAGDIIIKLNDTPTTETNLADILNQIKQHSLSNQSIRLTLKHRNDAVEFEVSLKPSTITIQSVASKLLDGNIGYVRLSSFQENSTEDMVRSLSQWQNAHLTGLILDLRNNPGGLLDQAIKIADLFLAKGRIVSTSGRFFDANSDYYASPQTMLTNVPMLVLINKGSASASEVLAAALQENGRAKLLGETSFGKGTVQSLIPILNDGNAIKLTIAQYNTPRGENIHDIGIVPDIKVAAETGSNQKNMAIIDTISARTDVSQDSLVTSAIAWMQHHD

SEQ ID NO: 8059 - protein, 271 aa, Unknown
  Silicibacter sp. TM1040
MTMPDQTSFPSTVANGLEIVTVPCLADNYAYLVKGPDGVALIDAPEAEPILTALEARDWSLGVIMITHHHHDHVGGVAALREKFGCPVMGPKAEADKIAAQGVTLDMELEPGFEGGTGAGRCQVLAVPGHTLGHIAFYYPEAPALFSADSLMVMGCGRLFEGTPAMMWQTMTTLSALPDETLIYSGHEYTESNAGFALSLEPENAALQKRMDEITKTRQNGQPTVPALLSLEKQTNPFLRAGDPNLKKTLGLEGVEDAEVFAHIRVAKDKF

SEQ ID NO: 8060 - protein, 453 aa, Unknown
  Synechocystis sp. PCC 6803
MYCYDPRQFAQTHQGFAKTGPWRSNFLQQSVQNLAESLQKVGNKLLVTTGLPEQVIPQIAKQINAKTIYYHREVTQEELDVERNLVKQLTILGIEAKGYWGSTLCHPEDLPFSIQDLPDLFTKFRKDIEKKKISIRPCFFAPSQLLPSPNIKLELTAPPPEFFPQINFDHRSVLAFQGGETAGLARLQDYFWHGDRLKDYKETRNGMVGADYSSKFSPWLALGCLSPRFIYQEVKRYEQERVSNDSTHWLIFELLWRDFFRFVAQKYGNKLFNRGGLLNKNFPWQEDQVRFELWRSGQTGYPLVDANMRELNLTGFMSNRGRQNVASFLCKNLGIDWRWGAEWFESCLIDYDVCSNWGNWNYTAGIGNDARDFRYFNIPKQSQQYDPQGTYLRHWLPELKNLPGDKIHQPWLLSATEQKQWGVQLGVDYPRPCVNFHQSVEARRKIEQMGVIA

SEQ ID NO: 8061 - protein, 324 aa, Hypocrea jecorina
MASPTLKLNSGYDMPQVGFGLWKVDNAVCADTVYNAIKAGYRLFDGACDYGNEKECGEGVARAIKDGLVKREDLFIVSKLWQTFHDEDKVEPITRRQLADWQIDYFDLFLVHFPAALEYVDPSVRYPPGWFYDGKSEVRWSKTTTLQQTWGAMERLVDKGLARSIGVSNYQAQSVYDALIYARIKPATLQIEHHPYLQQPDLVSLAQTEGIVVTAYSSFGPTGFMELDMPRAKSVAPLMDSPVIKALADKHRRTPAQVLLRWATQRGIAVIPKTSRPEVMAQNLDNTSFDLDSEDLAKIADMDLNIRFNKPTNYFSANKLYLFG

SEQ ID NO: 8062 - protein, 469 aa, Clostridium acetobutylicum
MKFPKDFFLGAASASYQVEGAWNEDGKGVSNWDVFTKIPGKTFEGTNGDVAVDHYHRYKEDVKLMAEMGLDSYRFSVSWPRIIPDGDGEINQKGIEFYNNLIDECLKYGIVPFVTLYHWDMPEVLEKAGGWTNKKTVDAFVKYAKACFEAFGDRVKRWITFNETIVFCSNGYLSGAHPPGITGDVKKYFQATHNVFTAHARSVIEYKKLKQYGEIGITHVFSPAFSVDDKEENKAAAYHANQYEITWYYDPILKGKYPEYVIKNIEKQGFLPDWTDEELNTLREAAPLNDFIGLNYYQPQRVIKNHDTGEKIERTRENSTGAPGNASFDGFYRTVKMDDKTYTKWGWEISPESLILGLEKLKEQYGDIKIYITENGLGDQDPIIEDEILDMPRIKFIEAHLRAIKEAISRGINLKGYYAWSVIDLLSWLNGYKKQYGFIYVDHKHNLDRKKKLSFYWYKKVIEERGKNI

SEQ ID NO: 8063 - protein, 1281 aa, Neurospora crassa
MTDGPTLAAIAALVKSLAVDPATTQTSGLRPSTHVRLPGPYTREKGDLERELSALVVRIEQLETAAIAASPPAMPDTPNAPTDALFSNGTLSPSSETPDARYPAPLPRNGFIDEALEGLREHVDDQSKLLDSQRQELAGVNAQLIEQKQLQEKALAIIEQERVATLERELWKHQKANEAFQKALREIGEIVTAVARGDLSKKVRMNSVEMDPEITTFKRTINTMMDQLQVFSSEVSRVAREVGTEGILGGQAQIEGVDGTWKELTDNVNVMAQNLTDQVREIASVTTAVAHGDLTKKIERPAKGEILQLQQTINTMVDQLRTFASEVTRVARDVGTEGILGGQADVEGVQGMWNELTVNVNAMANNLTTQVRDIIKVTTAVAKGDLTQKVQAECRGEIFELKKTINSMVDQLQQFAREVTKIAREVGTEGRLGGQATVHDVQGTWRDLTENVNGMAMNLTTQVREIAKVTTAVAKGDLTKKIGVEVQGEILDLKNTINTMVDRLGTFAFEVSKVAREVGTDGTLGGQAQVDNVEGKWKDLTENVNTMASNLTSQVRGISTVTQAIANGDMSRKIEVEAKGEILILKETINNMVDRLSIFCNEVQRVAKDVGVDGIMGGQADVAGLKGRWKEITTDVNTMANNLTAQVRAFGDITNAATDGDFTKLVEVEASGEMDELKKKINQMVYNLRDSIQRNTQAREAAELANKTKSEFLANMSHEIRTPMNGIIGMTQLTLDTDLTQYQREMLNIVNSLANSLLTIIDDILDLSKIEARRMVIEEIPYTLRGTVFNALKTLAVKETEKFLDLTYRVDHSVPDHVVGDSFRLRQIILNLVGNAIKFTEHGEVSLTIQKASSVQCSTEEYAIEFVVSDTGIGIPADKLDLIFDTFQQADGSMTRKFGGTGLGLSISKRLVNLMGGDVWVKSEYGKGSKFFFTCVVRLANDDISLIAKQLNPYKSHQVLFIDKGRTGHGPEIAKMLHGLGLVPIVVDSERNPALEKARAAGQAPYDVIIVDSIEDARRLRSVDDFKYLPIVLLAPVVHVSLKSCLDLGITSYMTTPCQLIDLGNGMVPALENRATPSLADNTKSFEILLAEDNTVNQRLAVKILEKYHHVVTVVGNGEEAVEAVKRKKFDVILMDVQMPIMGGFEATAKIREYERSLGSQRTPIIALTAHAMMGDREKCIQAQMDEYLSKPLQQNHLIQTILKCATLGGQLLEKNRERELTRAADAVTGGRRDNGMYSASQAAQHAALRPPLATRGLTAADSLVSGLESPSIVTADKEDP

SEQ ID NO: 8064 - protein, 246 aa, Glycine max
MGRGKVELKRIENKINRQVTFAKRRNGLLKKAYELSVLCDAEVALIIFSNRGKLYEFCSGHSTAKTLERYHRCSYGALEVQHQPEIETQRRYQEYLKLKSRVEALQQTQRNLLGEELEHLDVNDLEQLERQLDSSLKQIRSNKTQQMLDQLSDLHRKEEMLLETNNILRNKLEEINVALQPTWEAREQNAPYNCHPPQTEGYYETATAHCSSTLRIGYDSSGLNEAGGAAGASAQNASEFMHGWMN

SEQ ID NO: 8065 - protein, 446 aa, Pyrus pyrifolia
MAIDIEQQQQPSPGLSKIAVSDTHGEDSPYFAGWKAYDENPYHESSNPSGVIQMGLAENQVSFDLLEKHLEENSEASNWGSKGSKGVSGFRENALFQDYHGLLSFRKAMASFMEQIRGGRAKFDPARVVLTAGATAANELLTFIIADPGDALLVPTPYYPGFDRDLRWRTGVNIVPIHCESSNNFQITPQALEAAYKEAEAKNMRVRGVLITNPSNPLGATIQRAVLEEILDFVTQKNIHLVSDEIYSGSAFSSSEFISVAEILEDRQYKDAERVHIVYSLSKDLGLPGFRVGTVYSFNDKVVTTARRMSSFTLISSETQHLLASMLSDKEFTGNYIKTNRERLRRRYDMIVEGLKKSGIECLKGNAGLFCWMNLSPFLDEPTRECELTLWDSMLHEVKLNISPGSSCHCSEPGWFRVCFANMSEQTLGIALTRIHNFMEKRERAC

SEQ ID NO: 8066 - protein, 154 aa, Quercus suber
MALSLFGGRRSNVFDPFSLDIWDPFEGFSAVASVPPSARETTAFATARIDWKETPEAHIFKADLPGLKKEEVKVEVEDGNVLQISGERSKEHEEKNDKWHRVERSCGKFMRRFRLPENAKVDQVKANMENGVLTVMVPKEEQKKPAVKAIEISG

SEQ ID NO: 8067 - protein, 547 aa, Escherichia coli
AAKDVKFGNDAGVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTVAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATAVVNTIRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 8068 - protein, 353 aa, Oryza sativa
ESLVRAGELSWEVGMERYEVIKDIGSGNFGVAKLVRDVRTKELFAVKFIERGQKIDENVQREIMNHRSLRHPNIVRFKEVVLTPTHLAIVMEYAAGGELFERICSAGRFSEDEARFFFQQLISGVSYCHSMQICHRDLKLENTLLDGSIAPRLKICDFGYSKSSLLHSQPKSTVGTPAYIAPEVLARKEYDGKVADVWSCGVTLYVMLVGAYPFEDPDEPRNFRKTITRILSVQYMVPDYVRVSMECRHLLSRIFVANPEQRITIPEIKNHPWFLKNLPIEMTDEYQMSVQMNDINTPSQGLEEIMAIIQEARKPGDGSKFSGQIPGLGSMELDDVDTDDIDVEDSGDFVCAL

SEQ ID NO: 8069 - protein, 546 aa, Brucella suis
MAAKDVKFGRTAREKMLRGVDILADAVKVTLGPKGRNVVIDKSFGAPRITKDGVSVAKEVELEDKFENMGAQMLREVASKTNDTAGDGTTTATVLGQAIVQEGAKAVAAGMNPMDLKRGIDLAVNEVVAELLKKAKKINTSEEVAQVGTISANGEAEIGKMIAEAMQKVGNEGVITVEEAKTAETELEVVEGMQFDRGYLSPYFVTNPEKMVADLEDAYILLHEKKLSNLQALLPVLEAVVQTSKPLLIIAEDVEGEALATLVVNKLRGGLKIAAVKAPGFGDRRKAMLEDIAILTGGQVISEDLGIKLESVTLDMLGRAKKVSISKENTTIVDGAGQKAEIDARVGQIKQQIEETTSDYDREKLQERLAKLAGGVAVIRVGGATEVEVKEKKDRVDDALNATRAAVEEGIVAGGGTALLRASTKITAKGVNADQEAGINIVRRAIQAPARQITTNAGEEASVIVGKILENTSETFGYNTANGEYGDLISLGIVDPVKVVRTALQNAASVAGLLITTEAMIAELPKKDAAPAGMPGGMGGMGGMDF

SEQ ID NO: 8070 - protein, 337 aa, Yersinia pestis
MKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVTAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 8071 - protein, 242 aa, Syringa vulgaris
  misc_feature (188)..(188): Xaa can be any naturally occurring amino acid
LVQLRRMENKINRQVTFSKRRNGLLKKAYELSVLCDAEVGLIIFSSRGKLYEFGSAGMTATLERYQRCCFNPQNAGAGAERETQSWYQEVSKLKAKYESLQRTQRHLLGEDLGPLNVKELENLEKQLEGSLSQARQRKTKIMMEQMEDLRRKERQLGEMNKQLKIRVSLELSSHETEGQGLRGFPCQXNAAASAGTSNFMAQPGTNPMEFEPEPVLQMGYHHYNLGEGPLFQDHGYRSFDLF

SEQ ID NO: 8072 - protein, 169 aa, Brassica napus
  misc_feature (12)..(12): Xaa can be any naturally occurring amino acid
  misc_feature (139)..(139): Xaa can be any naturally occurring amino acid
RPRVRDRIGVCXGVFRTDKIKDEDIVKLVDQFPGQSIDFFGALRARVYDDEVRKFVEGLGVEKIGKRLVNSREGPPKFEQPEMTLDKLMEYGNMLVMEQENVKRVQLADQYLNEAALGDANADAIGRGTFYGKAAQQVXLPVPEGCTDPAAKNFDPTARSDDGTCVYTF

SEQ ID NO: 8073 - protein, 203 aa, Tradescantia virginiana
  misc_feature (199)..(199): Xaa can be any naturally occurring amino acid
LCDAEVGVIIFSNRGKLYEFCSGPSMMKTLERYEKSCFAGPDQNTQVKENQLVHSSRQEYLKLKARLDTLQRSQRNLLGEDLGSLSVKELDYLEKQLEMSLTEVRSTRTQQMLDQLTDLQRRESQLCDANKFLRKRLEELYQANGEQVWQIVPICHLTRHKTLRHVFFHPLECPPPTLQIGYDQSEQMPGPSVSNFMPXWMLC

SEQ ID NO: 8074 - protein, 727 aa, Xanthomonas campestris
MTYNVSASLKAGLLALVLTTPMALLARADTALPAAATPEQATATKLVYGLLSDSRYAYRPRTLDEAMSKDVFKRYLETLDGGKQFFTQADVDAFAPLQAGVGDALRGGNLEPAFQVFSVYKKRVDQRVKYARELLKQDFDFTGSEKFEYDRKDVPWAADDKQLDVLWRQSVMNDWLRLKLAGKKSDDIRKTLDKRYATLADSVNELKGEDAFQFFLNAYTNAVDPHTDYFTPRTAETFNQQMSLSLEGIGAQLQKQDDMVVIREVIPGGPAAVDGTLKPGDRIVGVGQAKSGAIEDVIGWRIDDVVAKIRGSKDTQVRLEYIPAELGIDGTHRTVTLTRQKVRLAEQAAKGETITLPASGDVPQRRIGIIKLPGFYQDFEGRRRNAADYASATRDVAKLLAGFKSDKVDGVVLDLRNNGGGSLDEAIELTGLFIEQGPVVQVRESGGRVTVNGDSNPKVAWDGPLGVLINRGSASASEIFAGAIQDYGRGLVIGETTFGKGTVQNIVDLDRWPAAEGQRYGQVKLTIAQFFRVSGSSTQHKGVVPDIAFPASVDATEFGESTYDNALPWTRIAAVPHTQYGNFAPLLPKLQTLHATRIASDKEFQWWEEDVKQFRDEKAKKYISLNEAERVAERQKQDQQRKDRQQVRKQLGLPLDPLADDSDDGLTGNERDIVKDTAREKAAEKRPDPLLHESAAILADALGLLSKDQPLSAQVLPQSTAPGRWAD

SEQ ID NO: 8075 - protein, 241 aa, Tradescantia virginiana
  misc_feature (228)..(228): Xaa can be any naturally occurring amino acid
VQLKRMENKINRQVTFSKRRGGLLKKAHEISILCDAEIALIIFSTKGKLYEYATNSKMDNILERYERYSYAEKALTSSDPDIQGNWCQEYAKLKSKVEALCKSQRHLMGEQLETLNLKELQQLEQQLEGSLKHVRSRKTQVMLDSISELQRKEKSLEEQNKNLEKEILEKQKIKALAQQAHWEHQNQPAPRGSPPRPFVIAESHPTLNIGHFQGRTNAVEAEENQQPXMRICSSLLPPWML

SEQ ID NO: 8076 - protein, 222 aa, Tradescantia virginiana
  misc_feature (11)..(11): Xaa can be any naturally occurring amino acid
  misc_feature (218)..(218): Xaa can be any naturally occurring amino acid
  misc_feature (221)..(221): Xaa can be any naturally occurring amino acid
GLVKKAHEISXLCDAEVALIIFSTKGKLYEYATDSKMENILERYERYSYAEKALTSSDPELQGNWCQEYVKLKAKVEALHKSQRHLMGEQLEALDLKELQQLEHQLEGSLRLVRSRKTQMMLDSISELQRKEKSLEEQNKNLEKEILEKQKEKALAHQAHWEQQNQPLQSTNSPPRPFVIAETHPTLNIGNFQGRTNTVHAEESLQRQMRISSSLLPXWMXH

SEQ ID NO: 8077 - protein, 525 aa, Sandersonia aurantiaca
MCGILAVLGCSDDSQAKRVRVLELSRRLKHRGPDWSGLDHHGDCYLAHQRLAIIDPASGDQPLYNEDKTIIVTVNGEIYNHEELRKGLPGHTFRTGSDCEVIAHLYEEHGESFIHMLDGIFSFVLLDSRNNSFVAARDAIGVTPLYIGWGLDGSVWISSEMKGLNDDCEHFKFFPPGHLYSSKEGSFKRWYNPPWFSEVIPSVPFDPLALRKAFEDAVIKRLMTDVPFGVLLSGGLDSSLVASVTARYLEGTKAAELWGTQLHSFCVGLEGSPDLKAAKEVANFLGTIHHEFHFTVQDGIDAIEDVIYHVETYDVTTIRASTPMFLMSRKIKSLGVKMVISGEGSDEIFGGYLYFHKAPNKEELHLETCHKIKALHQYDCLRANKATSAWGLEARVPFLDKEFVNVAMSIDPEWKMIKPDIGRIEKWILRRAFDDEENPYLPKHILYRQKEQFSDGVGYSWIDGLKAHSALHVTDKMMLNAAHIYPHNTPTTKEAYYYRMIFERFFPQIDSPWRSKCGLQHSKSY

SEQ ID NO: 8078 - protein, 370 aa, Triticum aestivum
MSNAASATPLLAPYKMGKFDLSHRVVLAPLTRERSFGNVPQPHAVLYYQQRATKGGLLIAEATGVSDTAQGYKDTPGIWTKKQVEAWKPIVDGVHAKGGIFFCQIWHVGRVSNHAFQPNGQAPISSTDKPIKPATRADGIGLAKVSTPRRLETDEIPLVIDDFRVAARNAIEAGFDGVEIHGAHGYLIDQFLKDQVNDRTDKYGGSLENRCRFALEVVQAVADEIGADKVGIRLSPFASYSEASDSNPEALGLYMAQALNKLGILYCHMVEPRMVNIGEKLETPHSLRPMRDAFKGTFIVAGGYGRDDGDKAIADGYADLVAYGRLFLSNPDLPRRFEMDGPLNKYNRDTFYLSDPVIGYTDYPFLPSDV

SEQ ID NO: 8079 - protein, 71 aa, Triticum aestivum
QFFFWVCGQVAFQIFSGMRLGNLYCDPLMVHGGHKITARQRWTPTQMQLQILESIFDQGNGTPSKQKIKDI

SEQ ID NO: 8080 - protein, 265 aa, Neurospora crassa
MHIKSIPMSGTGSSDNYAYLVVDDKSKDAVIIDPAHPEEVAPVLKKAIDDGSIKLTAIVNTHHHWDHAGGNTKLRTALGLPNLEIIGGKDCEKVNKVPAHGQGFNIGNIAVKALHTPCHTQDSICWFMQDGDDKVVFTGDTLFHGGCGRFFEGNGAEMHKALNETLASLPDETRVFYLTYPMKPGHEYTKSNAKFCMSVLQSEAVKALQAFAEKHRETQGKFTIGDEKKHNVFMRPHDPEIQKATGETDPVAIMTKLREMKNNFK

SEQ ID NO: 8081 - protein, 183 aa, Triticum aestivum
  misc_feature (105)..(105): Xaa can be any naturally occurring amino acid
  misc_feature (141)..(141): Xaa can be any naturally occurring amino acid
MATSSGPKEAPANNPGLQTEVDPATKGYFLQQTMLRVKDPKVSLDFYSRVMGMSLLKRLDFEEMKFSLYFLGYEDVTLAPDDHIKRTEWTFRQKATLELTHNWGXTENDPEFKGYHNGNSDPRGFGHIGVTVDDVHKACEXFERLGLICEEPDDGKSKALHRPDGTDSYLPDIGTSQHMMTGS

SEQ ID NO: 8082 - protein, 294 aa, Arabidopsis thaliana
MAAPIRFFELNTGAKLPCVGLGTYAMVATAIEQAIKIGYRHIDCASIYGNEKEIGGVLKKLIGDGFVKREELFITSKLWSNDHLPEDVPKALEKTLQDLQIDYVDLYLIHWPASLKKESLMPTPEMLTKPDITSTWKAMEALYDSGKARAIGVSNFSSKKLTDLLNVARVTPAVNQVECHPVWQQQGLHELCKSKGVHLSGYSPLGSQSKGEVRLKVLQNPIVTEVAEKLGKTTAQVALRWGLQTGHSVLPKSSSGARLKENLDVFDWSIPEDLFTKFSNIPQASSFIFLFFSR

SEQ ID NO: 8083 - protein, 290 aa, Arabidopsis thaliana
MAAPIRFFELNTGAKLPCVGLGTYAMVATAIEQAIKIGYRHIDCASIYGNEKEIGGVLKKLIGDGFVKREELFITSKLWSNDHLPEDVPKALEKTLQDLQIDYVDLYLIHWPASLKKESLMPTPEMLTKPDITSTWKAMEALYDSGKARAIGVSNFSSKKLTDLLNVARVTPAVNQVECHPVWQQQGLHELCKSKGVHLSGYSPLGSQSKGEVRLKVLQNPIVTEVAEKLGKTTAQVALRWGLQTGHSVLPKSSSGARLKENLDVFDWSIPEDLFTKFSNIPQAKVLPSY

SEQ ID NO: 8084 - protein, 122 aa, Brassica napus
MSLIPSFFGGRRTNVFDPFLLDLYDPFEGFLTPSGMTNAPSKDVAAFTNAKVDWRETPEAHVFKADLPGLKKEEVKVEVEDGHILQISGERSSENEEKSDKWHRVERSSGKFMRGVKLPENA

SEQ ID NO: 8085 - protein, 724 aa, Solibacter usitatus
MTGEEIEAIVNGYHGDAFGILGPHSVRKKNGNPRWEVRAFLPQADSAVVLAGTTRYDMEKRHTQGFFVAAMDGDSVPYVIRARLWDGREIEIVDPYRFGPQISDSDLYLHTEGTLNEAWRSLGAHLVTTEGASGVRFAVWAPNAENVTVAGEFNDWDVRRHPMRRRNGGVWELFIPGLTQGTAYKYNIRSRFAGYQQLKADPYAFYCEHPPKSASVVWGLDNYQWQDQEWMETRAAHDLLKSPMAVYEVHLGSWMRGPMGQVLTYRDLAVKLVEYVKQMGYTHVELLPPMEHPFSGSWGYQIIGYFAPTSRFGTPDDFKFFIDAFHRAGIGVIVDWVPAHFPKDAHGLVFFDGTALYEHADPRKGEQQDWGTLVFNYGRNEVRTFLISNALFWLKEMHIDGLRVDAVASMLYLDYSRKAGEWIPNQYGGNENLEAIDFLRQFNVVAHSVPGAFTVAEESTAFAGVSKPVYLNGLGFTMKWNMGWMHDMLDYFSNDPIYRKYHHNSITFSLLYAFTENFVLPVSHDEVVHGKGSLLNKMPGDEWRQFANARAFLAYMWVHPGKKLLFMGQEIGQREEWNHDQGIRWELLQFDLHRQLQSLMRELNRVYKANPALYEIDFHYTGFEWVDFHDGANSIIAFLRRAEDPDDFILVCCNFTPVPRQGYEFGVPEEGFYQEILNTDSEYFGGTNMGNGGCLSSRPIAKHNRSHSIAVTLPPLAVVAFKKC

SEQ ID NO: 8086 - protein, 223 aa, Glycine max
MSQESFIYSFVARGTMVLAEYTEFTGNFPAIAAQCLQKLPSSNNKFTYNCDHHTFNFLVEDGYAYCVVAKESVSKQISIAFLERVKADFKKRYGGGKADTAIAKSLNKEFGPVMKEHMKYIIDHAEEIVKLIKVKAQVSEVKSIMLENIDKALDRGENLTILADKTEALRSHAQDFRKQGTQVRRKMWYQNMKIKLVVLGILLVLVLVIWLSICGGFDCTNWQ

SEQ ID NO: 8087 - protein, 547 aa, Pseudomonas syringae
MAAKEVKFGDSGRKKMLAGVNVLADAVKATLGPKGRNVIIEKSFGAPLITKDGVSVAKEIELKDRFENMGAQLVKDVASRANDDAGDGTTTATVLAQAIVNEGLKAVAAGMNPMDLKRGIDKATIAIVAELKKLSKPCTDTKAIAQVGTISANSDHSIGDIIAEAMEKVTKDGVITVEEGSGLENELSVVEGMQFDRGYLSPYFINKPDTMVAELDSPLLLLVDKKISNIREMLPVLEAVAKAGRPLLIVAEDVEGEALATLVVNNMRGIVKVAAVKAPGFGDRRKAMLQDIAVLTGGTVISEEVGLSLETTTLEHLGNAKRVILNKENTTIIDGAGVKTDIDSRISQIRQQIGDTSSDYDKEKLQERLAKLSGGVAVIKVGAGSEVEMKEKKARVEDALHATRAAVEEGVVPGGGVALVRSLQAIEGLKGDNADQDVGIALLRRAVEAPLRQIVANSGDEPSVVVDKVKQGSGNFGYNAASGEYGDMIEMGILDPAKVTRSALQAASSIASLMITTEAMIADVPEDKPAGGGMPDMGGMGGMGGMM

SEQ ID NO: 8088 - protein, 546 aa, Burkholderia pseudomallei
MAAKDVVFGDSARAKMVEGVNILANAVKVTLGPKGRNVVLERSFGGPTVTKDGVSVAKEIELKDKLQNMGAQMVKEVASKTSDNAGDGTTTATVLAQSIVREGMKYVASGMNPMDLKRGIDKAVAAAVEELKKISKPCTTNKEIAQVGAISANSDSSIGDRIAEAMDKVGKEGVITVEDGKSLADELDVVEGMQFDRGYLSPYFINNPDKQVAVLENPFVLLHDKKVSNIRDLLPVLEQVAKAGRPLLIIAEDVEGEALATLVVNNIRGILKTVAVKAPGFGDRRKAMLEDIAILTGGQVIAEETGLTLEKATLAELGQAKRIEVGKENTTIIDGAGEAVNIEARVKQIRTQIEEATSDYDREKLQERVAKLAGGVAVIKVGAATEVEMKEKKARVEDALHATRAAVEEGIVPGGGVALIRARTAIAGLTGVNADQNAGIKIVLRAMEEPLRQIVTNGGEEASVVVAAVAAGKGNYGYNAATGEYVDMVEAGVVDPTKVTRTALQNAASVAGLLLTTDAAVAELPKEDAPMPGGMPGGMGGMGMDM

SEQ ID NO: 8089 - protein, 473 aa, Pyrus pyrifolia
MRMLSRNATFNSHGQDSSYFLGWQEYEKNPYHEVHNTNGIIQMGLAENQLCFDLLESWLAKNPEAAAFKKNGESIFAELALFQDYHGLPAFKKAMVDFMAEIRGNKVTFDPNHLVLTAGATSANETFIFCLADPGEAFLIPTPYYPGFDRDLKWRTGVEIVPIHCTNSNGFQITETALEEAYQEAEKCNLRVKGVLVTNPSNPLGTTMTRNELYLLLSFVEDKGIHLISDEIYSGTAFSSPSFISVMEVLKDRNCDENFEVWQRVHVVYSLSKDLGLPGFRVGAIYSNDDMVVAAATKMSSFGLVSSQTQHLLSAMLSDKKLTKNYIAENHKRLKQRQKNLVSGLQKAGISCLNGNAGLFCWVDMRHLLRSNTFEAEMELWKKIVYEVHLNISPGSSCHCTEPGWFRVCFANLPERTLDLAMQRLKAFVGEYYNVPEVNGRSQSSHLSHSRGQSLTKWVSRLSFDDRCPIHGR

SEQ ID NO: 8090 - protein, 691 aa, Yarrowia lipolytica
MTLQVCKDDPWLKPFEEELLRRQALVGQWKDHFAKEGGLAEFAASYKRYGLHVNKDNSVTYREWAPGASEAVLTGDFNGWDRQQYHMTRDEYGLWSVTVPPTSDGQVAIPHNSKVKLALKTSNGQWVDRLPAWSTYVVQDLSKSPIYEAVFWNPPESEKYQWKNKSPPTPANAQIYEAHVGISSSEPRVGTYKEFTKNILPRIHKLGYNVIQLMAIMEHAYYASFGYQVTSFYAISSRYGTPEDLKELIDTAHGMGITVLLDVVHSHACKNVDDGLNNFDGTDHQYFHGGAKGDHPQWDSKLFDYGKYEVLRFLLSNLRFYIEEYHFDGFRFDGVTSMLYKHHGLGTGFSGGYHEYFGDEHVDQQAVVYLMLAHELMRELQPLLRPGEDAGNFLSIAEDVSGMPALCRPVSEGGVGFDYRLAMAIPDMWIKLVKETRDEDWDMGNIVFTLTNRRHREKTIAYAESHDQALVGDKTLAFWLMDKEMYTSMSVLSDPNPIIDRGIALHKMIRLITHSLGGEGYLNFEGNEFGHPEWLDFPREGNGSSFHYCRRQWPVVDDKLLRYQHLNEFDAAMQHRGDHYGWLSADQAYVSLKNEDDKVVVYERAGLVFVFNFHPNKSFTDYRIGVDQPGTYTLVLDSDSPEFGGFGRIDHEKTRCHTEPLEWNGRANCMHIYIPSRVALVFAREDDPRRK

SEQ ID NO: 8091 - protein, 372 aa, Ralstonia metallidurans
MTSTSNPLFQPYSLGPLSLPNRIVMPPMTRSRASQPGDVPNALMAEYYAQRASAGLIVSEGTWISPLGRGYAWTPGIHTPEQVAGWRKVTTAVHQAGGRIFAQLWHVGRLSHISLLDGHAPVSSSAIQAQGVNVFVAQSDGKPGFAQASQPRALSVEEIHAIVDDFRQAARNAMAAGFDGVELHAANGYLVNQFIDSGANDRTDEYGGSLENRLRFLGEVAQALIEGTGGKDRVGIRLAPLTTLNGCVDADPETTYTAAARLLGEIGVGYIHIAEADWEDAPHMPTAFKQQLRKVYPGTLIYAGKYTAARAQAALHEGWADLIAFGRPFVANPDLPERLRTGATLNAHDRDTLFGGDARGLTDYPPLVAKAA

SEQ ID NO: 8092 - protein, 447 aa, Arabidopsis thaliana
MDSSNVEENLNPETKSAEEQNPLAIFHSSLPIASLSLTLFPSSTQFLKLFAHHPNKVKIPTQASSLTHLSLSSVSPFPSSRISFKSTIAANPLQSPLSIVPRRPVDPSSAAALRRAAVVWFRNDLRVHDNECLNSANDECVSVLPVYCFDPRDYGKSSSGFDKTGPFRAQFLIESVSELRKNLQARGSNLVVRVGKPEAVLVELAKEIGADAVYAHREVSHDEVKAEGKIETAMKEEGVEVKYFWGSTLYHLDDLPFKIEDLPSNYGAFKDKVQKLEIRKTIAALDQLKSLPSRGDVELGDIPSLLDLGISPTPRTSQEGKPTMVGGETEALTRLKSFAADCQARLSKGNQKGGNNSVFGANFSCKISPWLAMGSISPRSMFDELKKTISASTTSTTPRNGPGDTGLNWLMYELLWRDFFRFITKKYSSAKTQVEAGPATACTGAFA

SEQ ID NO: 8093 - protein, 235 aa, Tradescantia virginiana
VQLKRMENKINRQVTFSKRRTGLLKKAHEISVLCDAEVGLIIFSTKGKLYEYSTDNSMAKILERYDRYATAERAVLEANLNLEVGSHYEYRKIKAKVDALQKSQRHLMGEQLDTMTNKELQQLEQQLETALKHIRSRKNQMMLESVAALQKKEKALREQKSILEKKLIEKQKDMEISQIHQYQAHEDNTSPTSLVLTNSLPTTLNTNGCITHAIEEEHAPTLPHTNNNNLPPWMV

SEQ ID NO: 8094 - protein, 201 aa, Aspergillus niger
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMEDKKVVEYTVAKEFADSLGIPFLETSAKNASNVEQAFLTMARQIKERMGTATVNNKPTVQVGQGQGVQSGSAGGCC

SEQ ID NO: 8095 - protein, 345 aa, Sulfolobus solfataricus
MIFKIIHLMIEIDGSFGEGGGQILRTSLTLSVITGKPFRIFNIRANRPNPGLQRQHLWAVRAMKMISNAETKGDEVGSKELTFIPHEIKGNSIIDIDIGTAGSVTLIMQTMIPAIINKNMRIKIKGGTDVPKSPTIDYIRLVYLEILRKIGIESKVNLIKRGHYPEGGGEVIIENVNGNPSDFSLLELGKLIMIKGISHVSSLPSHIAERQKDSAKAILSKLGVQIEIETDVRQGEVSKGSGIALAAIGEKSIIGADSLGERGKRAEIVGEEAARKLIDNLNTKAAVDVHMSDMLMIFTSLFGGEYIGAELTSHAYTNMEIIRKFLDVKIEISGKRPFRFKAKIF

SEQ ID NO: 8096 - protein, 205 aa, Gibberella zeae
MSSRKKVLLKVIILGDSGVGKTSLMNQYVNKKFSASYKATIGADFLTREVLVDDRQVTMQLWDTAGQERFQSLGVAFYRGADCCVLVYDVNNAKSFEALDSWRDEFLIQASPRDPPNFPFVVLGNKIDVEESKRVISNKRAMTFCQSKGDIPYFETSAKEAINIDQAFEVIARNALAQEESEEFSGDFDDPINIHIENDRDGCAC

SEQ ID NO: 8097 - protein, 500 aa, Triticum aestivum
MDAAGRDANPLAGYRIGKTLGIGSFGKVKIAEHIITGHKVAIKILNRRKIKSMEMEEKVKREIKILRLFMHPHIIRLYEVIDTPADIYVVMEYVKSGELFDYIVEKGRLQEEEARRFFQQIISGVEYCHRNMVVHRDLKPENLLLDSKCNVKIADFGLSNVMRDGHFLKTSCGSPNYAAPEVISGKLYAGPEVDVWSCGVILYALLCGTLPFDDENIPNLFKKIKGGIYTLPSHLSPLARDLIPRMLVVDPMKRITIREIREHSWFKARLPRYLAVPPPDTAQQVKKLDDETLNDVIKMGFDKNQLTESLQKRLQNEATVAYYLLLDNKLRTTSGYLGAEYQESMDSSFSQVSPETPSSASEARQYGSPGFGLRHHFAAERKWALGLQSRAHPREIITEVLKALQELNVCWKKIGHYNMKCRWSPGFVETMMHNNNGFGVESAIIEADGLSDKSTHIVKFEIQLYKTRDEKYLLDLQRVSGPQLLFLDLCSAFLTQLRVL

SEQ ID NO: 8098 - protein, 226 aa, Paeonia suffruticosa
SQVTFSKRRGGLLKKAHEISVLCDAEVALIVFSTKGKLFEYSTDSSMEKILDRYEQYSIAERQLVEEPGSQGNWSLEYSKLRAKIELLQRNQRRFMGEDLDSLSPKDLQNMEQQLDVSLKNIRSRKNQLMYESISELQKKERAIQEQNNLLAKQIKEKEKTMAQQAQWEQQIHHGPNASAYLLSPHELTTLNMGGNYQGEPTEMRRNELDLTLEPIYTCHLGCFGA

SEQ ID NO: 8099 - protein, 429 aa, Unknown
  Malus x domestica
MLSRNATFNSHGQDSSYFLGWQEYEKNPYHEVHNTNGIIQMGLAENQLCFDLLESWLAKNPEAAAFKKNGESIFAELALFQDYHGLPAFKKAMVDFMAEIRGNKVTFDPNHLVLTAGATSANETFIFCLADPGEAVLIPTPYYPGFDRDLKWRTGVEIVPIHCTSSNGFQITETALEEAYQEAEKRNLRVKGVLVTNPSNPLGTTMTRNELYLLLSFVEDKGIHLISDEIYSGTAFSSPSFISVMEVLKDRNCDENSEVWQRVHVVYSLSKDLGLPGFRVGAIYSNDDMVVAAATKMSSFGLVSSQTQHLLSAMLSDKKLTKNYIAENHKRLKQRQKKLVSGLQKSGISCLNGNAGLFCWVDMRHLLRSNTFEAEMELWKKIVYEVHLNISPGSSCHCTEPGWFRVCFANLPERTLDLAMQRLKAFVGE

SEQ ID NO: 8100 - protein, 253 aa, Cytophaga hutchinsonii
MTGTAWPIIIFFVAHWYLSLFSQTFFLHRYSAHAMFKMNKFWEKFFFIFLYLTQGSSYLVPRAYGALHRMHHAYSDTEKDPHSPLYSRNAFVMMWKTKDIYNAVLRREAQVEDKFNKNLPEWAFIDNIGDMWISRIIWGTLYVLFYIYFVPADMWYLYLLLPIHFLMGPVHGAIVNWFGHKLGYQNFDNKDASRNTLALDVLLGGELFQNNHHMYGSRPNFAMKWFEFDPTYPVIKVLHYVRIIRLVNPDAKA

SEQ ID NO: 8101 - protein, 355 aa, Craterostigma plantagineum
MEKYELVKDIGSGNFGVARLMRNKETKELVAMKYIERGHKIDENVAREIINHRSLRHPNIIRFKEVVLTPTHLAIVMEYAAGGELFERICNAGRFSEDEARYFFQQLICGVHYCHALQICHRDLKLENTLLDGSPAPRLKSCDFGYSKSSLLHSRPKSTVGTPAYIAPEVLSRREYDGKLADVWSCGVTLYVMLVGAYPFEDQEDPFFFRKTILWIMAVQYKIPDYVRISQSCRHLLSRIFVANPLRRITIKEIKSHLWFLKNLPRELTEVAQAAYFRRDNPTYSLQSEEEIMKIVEEAKVPPQASRSIGGFGWGTEEDEENVEEEEEGESEGEEDEYEKQVKAAHASGEVPPLT

SEQ ID NO: 8102 - protein, 582 aa, Schizosaccharomyces pombe
MVSFLSSSVSRLPLRIAGRRIPGRFAVPQVRTYAKDLKFGVDARASLLTGVDTLARAVSVTLGPKGRNVLIDQPFGSPKITKDGVTVARSVSLKDKFENLGARLVQDVASKTNEVAGDGTTTATVLTRAIFSETVRNVAAGCNPMDLRRGIQLAVDNVVEFLQANKRDITTSEEISQVATISANGDTHIGELLAKAMERVGKEGVITVKEGRTISDELEVTEGMKFDRGYISPYFITDVKSQKVEFENPLILLSEKKVSAVQDILPSLELAAQQRRPLVIIAEDVDGEALAACILNKLRGQLQVVAIKAPGFGDNRRNMLGDLAVLTDSAVFNDEIDVSIEKAQPHHLGSCGSVTVTKEDTIIMKGAGDHVKVNDRCEQIRGVMADPNLTEYEKEKLQERLAKLSGGIAVIKVGGSSEVEVNEKKDRIVDALNAVKAAVSEGVLPGAGTSFVKASLRLGDIPTNNFDQKLGVEIVRKAITRPAQTILENAGLEGNLIVGKLKELYGKEFNIGYDIAKDRFVDLNEIGVLDPLKVVRTGLVDASGVASLMGTTECAIVDAPEESKAPAGPPGMGGMGGMPGMM

SEQ ID NO: 8103 - protein, 359 aa, Hydrogenophilus thermoluteolus
MSWAHTPTLTQYLIEERRRYPQASGDFNALILDMARACKAIARQVAYGALAKSNHAVTTTINVQGEEQKPLDVISNECFMRLTEWGGYLAAMASEEMDEPYLIPEQYPRGRYLLLFDPLDGSSNIDVNVSVGSIFSVLRAPEGKTEITVDDFLQPGTQQVAAGYAIYGPTTMLVLTVGRGVVGFTLDPDFGEFMLTHPNIRIPESTKEFAINTSNARFWEPPVKRYVDECLKGKTGPRGKDFNMRWVASLVAETHRILSRGGVFLYPRDNKEPKKPGRLRLLYECNPIGMIVEQAGGRASTGYGPVLEVQPTELHQRIGFVFGSREEVERIEQYHNDPDASPVDLPLFAERTLFRDETL

SEQ ID NO: 8104 - protein, 363 aa, Schizosaccharomyces pombe
MSTGQLKRFKGCEYLTHRLVLATLSGTPIRVEGIYPDEADPGVKDYQVSFLRLLEKLTNGSVIEISYTGTSFIYRPGNIIGGRVVHDCPTTKGIGYFLEPILILCLFAKTPTSLTLTGVTSSNEDIGVDVLRTSVLPSLQKRFQVGDELELRILKRGSAPGGGGEVNFLCPVIKESLPPIRLSEFGRVFRIRGIASSTRVSPAFANRLVESARGVLNPFIPDVFIYTDVRRGDECGNSPGYSITLVAETNKGCSYAAEHCGEAGETPEDVGSFCAKKLLEVIESGGCVDPYTQPSTLTGMLLSSEDVNTIVVGQLGITSQLVVFLRDVKALFNCEYRFKELESGQVEMSCLGKGYLNVNRRIQ

SEQ ID NO: 8105 - protein, 255 aa, Daucus carota
MSFVDDQSGDLSLHERKSGRGKIEIKRIENTTNRQVTFCKRRNGLLKKAYELSVLCDAEVALIVFSNRGRLYEYANNSVRGTIERYKKANSDTPNTATVSEANTQYYQKEAARLRQQISNLQNSNRHLMGEALGAVPAKELKGLETKLQNGLSRVRSKKNELLFAEIEFMRKREIDLHNNNQYLRAKISENERAQQQMSLMPGASGSSEQYRDVGQPHESFDARNYLQVNGLQPNNANYSSHQDHQTQHVPLQLV

SEQ ID NO: 8106 - protein, 540 aa, Bradyrhizobium japonicum
MAAKEVKFSTDARDRVLRGVDTLANAVKVTLGPKGRNVVIEKSFGAPRITKDGVTVAKEIELEDKFENMGAQMVREVASKTSDLAGDGTTTATVLAQAIVKEGAKSVAAGMNPMDLKRGIDLAVEAIVNDLKAHAKKVTTNEEIAQIATISANGDIEIGRFLADAMQKVGNDGVITVEEAKSLDTELEVVEGMQFDRGYASPYFVTNAEKMRVEFEDPYILIHEKKLSTLQSMLPLLEAVVQSGKPLLVVAEDVEGEALATLVVNRLRGGLKVAAVKAPGFGDRRKAMLEDIAILTGGQAISEDLGIKLENVTLKMLGRAKKVVIDKENTTIVNGAGSKKDIEARVTQIKMQIEETTSDYDREKLQERLAKLAGGVAVIRVGGATEVEVKERKDRVDDAMHATRAAVEEGILPGGGVALLRGLKALDAIKTVNADQKAGVDIVRRAIQVPARQIVQNAGEDGSLVVGKLLENSSYNWGFNAASGEYQDLAKAGVIDPAKVVRTALQDAASVAALLITTEALIAEKPKKSEPAPAAPPMDF

SEQ ID NO: 8107 - protein, 484 aa, Proteus mirabilis
  misc_feature (53)..(53): Xaa can be any naturally occurring amino acid
MEKKKLTTAAGAPVVDNNNVITAGPRGPMLLQDVWFLEKLAHFDREVIPERRXHAKGSGAFGTFTVTHDITKYTRAKIFSEVGKKTEMFARFSTVAGERGAADAERDIRGFALKFYTEEGNWDMVGNNTPVFYLRDPLKFPDLNHIVKRDPRTNMRNMAYKWDFFSHLPESLHQLTIDMSDRGLPLSYRFVHGYGSHTYSFINKDNERFWVKFHFRCQQGIKNLMDDEAEALVGKDRESSQRDLFEAIERGDYPRWKLQIQIMPEKEASTVPYNPFDLTKVWPHADYPLMDVGYFELNRNPDNYFSDVEQAAFSPANIVPGISFSPDKMLQGRLFSYGDAHRYRLGVNHHQIPVNAPKCPFHNYHRDGAMRVDGNSGNGITYEPNSGGVFQEQPDFKEPPLSIEGAADHWNHREDEDYFSQPRALYELLSDDEHQRMFARIAGELSQASKETQQRQIDLFTKVHPEYGAGVEKAIKVLEGKDAK

SEQ ID NO: 8108 - protein, 283 aa, Nocardia farcinica
MTFRSETSAVPSIVLNDGNVIPQLGFGVFQVPPDDVFDVVTTALRAGYRSIDTAAVYGNEEGTGRAIRAFGLPRDEVYVTTKLWNSEQGYDSTLRAFDDSMSKLGLDYLDLYLIHWPVAAAGKFVDTFRAFQELKRQGRVRSIGVSNFTVDNLRTLIAETGEIPAVNQIELHPALAQRELREFHAENAIATEAWSPLGQGTLLEDATITRIAQEVGRTPAQVIIRWHLQLGNVVIPKSVTPARIEANFDVFGFELSREQMAAIDGLDRGGRIGPDPDTFSAGL

SEQ ID NO: 8109 - protein, 847 aa, Aspergillus nidulans
MASNILQIPFRRSHTVSLSTALTQYISTKYDQRPDMFADDLLIIDRLRNEAINVQEPHVSGISRLVTYAAQLKWLGGKFPVDVGVEFPWYPAFGFNTSRPVSQDNIRFELANVIFNLAALYSQLAFAVNRTTTDGLKQACNYFCQAAGILAHLRTDIVPDMRSAPPEDMDEMTLRSLEELLLAQAQECFWQKAVMDGLKDASIARLAGQVSDFYGDACDHAVKSNAISPEWIHHMTAKQHHFAAAAQYRQSLDCLEKRKYGEEVARLRDAVACVNEALKESRWINRTVLGDLQGLKNRVTEDLKRAEKDNDMIYLNPVPPKSELKLIDRACMVAAKAPSQVTDAISMLGEKGPLGQPLFSKLVPYAVHIAASIYSDRRDRLVNERIIGELENMTDKLRDLLSSLNLPGSLQALEKPLGLPPSLVAHAEEMRQQDGLNRLRKSLLDIAKVKSNDRAVYTEGVELLAAEKAEDDASRRKFGTDRWTREASEAAAPKLYTTAREIDGYFTSAQSSDNLVEQKLHDSEAVFRVLTGTNRDLEAFVPSSRRATIPPEVEREVSRLRSCISEVNRLESRRKRKAQAVKDKARADDISSALVREAARLEREFPMQAIQASQFEDLFESRLRDYDVDLDMVAQEMHDQDQIVAQVRDANRAFTRAHTGDASTKEREKALQELENGYLKYKEIISNIEVGRKFYNDLAKIVGRFRDDVKAFVHKRRMEASQLEQDISSVAAMASLNISPIRQPPQQTVVSAPVSVSAAASVPAPTHFNPVKPQPQPPSQAIPPQSQPQPQPQPLRTPLTAPQPTRSVPQVTPGMWSPEMGIRFGPGGTTAQQSQQTWDPSKGMKFS

SEQ ID NO: 8110 - protein, 585 aa, Raphanus sativus
MCGILAVLGCSDDSQAKRVRVLELSRRLRHRGPDWSGIYQNGGNYLAHQRLAIIDPASGDQPLFNEDKSIVVTVNGEIYNHEELRKGLKNHKFHTGSDCDVIAHLYEEHGENFVDMLDGIFSFVLLDTRDNSFMVARDAVGVTSLYIGWGLDGSLWVSSEMKGLHEDCEHFEAFPPGHLYSSKSGGGFKQWYNPPWFNESVPSTPYEPLAIRRAFEDAVIKRLMTDVPFGVLLSGGLDSSLVASITARHLAGTKAAKRWGPQLHSFCVGLEGSPDLKAGKEVAEYLGTVHHEFHFTVQDGIDAIEDVIYHVETYDVTTIRASTPMFLMSRKIKSLGVKMVLSGEGSDEIFGGYLYFHKAPNKQEFHQETCRKIKALHKYDCLRANKATSAFGLEARVPFLDKEFINTAMSLDPESKMIKPEEGRIEKWVLRRAFDDEERPYLPKHILYRQKEQFSDGVGYSWIDGLKAHAAENVNDKMMSNAAYIFPHNTPLTKEAYYYRMIFERFFPQNSARLTVPGGATVACSTAKAVEWDASWSNNMDPSGRAAIGVHLSAYDGSKVALPLPPHKAIDDMPMMMGQEVVIQT

SEQ ID NO: 8111 - protein, 355 aa, Aspergillus nidulans
MTTNSTGNGGAVGQENINTDIVTLSRFFTEEQTKVPEATGDFTLLCHALQFSFKSIAYYIRRASLINLTGLAGSSNTTGDDQKKLDVIGNDLFVSAMRTSGKCRILVSEEEEEAIIFDEHPNARYAVVCDPIDGSSNLDAGVSVGTIFGIFRLPDDILGPGKKVTAKDVLLPGTEMVAAGFTMYGASAQLVITMKNGGVNGFTLENSLGEFILTHPNMKLPPSRAIYSVNEGNSMYWDDWCNAYFDSLKRPGEGKKPYSARYIGSMVADAYRTLLYGGVFAYPADSKSPKGKLRILYECAPMAMVFENAGGKAVNSRMERLLSVQPESIHDKSGVFLGSRDEVQKVIDTYNKYKK

SEQ ID NO: 8112 - protein, 473 aa, Claviceps purpurea
MASEVSVASSGSEHSGAQKCPFQDPGLSSMDQDSRLRDILSRFNREKIPERAVHARGAGAYGEFEVTHDVSDICDIDMLLGVGKKTPCVVRFSTTTLERGSAESVRDVKGMAIKHFTQDGNWDWVCLNIPMFFIRDPSKFPDMVHAQRPDPTTNVANPSRWWEFVCNNHETLHMVMFQFSDFGTMFDYRSMSGYAAHAYKWVMPDGSWKYVHWFLASDQGPNFETGHQAKQIGADDAESATRDLYQSLERGEYPSWTVKVQVVDPEDAPKLPFNILDVTKHWNLGNYPPDIDVIPGRTLGKLTLKKEPQDYFEEIEQLAFSPSRLVHGVEASEDPMLQARLFAYPDAQKHRLGPNNLDLPANRTKKFADGARPEKAEMAPQKVPSQEHADWVSQVKSSSWSEPNETDYKFPREFWKALPRLRGEAFQNSLVVNMAKSVSQVPVDMREKVYSTLALIADDLADRVRTMTEEIVE

SEQ ID NO: 8113 - protein, 1130 aa, Triticum aestivum
MSSSRAASSSSSRNRQSTQERVLAQTTLDAELNAEFEESSDSFDYSKLVEAQRDTPTVLQEGRSEKVIAYLQHIQRGKMIQSFGCLLALDEKSFNVIAFSENAPEMLTTVSHAVPSVDDPPRLDIGTNVRSLFTDQGAAALHKALGFADVSLLNPILVQCKTSGKPFYAIVHRATGCLVVDFEPVNPTEFPATAAGALQSYKLAAKAISKIQALPGGSMELLCNTVVKEVFDLTGYDRVMAYKFHEDNHGEVFAEITKPGLEPYLGLHYPATDIPQAARFLFMKNKVRLICDVRARPIKVIEDEALPFDISLCGSALRAAHSCHLQYMENMNSIASLVMAVVVNENEEDDEVGSEQPAQQQKKKILWGLIVCHHESPRYVPFPLRYACEFLAQVFAVHVNKEFEVQKQLREKSILRMQTILSDMLFKEASPLTIVSGAPNIMDLIKCDGAALLYGGKVWRLGTAPTESQIRDLALWLSEVHMDSTGLSTESLHDAGYPGASALGDTVCGMAVAKINSSDILFWFRSPTAKEIRWGGAKNDPSDMDDSRRMHPRLSFKAFLEVVKMKSLAWTDSEMDAIHSLQLILRGAVDGVVKPTGKASLDEQIGDLKLDGLAELQAVTSEMVRLMETATVPILAVDGNGLVNGWNQKAAELTGLRVDDAIGRHILTLVEESSVSVVQRMLYLALQGKEEKEVRFEVKTHGPKRDDGPVILVVNACASRDLHDDVVGVCFVAQDMTVHKLVMDKFTRVEGDYMAIIHNPNPLIPPIFGADESGWCCEWNAAMTKLTGWHREEVLDKMLLGEVFDSRNASCLLKNKDAFVSLCVVINSALAGEETEKAPFGFFDRSGKYTECLLSVNRRQNEGGLITGVFCFIHIPSHELQQALQVQQASEQKSLKRLKAFSYMRHAINNPLSGMLYSRKALKNTDLNEEQMRQIHVADNCHHQLNKILADLDQHNIMEKSSCLDLEMAEFVLQDVVVAAVSQVLIACQGKGIRVSCNLPERFMKQLVYGDGVRLQQILSDFLSISVKFSPVGSSVEISAKATKNSIGENLHLIDLELRIKHQGLGVPAELMAQMFEEDEPQQSEEGLGLLVSRNLLRLMNGDVRHLREAGVSIFILTAELACAPTAMEH

SEQ ID NO: 8114 - protein, 369 aa, Claviceps purpurea
MSTSNLFSTVPFGKNVLNHKIVLSPMTRFRADDNGVPLSYMKTFYAQRASVRGTLLVTDAVAICPRTKGFPNVPGIWHKDQIAAWKEVVDEVHSKGSFIWLQLWATGRAADLEALTSQGLKLESSSEVPVAPGEPTPRALDEDEIQQYILDYVQGAKNAVHGAGFDGVEIHGANGFLIDQFLQSSCNRRTDQWGGSIENRSRFGLEITRGVVDAVGHDRVGMKLSPWSTFQGMGTMDDLVPQFEHFITCLREMDIAYLHLANSRWVEEEDPSIRTHPDFHNQTFVQMWGKKRPILLAGGYDPDSARRLVDQTYSDRNNVLVVFGRHYISNPDLPFRLRMGIACRSTIETHSIFPARERAMWTIPSVKNI

SEQ ID NO: 8115 - protein, 86 aa, Arabidopsis thaliana
MYLFPCLHLPQKAIAAAEAEKTAPDNFYCKRLLKATGIVVVPGSGFRQVPGTWHFRCTILPQEDKIPAIVDRLTAFHQSFMDEFRD

SEQ ID NO: 8116 - protein, 494 aa, Zea mays
  misc_feature (205)..(205): Xaa can be any naturally occurring amino acid
MDPYKHRPSSAFNAPYWTTNSGAPVWNNDSSLTVGARGPILLEDYHLVEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGXSGVHTYTLVSRAGTVTYVKFHWRPTCGVRSLMDDEAVAVGGANHSHATKDLTDAIAAGNFPEWTLYIQTMDPEMEDRLDDLDPLDVTKTWPEDAFPLQPVGRLVLNRNIDNFFAENEQLAFCPGLIVPGIYYSDDKLLQTRIFSYSDTQRHRLGPNYLLLPANAPKCAHHNNHYDGFMNFMHRHEEVDYFPSRYDAARNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 8117 - protein, 807 aa, Triticum aestivum
FGCLLALDEKSFNVIAFSENAPEMLTTVSHAVPSVNDPPRLDIGTNVRSLFTDQGATALHKALGFADVSLLNPILVQCKTSGKPFYAIVHRATGCLVVDFEPVNPTEFPASAAGALQSYKLAAKAISKIQALPGGSIELLCNTVVKEVFELTGYDRVMAYKFHEDNHGEVFAEITKPGLEPYLGLHYPATDIPQAARFLFMKNKVRMICDVRSRSIKVIEDEALPFDISLCGSALRAAHSCHLQYMENMNSIASLVMAVVVNENEEDDEVGSEQPAQQQQKKILWGLVVCHHESPRYVPFPLRYACEFLAQVFAVHVNKEFEVQKQLREKSILRTQTILSDMLFKEASPLTIVSGAPNIMDLIKCDGAALLYGDKVWRLGNAPTESQIRDLALWLSEVHMDSTGLSTESLHDAGYPGASALGDSVCGMAVAKINSSDILFWFRSHTAQEIRWGGAKNDPSDQDDSRRMHPRLSFKAFLEVVKMKSLAWTDSEMDAIHSLQLILRGTVDGVVKPTGKASLDEQIGDLKLDGLAELQAVTSEMVRLMETATVPILAVDGNGLVNGWNQKAAELTGLRVDDAIGRHILTLVEESSVSVVQRMLYLALQGKEEKEVRFEVKTHGPKRDDGPVILVVNACASRDLHDDVVGVCFVAQDVTVHKLVMDKFTRVEGDYMAIIHNPNPLIPPIFGADEFGWCCEWNAAMTKLTGWHREEVLNKMLLGEVFDSSNASCLLKNKDAFVSLCVVINSALAGEETEKAPFGFFDRSGKYTDCLLSVNRRENEGGLITGVFCFIHIPSHELQQALQVQQA

SEQ ID NO: 8118 - protein, 585 aa, Hordeum vulgare
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPLYVGWGIDGSVWISSEMKGLNDDCEHFEIFPPGHLYSSKEGGFKRWYNPPWFSEVIPSVPYDPLALRKAFEKAVTKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSRKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWVLRKAFDDEEQPFLPKHILYRQKEQFSDGVGYSWIDGLKAHTESNVTDKMMSNAKFIYPHNTPTTKEAYCYRMIFERFFPQNSAILTVPGGPSVACSTAKAVEWDARWSGNLDPSGRAALGVHLSAYEQEHLPATIMAGTSKKPRMIKVAAPGVAIES

SEQ ID NO: 8119 - protein, 743 aa, Pseudomonas fluorescens
MSFSNKEQGKQQPALLPSAKAIDALVRAEHRDPFAILGPHGDGAGGQFIRAFLPGALSVQVLDRDQQQVLGSLQAGEVPGLFVGHFPEARPYLLRIQWAGGEQVSEDPYSFGPLLGEMDLYLFAEGNHRDLSSCLGAQLTTVDGIDGVRFAVWAPNARRVSVVGDFNIWDGRRHPMRLRHPSGVWELFIPRLQAGEAYKYEILGPQGILPLKADPMALATQLPPDTASRVAPPLTIDWQDQEWMLARGERQRVDAPLSIYELHAGSWQCEVDDLGEVARQYSWAELAERLIPYVKDLGFTHIELMPIMEHPFGGSWGYQPLSQFAPSARYGSPQDFAAFIDACHQAGIGVILDWVPAHFPTDTHGLAQFDGTALYEYGNPLEGFHQDWDTLIYNLGRTEVHGFMLASALHWLKHFHVDGLRVDAVASMLYRDYSRKAGEWVPNRHGGRENLEAIDFLRHLNDVVALEAPGALVIAEESTAWPGVSQRTDQGGLGFAYKWNMGWMHDSLHYIQQDPVYRAHHHNELSFGLVYAWSERFILPISHDEVVHGKHSLIDKMPGDRWQKFANLRAYLSFMWAHPGKKLLFMGCEFGQWREWNHDQQLDWYLLQYPEHRGVQQLVGDLNRLYRQYPPLHDQDDVPQGFQWLIGDDAINSVYAWLRWSKSGEPLLVVANFTPVPRQGYRVGVPVAGRWSELLNSDSQLYAGSNYGNGGEAFSEEQSSHGQALSLVLNLPPLAVLILRPDS

SEQ ID NO: 8120 - protein, 712 aa, Pseudomonas fluorescens
MSTKKPDTPKSQMAGTDTLDRGNSNSKLKSLETFRSDATGQALRTNQGVKIADNQNTLKAGARGPSLLEDFIMREKITHFDHERIPERIVHARGVGAHGYFQSYDNHSALTKAGFLRDPGKKTPVFVRFSTVQGPRGSGDTVRDVRGFAVKFFTDEGNFDLVGNNMPVFFIQDAIKFPDFVHAVKPEPHNEIPTGGSAHDTFWDFVSLQPESAHMVIWAMSDRAIPKSLRAMQGFGVHTFRLINAQGRSSFVKFHWRPTVGTCSLVWDEAQKLAGKDTDFHRRDLWESIEAGDYPEWEFGVQIIAEEDEHNFDFDILDPTKLIPEELVPITPLGKMVLNRNPDNYFAETEQVAFCPGHIVPGIDFSNDPLLQGRLFSYTDTQISRLGGPNFHELPINRPLAPFHNSQRDAMHRITLDKGRASYEPNSIDGGWPRETPPAAEDGGFESYNERIDAHKIRQRSESFSDHFSQARLFYKSMSKHEQEHIIAAYSFELGKVEREWIRERQVNEILANIDLQLAARVAENLGLAAPKKATVAERKTSLSRSPALSQANLLPGNIKTRKVAILAANGVDGAAIDALKKALKAEGAHAKLLGPTSAPVTTADGKSLPVDASMEGLPSVAFDAVFVPGGAQSIKALSGNGVALHYLLEAYKHLKAIALHGDARELLHSLRLEADEGLIVGADAKALKAFIAAIAQHRVWSREEKAKAIPA

SEQ ID NO: 8121 - protein, 146 aa, Oryza sativa
AISTTTAAYFSSQPQLPATAAAKSGGRQQQRRRSSFVMLEAAAASGSGGGGGGAVGRTRSLTEEDLEELKGCLDLGVGFAYHQIPELCGTLPALELCYSMTRRFLDDQRAPGQEPESPATPPLPNWRISGPGAPIAVLYRVGRGFG

SEQ ID NO: 8122 - protein, 246 aa, Daucus carota
MGRGKVELKRIENKINRQVTFAKRRNGLLKKAYELSVLCDAEVALIIFSNRGKLYEFCSTSSMNKTLGRYHRCSYGALETGQTDRDTQSSYQEYIKLKAKVEALQQSQRHLLGEELGQLGTKELEELERQLDSTLRQVRSTKTQYMLDQLSDLQQKEQELVEINKALRNKLEENDVRIQSQWEAAERNNVAYRSHPAEHPPDHGVFESLECNNTMHMGYNSAMNDHQMASATPTQNASGVIPGWML

SEQ ID NO: 8123 - protein, 488 aa, Unknown
  Synechocystis sp. PCC 6803
MGRQLILFPMSDQSDHPLILLWHRRDLRLNDHLALAKARQKTAKIVGVFCLDNKILQAEDMAPARVAYLLGCLQSLQDHYQRLGSELLVFQADPVQLLPKLANTLGAHGVTWTLDTEPYAQKRDLAVAQALRERGLAIATEWDQLMHHPGEVLTQAGSPYTVYTPFWKNWSQLPKTSPVPTPKDLQGLTPAEKEKLAPLEPLAIPQLADLGFIWDQPLPLTPGEEAAEQRLDWFVAHGLEEYQQNRNFPALDGTSQLSAALKFGVISPRTLWQTTLEAWEQSRSEEARASIETWQQELAWREFYQHCLYSFPALAQGPYRSPFQEFPWEENQDHFQAWCEGRTGYPIIDAAMAQLNQTGWMHNRCRMIVASFLIKDLILNWQWGELYFMQTLYDGDLAANNGGWQWSASSGMDPKPLRIFNPHTQAQKFDPEGEYIRTWLPQLARFDTGDLLTGKLTPGSRRSVNYPEPIVDHNQQQREFKRRYQLVK

SEQ ID NO: 8124 - protein, 409 aa, Unknown
  Frankia sp. EAN1pec
MWWLRRDLRLDDNPALLAAAESGRVLALFVLDDALRRPSGPVRLAFLHRCLRDLDAQLGGRLCVRTGSPYAVAPGRLRKADGTSYRVFTPFYRAWKEHGWRGPAIPADPVWLQPADLDGGSEPIPADPELGGTELPPAGEHAAHERLRAFLTESLAGYAAHRDEPAAASESGDAVPGWSGASRAGGAGGAGGAGGADAAGGGGGLAGSAEKFRSELAWREFYADVLAGTPSSARTDLTDTLAALAYEPPGDTFEAWKWGRTGYPIVDAGMRQLLAEGWVHNRVRMIEASFVCKDLNVHRTHGARWYLERLVDGDLASNNHGWQWTAGTGTDAAPYFRVFNPVSQGRKFDPAGEYIRRWVPELRGLPPDAVHEPWKLPAGPPNGYPRPVVDHAVERREALDRHARARHHD

SEQ ID NO: 8125 - protein, 369 aa, Festuca arundinacea
MVMMVDPPNGMGNHGKHYYTMWQTMFEIDTKYVPIKPIGRGAYGIVCSSINQETNEKVAIKKMNNVFDNRVDALRTLRELKLLRHLRHENVICLKDIMMPVHRRSFKDVYLVSELMDTDLHQIVKSLQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSDSDLEFIDNRKARNYIKSLPYTPGIPLSNMYPQVHPLAIDLLQKMLVFDPSKRISVIEALAHPYMSELYDPAANPPAQVPIDLDIDENIGVETIREMLWQEMLQYHPEAATMVNM

SEQ ID NO: 8126 - protein, 231 aa, Nicotiana benthamiana
MAPKEKGTAAGKVNGVSKEVHYRGVRKRPWGRYAAEIRDPGKKSRVWLGTFDTAEDAARAYDAAAREFRGTKAKTNFLVLEQENVKLANGNRSPSYSSTVENSPPVMPENSPPAVILDTSPLDLSLGGSGSLFSNGVGRFHMYYLEAVQREQVISSYKKSCRTTAEFIAGCGGGASGESDCRTTAEFIAGCGGGASGESDSSSVIDFMGHDLKPTTRPINLDLNLPPPENM

SEQ ID NO: 8127 - protein, 474 aa, Brassica oleracea
MDLLSRKATCNSHGQDSSYFLGWEEYEKNPHDVVKNPHGIIQMGLAENQLCFDLLESWLIQNPDAASFKRDGQSIFRELALFQDYNGLSSFKKALADFMSENRQNRVSFDSKNLVLTAGATSANETLMFCLANPGDAFLLPTPYYPGFDRDLKWRTGVEIVPIQCSSRNGFCITKLALEEAYEQAKKLNLNVKGVLITNPSNPLGTTATQTELNILFEFISKNKNIHLVSDEIYSGTAFSSSEFISVMEILKTNQLENTDVFKRVHIVYSLSKDLGLPGFRVGAIYSNDKDVISAATKMSSFGLVSSQTQYLLSSLLSDKKFTKNYLRENQRRLNNRQRMLVTGLEAIGIGCLKSNAGLFCWVDMRHLLSSKTFEAEMDLWKKIVYEVKLNISPGSSCHCEEPGWFRVCFANMSEETLKLAMKRLKKFVDNGTLSRSCQVGESQSLKSSRKKTTTTVSNWVFRLSFHDRDTEER

SEQ ID NO: 8128 - protein, 183 aa, Arabidopsis thaliana
LWSCDDLFLGVRKARRAVAEYLNGELPTKLKAEDVYITGGCNQAIEIVIDSLAGNPSANILLPRPGYPHYDARAVYSGLEIRKYDLLPESDWEINLDGLEAAADENTVAMVIINPNNPCGNVYTYDHLNKVAEMARKLGIMIISDEVYDHVVYGDKPFIPMGKFASIAPGITLGSISKGWVNP

SEQ ID NO: 8129 - protein, 400 aa, Zea mays
MGSGGANTAPLITPYKMGKFDVSHSIECGSSMLVIVLTPNKTNGDFKSDAESERVVLAPLTRQRSYGNVPQPHAILYYQQRATKGGLLIAEATGVSDTAQGYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGMYMANALNEFGILYCHMVEPRMVKLGEKFETPYSLRPIRDAFRGTFIVAGGYGREDGNRAISTGYADLVAFGRVFLANPDLPRRFEVDAPLNKYNRDTFYIPDPVIGYTDYPFLSSDV

SEQ ID NO: 8130 - protein, 648 aa, Chlamydophila pneumoniae
MFVMKKLVRLCVVLLSLLPNVLFSSDLLREEGIKKMMDKLIEYHVDAQEVSTDILSRSLSSYIQSFDPHKSYLSNQEVAVFLQSPETKKRLLKNYKAGNFAIYRNINQLIHESILRARQWRNEWVKNPKELVLEASSYQISKQPMQWSKSLDEVKQRQRALLLSYLSLHLAGASSSRYEGKEEQLAALCLRQIENHENVYLGINDHGVAMDRDEEAYQFHIRVVKALAHSLDAHTAYFSKDEALAMRIQLEKGMCGIGVVLKEDIDGVVVREIIPGGPAAKSGDLQLGDIIYRVDGKDIEHLSFRGVLDCLRGGHGSTVVLDIHRGESDHTIALRREKILLEDRRVDVSYEPYGDGVIGKVTLHSFYEGENQVSSEQDLRRAIQGLKEKNLLGLVLDIRENTGGFLSQAIKVSGLFMTNGVVVVSRYADGTMKCYRTVSPKKFYDGPLAILVSKSSASAAEIVAQTLQDYGVALVVGDEQTYGKGTIQHQTITGDASQDDCFKVTVGKYYSPSGKSTQLQGVKSDILIPSLYAEDRLGERFLEHPLPADCCDNVLHDPLTDLDTQTRPWFQKYYLPNLQKQETLWREMLPQLTKNSEQRLSENSNFQAFLSQIKSSEKTDLSYGSNDLQLEESINILKDMILLQQCRK

SEQ ID NO: 8131 - protein, 713 aa, Alkaliphilus metalliredigenes
MNTGPQQPQNTMEQNSKNEKLDLHRVDHNNELLTTNQGGRVSNTDDSLKAGARGPTLMEDFHFREKMTHFDHERIPERVVHARGFGVHGYFQVYEPMAELTKAKFLQDPTKKTPVFVRFSTVVGSKGSADTVRDVRGFATKFYTEDGNYDLVSNNIPVFFIQDAIKFPDVVHAIKPEPHNEIPQASAAHDTFWDFVVNTPETAHMIMWLLSDRAIPRSFRMMEGFGVNTFRFVNEQGKARFVKFHWKPLLGVHSLVWDEAQKLAGKDPDYHRRDLWDAIDMGEYPEYELGVQIVEEEEEFNFDFDILDATKIWPEEMIPVKRIGKMTLDNNVANFFAETEQVAFHPGHVVPGIDFSNDPLLQGRLFSYLDTQLIRLGGPNFHEIPINRPMAPIHNNQRDGYHRMTIDRGRVSYSPNSLQNDAPHPAPEADHGYVHHAEKVEGQKVRERSESFRDHYRQATLFWNSMSSAEKQHIIEAFHFEVGSVMDKQIKQRVVNMFNNVDGQLATQIAVGVGADSPAALGGNGVTATSPAVSQENTVKDARTRKVAILLENGFNYPEVTQVMSAFNGAGVHTEIVSKNLGMLTSVDGQQLEVGKNYATTASIKYDAVYVPGGPQSINSLMMQGDALHFVNEAFKHAKAIGATNEGVDLLMASAIQGVNMAGGNTQDQLITEMGVVTVRNVTDTNQFSQEFTNAIAQHRHWSRQNKKQMIPA

SEQ ID NO: 8132 - protein, 120 aa, Brassica napus
  misc_feature (106)..(106): Xaa can be any naturally occurring amino acid
  misc_feature (117)..(117): Xaa can be any naturally occurring amino acid
MDAVMFGLETPLMAALQHLLDVPDGDAGAGGDNKTGSGGSATRTYVRDARAMAATPADVKELPGAYAFVVDMPGLGTGDIRVQVEDERVLVVSGERRREEREDDAXYLRMERRMGKXMRK

SEQ ID NO: 8133 - protein, 598 aa, Pseudomonas fluorescens
MPSSTLHTWTHGARLLDAEHTRFALWAPDARCVSVELADGQSLPMQPQPEGWFMTQARCPAGSAYRFNIDERIQVPDPASRAQLGDVHGPSLVVDPERYQWQHPQWRGRPWHEAVIYELHVGVMGGYQAVQQALPALVELGVTAIELMPLAEFPGERNWGYDGVLPYAPEASYGSPDELRALIDTAHGLGLAVILDVVYNHFGPDGNYLQEYAQGFFRQDLHTPWGAAIDFRRPQVSEFFIDNALMWLLEYRFDGLRLDAVHAIDDPDFLRQLAQRVRQAVPPDRHVWLNLENEFNQASLLQQGFDAQWNDDGHNALHVLLTGETDAYYADFAEQPTEQLARCLSQGFAFQGHANRHGEARGEPSGHLPPSAFVLFLQNHDQIGNRAFGERLNQLAPTQALHAATVLLLLSPMIPLLFMGDEVAAQEPFLFFTSHQGQLAEAVREGRRNEFAAFSAFADAGQRQRIPDPNAASTFQASRPRAQSRQAEATRELYRSLLQIRRRELVPRLPGARALGCQVLAEGALSARWRLGDGSLLRIDLNLGPHQVELAAEAAPQLCFEYPPHTLKHWCQGQLPAYSVLVLLAPTSSPTDPDGECL

SEQ ID NO: 8134 - protein, 252 aa, Glycine max
  misc_feature (39)..(39): Xaa can be any naturally occurring amino acid
MFPHKVASMAFPNPSMSVSPQKKMGRGKIEIKRIENTTXNRQVTFCKRRNGLLKKAYELSVLCDAEVALIVFSSRGRLYEYANNSVKATIERYKKACSDSSGAGSASEANAQFYQQEADKLRAQISSLQNNNRQMMGESLGPLTAKELKNLETKLEKGISRIRSKKNELLFAEIEYMQKREIDLHNNNQLLRAKIAEGERNHHNLAVLPGGSNYDSLQTSQQQFDSRGSFQVTGLQPNNQYARQDQMSLQLV

SEQ ID NO: 8135 - protein, 542 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQAQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVALRDAPQVH

SEQ ID NO: 8136 - protein, 318 aa, Pichia stipitis
MPSIKLNSGYDMPAVGFGCWKVDVDTCSEQIYRAIKTGYRLFDGAEDYANEKLVGAGVKKAIDEGIVKREDLFLTSKLWNNYHHPDNVEKALNRTLSDLQVDYVDLFLIHFPVTFKFVPLEEKYPPGFYCGKGDNFDYEDVPILETWKALEKLVKAGKIRSIGVSNFPGALLLDLLRGATIKPSVLQVEHHPYLQQPRLIEFAQSRGIAVTAYSSFGPQSFVELNQGRALNTSPLFENETIKAIAAKHGKSPAQVLLRWSSQRGIAIIPKSNTVPRLLENKDVNSFDLDEQDFADIAKLDINLRFNDPWDWDKIPIFV

SEQ ID NO: 8137 - protein, 477 aa, Mesorhizobium loti
MSRQAQAPTIVLFRRDLRMGDNAALAAAAERGVPVVALYILDETTKGLRAMGAASRWWLHHSLAALGDLLRKAGANLFLAHGRTEDAVAKAIDASGANCVFWNRRYDPSEVAVDARLKAALREKGLTALSFDGALLHEPSLLKTGSGGFYKVFTPFWKAMADKVDVRDPIDTPGQIDGWRGELGGLRLDELDLLPSKPDWAYGLRETWTPGEKGAQARLGQFIEHGLANYERQRDYPGQPSTSRLSPHLTFGEITPFQIFAALRRSKSSGTSKFRAEIGWREFSYHLLFHNPDLSGRNFRPEFDAMSWRDDIRALRTWQRGLTGYPIVDAGMRELWRTGWMHNRVRMIVASFLIKDLMIDWRHGEKWFWDTLVDADAANNPASWQWVAGSGADPAPYFRIFNPVLQGEKFDPHGDYVRQHVPEISALPDRYIHRPWEAPAAVLKDKGIVLGKTYPNPIVDHGAARERALIVYQSLKD

SEQ ID NO: 8138 - protein, 376 aa, Lycopersicon esculentum
MENKVVEEKQVDKIPLMSPCKMGKFELCHRVVLAPLTRQRSYGYIPQPHAILHYSQRSTNGGLLIGEATVISETGIGYKDVPGIWTKEQVEAWKPIVDAVHAKGGIFFCQIWHVGRVSNKDFQPNGEDPISCTDRGLTPQIMSNGIDIAHFTRPRRLTTDEIPQIVNEFRVAARNAIEAGFDGVEIHGAHGYLIDQFMKDQVNDRSDKYGGSLENRCRFALEIVEAVANEIGSDRVGIRISPFAHYNEAGDTNPTALGLYMVESLNKYDLAYCHVVEPRMKTAWEKIECTESLVPMRKAYKGTFIVAGGYDREDGNRALIEDRADLVAYGRLFISNPDLPKRFELNAPLNKYNRDTFYTSDPIVGYTDYPFLETMT

SEQ ID NO: 8139 - protein, 1297 aa, Emericella nidulans
MACADETLTAAAAIIQNLVREAPSSGSPSFEFNFSPQSTNGVDSLPKLPGEPSLAKVRFENELEALVRRIHRMEVQSQQNHAQHAEHTQHLHKRRKSSKDTEPEILDESDGAASDEDEEEGATTLVREEDISYLRNYVQKQAEEISFQKNIITQVREELQLQEVQTRRALTKVENEDVVLLERELRKHQQANEAFQKALREIGGIITQVANGDLSMKVQIHPLEMDPEIATFKRTINTMMDQLQVFGSEVSRVAREVGTEGILGGQAQITGVHGIWKELTENVNIMAKNLTDQVREIAVVTTAVAHGDLSQKIESRAQGEILELQQTINTMVDQLRTFATEVTRVTRDVGTEGVLGGQAQIEGVQGMWNELTVNVNAMANNLTTQVRDIATVTKAVAKGDLTQKVQANCKGEIAELKNIINSMVDQLRQFAQEVTKIAKEVGTDGVLGGQATVNDVEGTWKDLTENVNRMANNLTTQVREIADVTTAVAKGDLSKKVTANVQGEILDLKSTINGMVDRLNTFAFEVSKVAREVGTDGTLGGQAKVDNVEGKWKDLTDNVNTMAQNLTSQVRSISDVTQAIAKGDLSKKIEVHAQGEILTLKVTINHMVDRLAKFATELKKVARDVGVDGKMGGQANVEGIAGTWKEITEDVNTMAENLTSQVRAFGEITDAATDGDFTKLITVNASGEMDELKRKINKMVSNLRDSIQRNTAAREAAELANRTKSEFLANMSHEIRTPMNGIIGMTQLTLDTDDLKPYTREMLNVVHNLANSLLTIIDDILDISKIEANRMVIESIPFTVRGTVFNALKTLAVKANEKFLSLTYQVDNTVPDYVIGDPFRLRQIILNLVGNAIKFTEHGEVKLTICKSDREQCAANEYAFEFSVSDTGIGIEEDKLDLIFDTFQQADGSTTRRFGGTGLGLSISKRLVNLMGGDVWVTSEYGHGSTFHFTCVVKLADQSLNVIASQILPYKNHRVLFIDKGENGPEAENVLKMLKKLDLEPLVVRNEDHVPPPEIQDPSGKESGHAYDVIIVDSVNTARMLRTYDDFKYVPIVLVCPLVCVSLKSALDLGISSYMTTPCEPIDLGNGMLPALEGRSTPITTDHSRSFDILLAEDNDVNQKLAVKILEKHNHNVSVVGNGLEAVEAVKQRRYDVILMDVQMPVMGGFEATGKIREYERDSGLSRTPIIALTAHAMLGDREKCIQAQMDEYLSKPLKQNQMMQTILKCARLGGSLLEKSKESRISSSGEMHHVHTGPDGKSQRPGMEGRSITSSSATSRTLASTSAERTEQLSIDRVRP

SEQ ID NO: 8140 - protein, 540 aa, Unknown
  Bradyrhizobium sp. BTAi1
MAAKDVKFSTDARDRMLRGVDILANAVKVTLGPKGRNVVIEKSFGAPRITKDGVTVAKEIELEDKFENMGAQMVREVASKTADLAGDGTTTATVLAQAIVKEGAKSVAAGMNPMDLKRGIDLAVDAIVADLKAHAKKITSNDEIAQVGTISANGDNEIGRFLAEAMQKVGNEGVITVEEAKSLDTELEVVEGMQFDRGYVSPYFVTNSEKMRVELEDPYILIHEKKLSGLQTMLPLLEAVVQSGKPLLIVAEDVEGEALATLVVNKLRGGLKIAAVKAPGFGDRRKAMLEDIAILTGGTTISEDLGIKLENVTLSMLGRAKKVVIDKENTTIVDGAGAKKDIEARTQQIKLQIEETTSDYDREKLQERLAKLAGGVAVIRVGGATEVEVKERKDRVDDALHATRAAVEEGILPGGGVALLRATKVLDGVKTANADQKAGVDIIRRAIQVPVRQIVQNAGEDGSLVVGKLLEKDTYSWGFNAATGEYQDLVQAGVIDPAKVVRTALQDAASVASLLITTEALVADKPKKAEATQAAPAMDF

SEQ ID NO: 8141 - protein, 487 aa, Bradyrhizobium japonicum
MSADFSRRHFAKLAGLAALGAATGVGAAESETPASAGRGAPFPKDFLWGTATSSYQIEGAVNEDGRGKSIWDVFSHTPGKIEDGSTGDRANEHYHRYREDVALIKALGVRAYRFSIAWPRVFPDGTGQPNPKGLDFYNRLVDELLASGIEPYATLYHWDLPQALQDRVGGWQSSDTSKAFADYAAYVAARLTDRVKNVFTVNEVGRFVNFGYGWGIDAPGLKLPAVQLNQARHHVALAHGLAVQAIRASGRAGTRVGAAENIAACVPAIATAENIRAAEIATRELNAGFLGVVLEGRYTDGFLAYAGADAPKFTAEELKIIGAPTDFVGLNIYAPQFYVTASDRAPGFHVLPFPTSFPHMNSEWLRVGPEVIYWAPRLAAKIWNIETIYISENGTSSEDRIAADGQVYDLDRIMFLRNYLTQMQRAVAEGVPIRGYFLWSLMDNFEWIFGYGKRFGLYRVDFETQARVAKLSAAFYRDVVARNAIGV

SEQ ID NO: 8142 - protein, 547 aa, Thiobacillus denitrificans
MAAKDVRFGDSARHRMVAGVNVLADAVKVTLGPKGRNVVLDRSFGAPTVTKDGVSVAKEIELKDKLENMGAQMVKEVASKTSDVAGDGTTTATVLAQSIVNEGMKFVAAGMNPMDLKRGIDKAVNAITEELKKISKPCTTSKEIAQVGSISANSDAPIGQIIADAMDKVGKEGVITVEDGSGLENELDVVEGMQFDRGYLSPYFINNADKQMAIMDDPFILLFDKKISNIRDLLPVLEQVAKAGKPLMIVAEDVDGEALATLVVNNIRGILKTCAVKAPGFGDRRKAMLEDMAILTGGTVIAEEVGLSLEKATLQDLGRAKRIEVGKENTTIIDGAGDGNAIKGRIAQINKQIEEVTSDYDKEKLQERKAKLAGGVAVIKVGAATEVEMKEKKARVEDALHATRAAVEEGIVPGGGVALLRAKAAAAAIKGDNHDQDAGVKIVLRAIEEPLRQIVKNCGDEPSVVVNKVLEGEGNFGYNAGTSEYGDMVAMGVLDPTKVTRTALQNAASIAGLMLTTDCMVADLPEDKAPAMPMGGGMGDMGGMGMM

SEQ ID NO: 8143 - protein, 1147 aa, Yarrowia lipolytica
MYQLLKALNAKVYSQQREIALHSGAVVALERDLSQTRNILNSFTETIAPGEKRVVDTDLLDRELRKSQTANRAFQKALMEIGEVVFAVAQGDLSKKVTIHDQEMDPEIVKFKETINKMMSQLQRFASEVTRVATEVAGGTLGGQAEGEGTVGVWRELTDNVNVMASNLTNQVREIADVTRAVAQGDLSRKINVHAQGEILELQKTINTMVEQLRTFAFEVTRVARETGVEGRLGGQAQIEGVEGIWRELTDNVNAMASNLTDQVRNIANVTTAVARGDLSQKVSADCKGEILDLKSTINKMVDRLQNFALEVTTLARSVGTEGILGGQAKVEDVEGAWKEITENVNVMASNLTTQVRSIAHVTTAVAQGDLSQKIDVHAQGEMLALKSTINKMVDRLQVFASEVTRVAKDVGIDGKLGVQAQVSDVDGLWKEITTNVNTMAANLTTQVRALVQITAAATDGDFTRFITVEASGEMDALKTKINQMVLNLRESIQRNTAAREAAELANRAKSEFLANMSHEIRTPMNGIIGMTQLTLDTELTQYQREMLSIVHNLANSLLTIIDDILDISKIEANRMTIEKIAFSLRGTVFGALKTLSVKANEKPLDLVYKVDNTFPDNLVGDSFRLRQVILNLVGNAIKFTESGEVALSVRKADDQRPGSPDEMMIEFCVSDTGIGIQSDKLDVIFDTFCQADGSTTRKFGGTGLGLSISKRLINLMGGDIWVKSEYGKGSQFFFTLAVQPADSGLSQLLDNIAPFRNHYVLFINTEHEQEVVDQLVDNMQRLNLNAWVVDSLEEAPLPEDRSGPKFDTIIVDSLEVATKLRTLNHLKYIPLILLHPCIPQVNLKICLDLGITSYGNTPCSTNDIGNVLLPALESRAAPLNSDGQMKFQILLAEDNVVNQKLAVRILEKHQHRVEVVENGYEAFEAIKKKRYDVVLMDVQMPVMGGFEATAKIREWEKQNITIRTRTPIVALTAHAMLGDRERCMQAQMDEYLSKPLKPALLVQTINKCVHSVNQLRSLALGPTSTSSVNQILSRSGQHKSAVAASSSAASASMLPYVAPQPTSPVLSPSLEDAIIKTTDGVVSKSPLPPSQSKPRPTIEQRSRTVTSVPHVDYPENGGARIVAIDEGTEPEKESEQPPSNRRVNSN

SEQ ID NO: 8144 - protein, 364 aa, Kluyveromyces lactis
MSSSSRYVTFEGSRNFRLRVVMATLSGKAIKIEKIRSDDLNPGLKDYEVSFLRLMEAVTNGSSIEISYTGTTVIFRPGIITGGSYTHQCPNSKPVGYFAEPMLYLAPFSKKKFSILFRGITSSHNDAGIDAIKWGLMPIMEKFGVRECALHTLKRGSPPLGGGEVHLVVDSLIAQPITMHALDKTMISSIRGVSYSTRVSPSLVNRMIDGAKKVLKSASCEVNITADVWRGENSGKSPGWGLTLVAENKQGWRIFSEAIGDAGDVPEDIGASVAYHLLEEISKSGVVGRNQLPLTILYMIIGKEDIGRLRITKDQIDERFVWLLRDIKKVFGTEILLKPVDDNTTDLIATIKGIGFTNTNKKIA

SEQ ID NO: 8145 - protein, 213 aa, Brassica rapa
MVRGKTQMKRIENATSRQVTFSKRRNGLLKKASELSVLCDAEVSLIIFSPKAKLYEFASSNMQDTIDRYLRHTKDRVSTKPVSEENLQHLKHEAANMMKKIEQLEASKRKLLGEGIGSCSIEELQQIEQQLEKSVKCIRARKTQVFKEQIEQLKQKEKALAAENKKLTEKWGSHEIEVWSNKNQESGKGDEESSPSSEVETELFIGLPCSSRK

SEQ ID NO: 8146 - protein, 455 aa, Emericella nidulans
MSAPTADIRARAPEAKKVHIADTAINRHNWYKHVNWLNVFLIIGIPLYGCIQAFWVPLQLKTAIWAVIYYFFTGLGITAGYHRLWAHCSYSATLPLRIWLAAVGGGAVEGSIRWWARDHRAHHRYTDTDKDPYSVRKGLLYSHLGWMVMKQNPKRIGRTDISDLNEDPVVVWQHRNYLKVVFTMGLAVPMLVAGLGWGDWLGGFVYAGILRIFFVQQATFCVNSLALWLGDQPFDDRNSPRDHVITALVTLGEGYHNFHHEFPSDYRNAIEWHQYDPTKWSIWAWKQLGLAYDLKKFRANEIEKGRVQQLQKKLDRKRATLDWGTPLDQLPVMEWDDYVEQAKNGRGLVAIAGVVHDVTDFIKDHPGGKAMISSGIGKDATAMFNGGVYYHSNAAHNLLSTMRVGVIRGGCEVEIWKRAQKENVEYVRDGSGQRVIRAGEQPTKIPEPIPTADAA

SEQ ID NO: 8147 - protein, 213 aa, Cardamine flexuosa
MVRGKTQMKRIENATSRQVTFSKRRNGLLKKAFELSVLCDAEVSLIIFSPKGKLYEFASSNMQDTIDRYLRHTKDRVSSKPVSEENMQYLKFEAANMMKKIEQLEASKRKLLGEGIGTCSIEELQQIEQQLEKSVKCIRARKTQVFKEQIEQLKQKEKALAAENGKLSEKWGSHETEVWSNKNQESGRGDEESSPSSEVETQLFIGLPCSSRK

SEQ ID NO: 8148 - protein, 429 aa, Arabidopsis thaliana
MESLPQPQNQSSPATTPAKILLGKHELGRRLGSGSFAKVHLARSIESDELVAVKIIEKKKTIESGMEPRIIREIDAMRRLRHHPNILKIHEVMATKSKIYLVMELASGGELFSKVLRRGRLPESTARRYFQQLASALRFSHQDGVAHRDVKPQNLLLDEQGNLKVSDFGLSALPEHLQNGLLHTACGTPAYTAPEVISRRGYDGAKADAWSCGVILFVLLVGDVPFDDSNIAAMYRKIHRRDYRFPSWISKQAKSIIYQMLDPNPVTRMSIETVMKTNWFKKSLETSEFHRNVFDSEVEMKSSVNSITAFDLISLSSGLDLSGLFEAKKKKERRFTAKVSGVEVEEKAKMIGEKLGYVVKKKMMKKEGEVKVVGLGRGRTVIVVEAVELTVDVVVVEVKVVEGEEDDSRWSDLITELEDIVLSWHNDIM

SEQ ID NO: 8149 - protein, 550 aa, Unknown
  Polaromonas sp. JS666
MAAKDVIFGGEARARMVEGVNILANAVKVTLGPKGRNVVLERSFGAPTVTKDGVSVAKEIELKDKLQNMGAQMVKEVASKTSDIAGDGTTTATVLAQAIVREGMKYVAAGMNPMDLKRGIDKAVTALVEELKKASKATTTSKEIAQVGSISANSDEAIGKIIADAMDKVGKEGVITVEDGKSLESELDVVEGMQFDRGYLSPYFINNPEKQSAILDNPFVLLYDKKISNIRDLLPTLEQVAKAGRPLLIIAEEVEGEALATLVVNTLRGILKVVAVKAPGFGDRRKAMLEDIACLTGGKVIAEEVGMSLEKVTLADLGTAKRIEVGKENTIIIDGAGEAKDIEARVKQVRVQIEEATSDYDREKLQERVAKLAGGVAVIKVGAATEVEMKEKKARVEDALHATRAAVEEGIVAGGGVALLRAKQAAGAIKGDNADQEAGIKLVLRAIEAPLREIVYNAGGEASVVVNAVLAGKGNYGFNAANDTYGDMIEMGILDPTKVTRTALQNAASVASLMLTTEAMVAEAPKDESGAGGGMPGGMGGMGGMGDMGM

SEQ ID NO: 8150 - protein, 563 aa, Xylella fastidiosa
MCSIFGIFNLQPSDNLQRLRHQALECSQRQRHRGPDWSGVYVDVGAILVHERLAIVDPAGGAQPLLSEDGTLALAVNGEIYNHAVLKGTLQQPYVFQTHSDCEVINALYREETPTSFLNRLNGIFAFALWDKTTGRGLIARDPMGVVPLYWGHDQDGRLRVASEMKALIEHCPDVAQFPPGHWYDTTTGTLVKYYERSWKNYSAVEGVQVSLQELREAFERAVHRQLMTDVPYGVLLSGGLDSSLVAAVAARYARHRIETNDQSEAWWPRLHSFAIGLKDSPDLSAANVAAEALNTVHHGFEYTLQEGLDVLPEVIRHIETYDVTTIRASTPMFLLARRIKAMGVKMVLSGEGSDEIFGGYLYFHKAPNAREFHEELVRKLNALYYYDCLRANKAMMAWGVEPRVPFLDREFLDVAMRMDAQHKMVDKTSDGPQQMEKGILRAAFDGYLPPSILWRQKEQFSDGVGYGWIDGLKAHAETQVSDHALATAETRFQVNPPQTKEAYYYRSIFERFFPSPAAAETVPGGKSIACSSPAAIAWDASFATMADPSGRAVSGVHQQALL

SEQ ID NO: 8151 - protein, 300 aa, Streptococcus thermophilus
MHFYLISFKIILLQLEKENRMETYTLSNGVTIPKIGFGTWQIPEGEEAYNSVSFALKAGYTHIDTAQIYGNEVSVGKAISDSDVAREDLFLTTKLWNDKHDYDLAKASIDESLERLGVDYLDLFLIHWPNPKALRENDAWKAGNAGAWKAMEEAYKEGKVRAIGVSNFMQHHLEALFETAEIVPHVNQILLAPGCTQEDLVAYCRERDILLEAYSPLGTGSIFGNEDVEAVAERNGKSVAQVALRWSLQKGFLPLPKSVTPKNIEANLDIFDFDLSEEDMAVLDKIQGIKTQVDPDTVNF

SEQ ID NO: 8152 - protein, 540 aa, Bacteroides fragilis
MKRIIYLLIGLCSVLGLQAQNFGSPAMRKLQLAEFAISNLYVDTVNENKLVESAIIEMLAQLDPHSTYSDAEEVKKMNEPLQGNFEGIGVQFQMIEDTLLIVQPVSNGPSEKVGILAGDRIIAVNDTAIAGVKMGTEEIMGRLRGPKDSKVNLTIIRRGVKEPLLFNVKRDKIPILSLDAAYMIQPKIGYIRINRFGATTAEEFLKALKELQKKGMKDLILDLQGNGGGYLNAAIDLANEFLGQKELIVYTEGRSAQRSEFFAKGNGNFRNGRLVVLVDEYSASASEIVTGAIQDWDRGVVVGRRSFGKGLVQRPIDLPDGSMIRLTIARYYTPAGRCIQKPYDSSINEKPGKGKSSESSIEKYNQDLIDRYNHGEMVSADSIHFPDSLKCQTKKLGRTVYGGGGIMPDYFVPVDTTLYTDYHRNLVAKGVVIKTTMNFIEKNRKALLDKYKTFEKFNEKFEIDDQLLNYLREAADKEKIEFNEEQYNKALPLIKAQLKALIARDLWDMNEYFQVMNATNKSVERALEILNDKEYEKILK

SEQ ID NO: 8153 - protein, 218 aa, Aspergillus niger
MSSTSPSKEPEVEPEVQSGEDQEQMDKEQQDTQAQGQGEFEVKEQDRWLPIANVARIMKLALPENAKIAKEAKECMQECVSEFISFITSEASEKCQQEKRKTVNGEDILFAMTSLGFENYAEALKIYLSKYRETQSARGEHQNRPTSSGYGAGAPVGAPGPAGPGGRPMAPGAGFPDTADSANNIMNQSLDPSEQDTSTYGYPPMVGQPHNGTAGESY

SEQ ID NO: 8154 - protein, 487 aa, Desulfotalea psychrophila
MKDEKDKLTGNNGAPVVDNQNVMTAGPRGPLLLQDVWFMEKLAHFDREVIPERRMHAKGSGAYGTFTVTDDIRAYTKAKIFAEIGKTTDLFVRFSTVAGERGAADAERDIRGFAMKFYTEEGNWDLVGNNTPVFFLKDPLKFPDLNHAVKRDPRTNMRSAANNWDYWSSLPEALHQVTITMSDRGIPLSYRHMNGYGSHTYSLLNENNERFWVKFHFKTQQGIKTLSDEEAEKLVGRDRESHQRDLLEAIDNHEFPSWKMQIQVVPEKEAANFPFNPFDLTKVWPHDDYPLIDVGIMELNKNPENYFAEVEQAAFNPANIVPGIGFSPDKMLQGRLFSYGDAQRYRLGVNHHLIPVNRARCPFHSFHRDGAMRVDGNYGGTRGYEPNSYGEWREQPEFKEPPLTLEGAADHWNHREDSDDYYSQPGNLFRLMTAEQKKVLFENTARALGDAPRAIKMRHASNCQKADRAYGEGVAMALGLPVSELEE

SEQ ID NO: 8155 - protein, 532 aa, Yarrowia lipolytica
MSKELYANSKDDAVYSYSFGVPYPHHPYSSQRAGPTGPLLLQDTYLIDALAHFDRERIPERVVHANGGGAHGYFEVTDDISDITYAEPFQKIGYKCPTTVRFSTVGGERGSPDTARDPRGFAVKHKTDWGNWDMVGLNSPVFFIRDPVKFIHVNHSQKRDPQTNLTAGDDASNYWNYLVQNPESLHQVVYMFGDRGTPNGWRHMNCFSTHTYKMINKEGKLTYVQFHYKSDQGVKNFTGPEAAEMAGKSPDHDQKDLFFAIDNGDYPSWTVSLQTMTPEQAEEWEYSILDMTKTWPYDKFPLRKVGKLVLNKNAENFFEEIEQAAFSPSNLIHGIEASDDPVLQARLFSYPDTARHRLGPNFNQLPVNQARTFQKGSGCPFMAGNFQRDGNMAIHNQGNRPNYLSTIRPIQSVSVPNEDFKNTHDYCGVVTKEMEDESFKVQAEAAKKHNEKIWESSSYLYLSGFQESDAAQPRDLYERVYDDAAKQRMIDNVVDHASTIKQHGLKEQVAKYFGRISDDLGKKIAEGLGVPY

SEQ ID NO: 8156 - protein, 433 aa, Sulfolobus solfataricus
MLCLFIFRRDLRLDDNTGLIKALEDCEKVIPAFILDPRQVGNENEYKSEFAINFMINSLNELNDELRKRGSRLYVYFGLAEEVIKNLLKDVDAVYLNEDYTPFSKMRDERIRKYCEDTGKIMKSFEDYLLTSKNDFKNYRNFTTFYNVVKNKQIKKPVQNNYTNYYKNSLGDEHELPPRQGERGGRKEGIKLIERARQINYDRKDFVAEDNRTFLSPHLKFGTLSIREVYYSLLDSQAIIRQLYWRDFYTLLAYYNERVFHEPLKREYNCIEWENNERLFQAWLEGKTGYPIIDAGMRQLNRTGDMPNRVRMLTAFFLVKVLIIDWRIGEKYFASKLIDYDPSVNNGNWQWIASVGTDYIFRVFDPWKQQVTYDPEAKYIKRWVDELESYDAEIIHNAYKYTLKSYPKPIVDWRIRVNLAKRLYEVCRKSKIK

SEQ ID NO: 8157 - protein, 546 aa, Rhizobium leguminosarum
MASKEIKFGRTGREKMLRGVDILADAVKVTLGPKGRNVIIDKSFGAPRITKDGVSVAKEIELEDKFENMGAQMVREVASKTNDIAGDGTTTATVLAQAIVREGNKAVAAGMNPMDLKRGIDLAVADVVKDLQAKAKKISTSEEVAQVGTISANGDKQVGLDIAEAMQKVGNEGVITVEEAKTAETELEVVEGMQFDRGYLSPYFVTNPEKMIADLEDVFILLHEKKLSNLQSMLPVLEAVVQTGKPLLIVAEDVEGEALATLVVNKLRGGLKIAAVKAPGFGDRRKRMLEDIAILTGGTVISEDLGIKLESVTLDMLGRAKKVSISKENTTIVDGSGAKTDIEGRVAQIKAQIEETTSDYDREKLQERLAKLAGGVAVIRVGGSTEVEVKEKKDRIDDALNATRAAVQEGIVPGGGIALARSSTKITVKGANDDQEAGINIVRRALQSLVRQIAENAGDEASIVVGKVLDKNEDNFGYNAQTSEYGDMIAMGIVDPLKVVRTALQNAASVASLLITTEAMIAELPKKDAPAGMPGGMGGMGGMDMM

SEQ ID NO: 8158 - protein, 98 aa, Dianthus caryophyllus
MATVGGIKDSGGSSANSLEIDELAKFAVDHYNSKENALLEFQRVVNTKEQVVAGTIYYITLEATDGGVKKLYEAKVWVKPWVNFKEVQDFKYVGDASA

SEQ ID NO: 8159 - protein, 175 aa, Draba nemorosa
MVRGKTQMKRIENATSRQVTFSKRRNGLLKKAFELSVLCDAEVSLIIFSPKGKLYEFASSNMQDTIDRYLRHTKDRISSKPVSEENMQHLKHEAANMMKKIEQLEASKRKLLGEGIGTCSIEELQQIEQQLGKSVKCIRARKTQVFKEQIEQLKQKEKALAAENEKLSEKWGSNE

SEQ ID NO: 8160 - protein, 272 aa, Bradyrhizobium japonicum
MLFVEANGARIPAIGLGTWELSGRPCARVVEQALRLGYRHIDTAQVYDNEREVGDGVRASGVRRDDVFLTTKVWTNHFAPNDLERSVKESLARLRLPSVDLLLLHWPNSHVPLAETLGALSHARQMGLTRHIGVSNFTVALIEQAVALSPEPLVCNQVEFHPYLDQAKVRAACDQHGLALVAYSPIARGRIKTDQTLAGIGRAHRKTPAQVCLRWLVQQNVAAIPRTSRIERLSENIEIFDFELSDDEMARIAALANPKGRLTDFGFAPKWD

SEQ ID NO: 8161 - protein, 415 aa, Oryza sativa
  misc_feature (110)..(110): Xaa can be any naturally occurring amino acid
  misc_feature (122)..(122): Xaa can be any naturally occurring amino acid
MATSEAAAISNPFAPLTNHQQEHPPPPPPPAKKKRNLPGTPDPEAEVIALSPRTLMATNRFVCEICGKGFQRDQNLQLHRRGHNLPWKLRQRSGKEPRKRVYVCPEKSCXHHNPSRALGDLXGIKKHFCRKHGEKKWKCDKCSKRYAVQSDWKAHSKTCGTREYRCDCGTLFSRRDSFITHRAFCDALAEETARLNAASGAAAAAAAATATSLCGQSYLFAGSGGPGMAGMRPNTMMPPQFDAAQLSWLYGNGKLSSSNASELTSATAAAKEAESVPSVFSNQQHAKPAAPTDMSATALLQKAAQIGAVTSTAAMPLVSPFEPTKPGGATASPADECGKFDGAALFAAASHHNANLGGAMSELTGAAGNVPYDVLSAVRHHAGLKDAGGVGREETRDFLGVGVQALCSSSIHGWI

SEQ ID NO: 8162 - protein, 547 aa, Oryza sativa
MQGGGGAASAAAAAAAAATQQHRELLERYELVRVRGRGSFAQVWEARHRRTGLSVAVKILNLAGLLASGIPIRKVEREIAVMRLLNHPHIVRFHEAIAGGDGGGHVYIVMELATQGQLYDYVTQLGRLREDDARRIFQQIISGAEYCHHNMVVHRDLKLENILMDSEMNVKIVDFGFSKFFRHNKVLSASCGSREYAAPELLAGRKYVGPPVDVWSCGVILYILFCGRLPFDSADVSELHRIIKRGEFSIPPYVPDDARDLISSMLIVRPDKRLTITEVRTHRWLQHSIPRYLAMPPLNARTQITRIDAETVDKVVGHGFERRYLVESLENRVENEATVAYNLILNKKFDAPTRYVWTIDVYQEAGQSNTTGAAEATGSSAAGEPPVAVAGEDDGRNNGWALGGVEFHECPREAMRAIAAALRETGVVYAHDDDDRGRYGKLLCARFAGAAGVRRIIRSYLAATDDAPSSSSSAGGGSGRGEAGHGGGAPVDDAVLESLSAAVFFEIQLYKSEGEGNYLMDLKRLSGPQLQYLNICSELSSKLRAIN

SEQ ID NO: 8163 - protein, 918 aa, Escherichia coli
  misc_feature (639)..(639): Xaa can be any naturally occurring amino acid
MTNYSLRARMMILILAPTVLIGLLLSIFFVVHRYNDLQRQLEDAGASIIEPLAVSTEYGMSLQNRESIGQLISVLHRRHSDIVRAISVYDENNRLFVTSNFHLDPSSMQLGSNVPFPRQLTVTRDGDIMILRTPIISESYSPDESPSSDAKNSQNMLGYIALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELTPTQRDHLNTIERSANNLLAIINDVLDFSKLEAGKLILESIPFPLRSTLDEVVTLLAHSSHDKGLELTLNIKSDVPDNVIGDPLRLQQIITNLVGNAIKFTENGNIDILVEKRALSNTKVQIEVQIRDTGIGIPERDQSRLFQAFRQADASISRRHGGTGLGLVITQKLVNEMGGDISFHSQPNRGSTFWFHINLDLNPNIIIEGPSTQCLAGKRLAYVEPNSAAAQCTLDILSETPLEVVYSPTFSALPPAHYDMMLLGIAVTFREPLTMQHERLAKAVSMTDFLMLALPCHAQVNAEKLKQDGIGACLLKPLTXTRLLPALTEFCHHKQNTLLPVTDESKLAMTVMAVDDNPANLKLIGALLEDMVQHVELCDSGHQAVERAKQMPFDLILMDIQMPDMDGIRACELIHQLPHQQQTPVIAVTAHAMAGQKEKLLGAGMSDYLAKPIEEERLHNLLLRYKPGSGISSRVVTPEVNEIVVNPNATLDWQLALRQAAGKTDLARDMLQMLLDFLPEVRNKVEEQLVGENPEGLVDLIHKLHGSCGYSGVPRMKNLCQLIEQQLRSGTKEEDLEPELLELLDEMDNVAREASKILG

SEQ ID NO: 8164 - protein, 677 aa, Xanthomonas campestris
MATWLILVGELLVSLGLMVAILLRPQVSHTRRLIGMLLDYTCTGAIMAIQGEPASPLYAVCMWVTIGNGLRYGSNYLRAATAMGSLCFLGAILISPYWKANPYLSWGLLLGLIAVPLYFDSLLRAMTRAVREARHANQAKSRFLANMSHEFRTPLNGLSGMTEVLATTRLDAEQKECLNTIQASARSLLSLVEEVLDISAIEAGKIRIDRRDFSLREMIGSVNLILQPQARGRRLEYGTQVADDVPDLLKGDTAHLRQVLLNLVGNAVKFTEHGHVLLRVTRVSGSAEDAVRLRFDVEDTGIGVPMDMRPRLFEAFEQADVGLSRRYEGTGLGTTIAKGLVEAMGGSIGFKENQPSGSVFWFELPMAIGEPLKSSTVRVPTGALVDAPEELESSNIIAFSNPFLRHRARVRSMRMLVADDHEANRMVLQRLLEKAGHKVLCVNGAEQVLDAMAEEDYDAVIVDLHMPGMNGLDMLKQLRVMQASGMRYTPVVVLSADVTPEAIRACEQAGARAFLAKPVVAAKLLDTLADLAVSTRQLATPATTVQVATSFEGVLDSSVLDELAALGMGEEFERQFVRQCLDDAQNCVGDIERDGTCSDWEQLRESAHALRGVASNLGLAQVASSGGELMRMADWQLQAEWRLRLSTLREQLKAGKDALDARVQGVKDGECSPRSNE

SEQ ID NO: 8165 - protein, 455 aa, Unknown
  Nocardioides sp. JS614
MSLHLPSPSTLAYGAATASYQIEGATAEDGRGASIWDTFTTRPGAIRDGSDGSVACDSYHRYEEDADLVAGLGVGWYRFSIAWPRVLPEGTGRVEPRGLDYYDRLVDALLARGVSPTATLYHWDLPQALEDRGGWLERSTAEAFADYAMVVHERLGDRVGVWATHNEPWCAAYLGYAAGIHAPGRREGGAAHRAAHHLLLGHGLAAARLHEAGVGDVGIALNLAPFWPESPDAVAAADGVDAIRNRLWLGPLVDGAYDDGLLAVAPELADPDVVHEGDLELVRGSADWIGINYYTPFRPTLADPALETHPEVDAYPGATPVSFVVREPRTDIGWEVEARGLEELLVETHRRTGLPLIVTENGAAYADDTLREGAAGVIDDQDRIAYLRDHIAATERARSAGADVRAYIVWTLLDNFEWAEGYTKTFGVVHVDPKDQTRTPKASYHWLAEHVAEAH

SEQ ID NO: 8166 - protein, 259 aa, Catharanthus roseus
MALEALNSPTTPTPVFQYENAATLRYLDQPWAKGKRSKRPRSVEPPPPQHQQQQQPTEEEYLALCLIMLARGGAPSTTTLPLPPPPQQHNIPSSSSSDPPKLLYKCSVCDKAFSSYQALGGHKASHRKLSTASAGGGDDQSTTSTSTTTAAAATGRTHECSICHKCFPSGQALGGHKRCHYEGGAGAVGSTGNAASGVTSSEGMGSTNTHSNRDFDLNLPALPEFWLAAAAGDDEVSSPHPAKRSRFALPIKVENHQIN

SEQ ID NO: 8167 - protein, 153 aa, Methanococcoides burtonii
MKFGLVRRGSSDVSRWDPFDEIRQTQEHLNQLLREVSPFGGLFEGKSRAPLMDIKEEDNNVIVTTDLPGIDKEDVEISVNNNILEIHAEFKKESESEKEGYVQKERTYSSFSRSAVLPSVVSDEGVKAKLEAGVLTITLPKTKAEEKTKIKIE

SEQ ID NO: 8168 - protein, 480 aa, Pediococcus pentosaceus
MKMTKLPENFLWGGAVAAHQLEGAWQADGKGVSMADVMTAGANKVPRKITDGVVPGENYPNHEGIDFYHHYREDVKMFAELGLKAFRTSIAWTRIFPNGDDAEPNEAGLKFYDDLFDECLKYGIEPVITLAHFEMPYHLVKKYNGFSDRHVIDLYVRFAETCFKRYKDKVKYWMTFNEINNQSMYNNDFLMATNSGLVFKGDENREAAMYQAAHYELVASAKAVKLGHEINPDFQIGCMINFTPFYPLNAAPNNIMLAERLMQRRYWFSDVHVNGVYPENVETYLQQKGYRPDITEADREILKAGTVDYVGFSYYNSNTVALPEGRSIDENLAPEDVTVENPYLATSDWDWPIDPVGLRYSLNWLNDRYHLPMFIVENGLGAYDTVESDGAIHDPYRVDYLRAHIQEMEKAVELDGVNLMGYTPWGFIDLVSAGTGQMSKRYGFIYVDKDDDGNGTLQRSKKDSFGWYQKVIRTNGEDLD

SEQ ID NO: 8169 - protein, 617 aa, Candida albicans
MSEQAQTQVSADQQQHQHNHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYAAPEVISGKLYAGPEVDVWSAGVILYVMLCGRLPFDDEFIPALFKKISNGVYTLPNYLSAGAKHLLTRMLVVNPLNRITIHEIMEDEWFKQDMPDYLLPPDLSKNKNSKIDVDEDVIRALSVTMGYDRDEIVNVIEKANKQVAAGNSSSQQSKSSNEILDAYLLMKENHALVKDLKKSKSENIESFLSQSPPPSPFPNAGSTSSAPGVQQSLTYQTLATVPDLSTLPNSTIAILPTSLPSIHRAYMAETKQNGDPSQQHAPPPTKKSKTRWHFGIRSRSYPLDVMGEIYRALKNLGAEWAKPTEEELWTIRVRWKYDTSAQFECGSAPNLMKMQIQLFQLEPNNYLVDFKFDGWESAHGNAGTDSPQSHRQQDLDEVGSFSAYPFLHLATRLIMELAVNSQSG

SEQ ID NO: 8170 - protein, 207 aa, Alkaliphilus metalliredigenes
MKFEKIVVGIEEANGYIFYDENSLEAVVIDPGDEAKTFMKYIDKRYLKPIGIILTHYHYDHIAAAEALKKKYQCPINAHKKEIDGLKDPEINYSKREYAKEVSITPDVLLSHGDTISVGALQLEVIHTPGHTPGSICLAVKDEKVIFTGDTVFSDALGRTDLAGGSEAMLRKTIRNKVSKWDDDVRVYPGHGESALMAQLRSRREIK

SEQ ID NO: 8171 - protein, 311 aa, Zea mays
MAAAEVYSPTAAAAAQQQREKAASQAWRTVVGWIGFLVQVLLQILRGTPSCAQLLSFVGVRYPLLSGPTASNPSPEVAFMPLRSEIPADAAPAPTPAPEPLGRLKVVLDLDETLVSAYESSSLPTIVRTQAVEAGLHCFDMECISSDKDAEGKQKVNHVTVFERPGLHEFLQKTSEFADLILFTAGLEGYARPLVDRIDVHNRFRLRLYRPSTVTTEYREHVKDLSCVSKDFGRIVIVDNNPFSFILQPLNGIPCVPFSAGQHSDDQLMMVIFPLLKHLSLQKDVRPVLHERFHMPEWFQKHGIPQTNQSV

SEQ ID NO: 8172 - protein, 582 aa, Candida glabrata
MGNTTSIESKIDFGQNRHVKPHLKNNNHVDDIYKRDTLPPSMAQMEPRSPILVVNGKHLTDIKEIANISSQIPETMMAANAEAASLQESLSNEERAAYLPTFSKSSSYVSSLHSRKSSLLSNSTTLGTPATSPGLNESSSSLANDYFASKRRPSLPDQTLGQHLTRPSLLDSHRSYSSDNCLSTINSNSTELQNTTTHHNDRLRDIFPFSRPKSPNGFEIRIPLSSDDVSSSSESKLSLHRHHSSKDIPGDQTGYVMINGKRKKQVNIDEAIQRLLDVGYSGKKNKAFCLKNSEIIQICIQAREVFLNQPALLELSAPVKIVGDIHGQFQDLLRLFTKCGFPPSSNFLFLGDYVDRGKQSLETILLLLCYKIKYPENFFLLRGNHECANVTRVYGFYDECKRRCNIKIWKYFIDTFNTLPLTAIVAGKIFCVHGGLSPVLNTMDEIRNMSRPTDVPDFGLINDLLWSDPIDSPNEWEDNDRGVSYCYNKVAINKFINKFNFDLVCRAHMVVEDGYEFFNDRTLVTVFSAPNYCGEFNNWGAVMSVSQELLCSFELLDPLDSNSLKQVMKKGKQERDLANSFD

SEQ ID NO: 8173 - protein, 587 aa, Gibberella zeae
MSAGDGTSTPGVGGSNASEFVRKLYRMLEDPAHQDVARWGKDGDTFVVVENEKFTRSILPKHFKHSNMASFVRQLNKYDFHKVRQTNDSGSAANGANTLEFKHPNFRVGSKDDLDNIRRKAPAPRRTQATEDFTTSHHISVMTEQLTATQQQVQQLQELFTEVSQTNRLLVNEVLTLQKMLNAQKQSQHEMLNFLSPSTNRHQQTMHLNVGTSPLDGSDDSAPELRRARELLSSVTPDQIADRELERLQGVYGSPADSAVVIPQASMPMMHDPMNDINRYPVYPVGQTVGIDPFHSDHIHKIPYAMPNDSSANAMQEVAAPQPINIQTHGNSNSSANSALTWASRKPRIFLVEDDPTCAKIGIKFLKSMGCEVEHAQNGADAYSRITGVARDHFDMIFMDIIMPKLDGVSTTMYIRQDCPAIPIVAMTSNIRSDEVHCYFEHGMNGVLAKPFTKSGMQKIVENHLSYLLKGYDPSTQQESGSGYVVGGAGYMNPPSNLNTPGGTAFKFETTPTPPATGATWSPGQMPQQSPLTTGMDQGYGMVNGANQYGLTPTSASRASFPGNISQNNQGRMDGQSPPEKRQRTYV

SEQ ID NO: 8174 - protein, 402 aa, Carica papaya
PDQMGLAENQVITYRNPIHTYTYTYTFNSKVDSHLLIWLMQLCFNLIHEWLLKNPEASICTAQGAAEFRDIAIFQDYHGLAEFREAVAKFMGKVRRNRASFDPDRIVMSGGATGAHEMIAFCLADPGDAFLVPPPYYPGFDRDLRWRTGVKLIPVVCESSNDYQITIEALEAAYETAQEADIKVKGLLITNPSNPLGTIITKDTLGALVTFTNHKNIHLVCDEIYAATVFSQPEFTSIAEIIEEDKICCNRDLIHIIYSLSKDMGFPGFRVAIVYSYNDAVVSCARKMSSFGLVSSQTQYLIASMLADDEFVDKFIVESRKRLAMRHSFFTQRLAQVGINCLKSNAGLFVWMDLRRLLKEQTFEAEMVLWRVIINEMKLNVSPGSSFHCSEPGWFRVCFAAE

SEQ ID NO: 8175 - protein, 495 aa, Arabidopsis thaliana
MVAFATEKKQDLNLLSKIASGDGHGENSSYFDGWKAYEENPFHPIDRPDGVIQMGLAENQLCGDLMRKWVLKHPEASICTSEGVNQFSDIAIFQDYHGLPEFRQAVAKFMEKTRNNKVKFDPDRIVMSGGATGAHETVAFCLANPGDGFLVPTPYYPGFDRDLRWRTGVNLVPVTCHSSNGFKITVEALEAAYENARKSNIPVKGLLVTNPSNPLGTTLDRECLKSLVNFTNDKGIHLIADEIYAATTFGQSEFISVAEVIEEIEDCNRDLIHIVYSLSKDMGLPGLRVGIVYSYNDRVVQIARKMSSFGLVSSQTQHLIAKMLSDEEFVDEFIRESKLRLAARHAEITTGLDGLGIGWLKAKAGLFLWMDLRNLLKTATFDSETELWRVIVHQVKLNVSPGGSFHCHEPGWFRVCFANMDHKTMETALERIRVFTSQLEEETKPMAATTMMAKKKKKCWQSNLRLSFSDTRRFDDGFFSPHSPVPPSPLVRAQT

SEQ ID NO: 8176 - protein, 324 aa, Yarrowia lipolytica
MSITDSFKLNDGHSIPALGLGTASDGNVEEVVYAAIKNGYRHIDTAFIYGSEVDVGKGIKRAIDEELVKRENLFVTTKVWPTFYNRVSESLDISLKDLSLDYVDLLLVHWPVSLLADSDDPRAIYLVNTDGSVRYSDSLDDWITTYKQIEEEKLSGRTKSIGVSNVSEVYLKRLLDQVKTVPAVNQFEIHPYLPQKKEIEFNEKHGILVTAFSPLGSSTGALKLHENPIAVEIAQKHNTSTGSVLINWHVSQKRAVLPKTRSIERVVANGMKVPLDQGDLDKLDKIWLQTGTQRAIGLRWLDKNGDYLGFSEDDIEHKHIWAKD

SEQ ID NO: 8177 - protein, 469 aa, Vibrio cholerae
MRLVWFRRDLRSFDNTALTAALNSGDPVAAMYIATPEQWHQHHLAPIQADLIWRRLAELQQELAALNVPLFYQQVADFQAAAVAVSQLAKTLNATQVLANRDYELDEQQRDQLAQQLLSEQGIIWSAFDDKCVLPPGSVRTKQGEFFKVFTPFKRAWLTLFQPPVIGKNRPVALWNVPSALAELVWHPEQAFDYPRIDSTPWAADFETVRAQLRDFCRERVQDYHQARDFPAREGTSSLSPYLAIGVLSARQCVARLYHESSMGELSEGAQVWLSELIWREFYQHLVAIEPNLSKSRDFVEWGARLEWWNDNEKFQLWCEGKTGYPIVDAAMRQLNQTGWMHNRLRMIVASFLTKDLHIDWRWGERYFMSRLIDGDYAANNGGWQWCASTGCDGQPYFRIFNPVSQGEKFDPNGDFIRRWVPELRSVSSAYIHQPWTYPAVNSVLYPARLVDHKQEREVTLRLYKTAKG

SEQ ID NO: 8178 - protein, 206 aa, Cupriavidus necator
LQPGSAQVAAGYALYGPTTMLVLTVGNGVNGFTLDPNLGEFFLTHPHLRVPPDTQEFAINASNSRFWEAPVQRYIGECMAGKSGPRGKDFNMRWIASMVAEAHRILMRGGVFMYPRDTKDPAKPGRLRLLYEANPIAFLMEQAGGRASTGRQTLMSVAPGALHQRIGVIFGSRNEVERIEGYHTNQTDPDLPSPLFNERSLFRASA

SEQ ID NO: 8179 - protein, 471 aa, Vibrio parahaemolyticus
MILVWFRRDLRTLDHTALKAALDTGQPVVACFIATPEQWQEHHMAPMQADLIARRLEHVHQELTELNIPLLYKEVPRFDDCTQVICDWADKLNATAAMVNINYEVNEVELDRKVSQALDNRGVEFHAFHDKCVHAPTTVLNKQGEYFKVFTPFKRAWLQKFSLPTVSKPQRQNELPSAQLAAVKQDGFDADFTFSYPRESSEAWCVSTNDILKQLRTFARERSDGYQMKRDFPAIDGTSQLSPYLAIGALSPRQCIARLYAENPQPDLSEGKATWLSEIIWREFYQHLLVFEPKLVKGRGFIDWEDKIQWSYDEQAFECWKTGTTGYPIVDAAMRQLNQTGWMHNRLRMIVASFLTKDLHIDWRWGEEYFMSKLVDGDFAANNGGWQWSASTGCDGQPYFRIFNPISQGEKFDSDGQFVRHWVPEIKSVPNKFVHKPWTWEGFSLLEYHKPMVDHKVEREITLRLFKSAKE

SEQ ID NO: 8180 - protein, 159 aa, Cupriavidus necator
LQVPADTQEFAINASNSRFWEAPVQRYIAECMAGKSGPRGKDFNMRWIASMVAEAHRILMRGGVFMYPRDSKDPAKPGRLRLLYEANPIAFLMEQAGGRASTGRQTLMSVAPGALHQRIGVIFGSRNEVERIEGYHTDQTDPDLPSPLFNERSLFRASA

SEQ ID NO: 8181 - protein, 462 aa, Arabidopsis thaliana
MSEEQPHANLAVPAFKTEKDPVTQTQNGQSSVWRFGGSDKAAKASTVTLRGVIYMLFDNCGKDVNKTILPLGHGDPSVYPCFRTCIEAEDAVVDVLRSGKGNSYGPGAGILPARRAVADYMNRDLPHKLTPEDIFLTAGCNQGIEIVFESLARPNANILLPRPGFPHYDARAAYSGLEVRKFDLLPEKEWEIDLEGIEAIADEKTVAMVVINPNNPCGNVYSHDHLKKVAETARKLGIMVISDEVYDRTIFGDNPFVPMGKFASIVPVLTLAGISKGWVVPGWKIGWIALNDPEGVFETTKVLQSIKQNLDVTPDPATIIQAALPAILEKADKNFFAKKNKILKHNVDLVCDRLKDIPCVVCPKKPESCTYLLTKLELSLMDNIKDDIDFCVKLAREENLVFLPGYALGLKNWMRITIGVEAHMLEDALERLKGFCTRHAKKTETETESLQALKLSDNNLEM

SEQ ID NO: 8182 - protein, 340 aa, Brassica napus
MDHEADAFRTDLMTITRFVLNEQSKYPESRGDFTILLSNIVLGCKFVCSAVNKAGLAKLIGLAGDTNIQGEEQKKLDVLSNDVFVKALVSSGRTSVLVSEEDEEATFVESSKCGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAEEEKN

SEQ ID NO: 8183 - protein, 462 aa, Arabidopsis thaliana
MSEEQPHANLAVPAFKTEKDPITQTRNGQSSVWRFGGSDKAAKASTVTLRGVIYMLFDNCGKDVNKTILPLGHGDPSVYPCFRTCIEAEDAVVDVLRSGKGNSYGPGAGILPARRAVADYMNRDLPHKLTPEDIFLTAGCNQGIEIVFESLARPNANILLPRPGFPHYDARAAYSGLEVRKFDLLPEKEWEIDLEGIEAIADEKTVAMVVINPNNPCGNVYSHDHLKKVAETARKLGIMVISDEVYDRTIFGDNPFVPMGKFASIVPVLTLAGISKGWVVPGWKIGWIALNDPEGVFETTKVLQSIKQNLDVTPDPATIIQAALPAILEKADKNFFAKKNKILKHNVDLVCDRLKDIPCVVCPKKPESCTYLLTKLELSLMDNIKDDIDFCVKLAREENLVFLPGDALGLKNWMRITIGVEAHMLEDALERLKGFCTRHAKKTETETESLQALKLSDNNLEM

SEQ ID NO: 8184 - protein, 544 aa, Geobacter sulfurreducens
MAARIIKFDQEGRNAILKGVNTLADAVKVTLGPKGRNVVIEKAFGSPLITKDGVTVAKEIELEDKFENMGAQLVKEVASKTSDVAGDGTTTATVLAQAIYRQGSKLVAAGHNPMEIKRGIDKAVETIVAELKSISKPIKDHKEIAQVGTISANNDKTIGDIIAQAMEKVGKEGVITVEEAKAMETSLETVEGMQFDRGYLSPYFVTDPERMEASLENAMILIHDKKISNMKDLLPVLEQTAKSGRPLLIIAEDIEGEALATLVVNKLRGVLNICAVKAPGFGDRRKAMLEDIAILTGGQVISEEIGNKLENTTMDMLGRAKRITVDKDNTTIIDGDGKEADIQGRVKQIRAQIEETTSDYDREKLQERLAKLVGGVAVIKVGAATETEMKEKKARVEDALHATRAAVDEGIVPGGGVAYLRALASLDALSLPTEQQFGVNVIKRSLEEPIRQIAQNAGVDGSIVVDKVKNSKDAFGYNAAEDEYVDMLAAGIIDPTKVSRSALQNAASVAGLMLTTEAMIADKPKEEAPMPAMPGGMGGMGGMM

SEQ ID NO: 8185 - protein, 383 aa, Ceratopteris richardii
MNTFLSSGPHTYLNNLRCGEWGSGTAPGPIADPKSAAYYRDHTKNDKVNDLSNRLHSYGPPEALQYPNQHAIAADTEKMEVENSGKMAASVERSAQDAHASGALQEDVVAAYVDNMPACVAGVTLVPQGGRGTIPIRRIDNPTSRQVTFSKRRNGLLKKAYELSVLCDAEVGVMVFSATGRLSEFASTSMQKVLERYQEHSNGAPSRKVLLQDVEFWKREVLFLRDQLFHLKNYENHILGENQIPLDLAEIQRVETRLENALNKIRIQKVQVLHGEMQQIYKQEARLFEENNILRKKLAEATTINGMRGSMSTMTMSHEDLPGSTNQSYGTKALQGGCPSDTSTTTSNDPNHHSSHPPSHPSASQPLTLHLTSPCSPKLDLRL

SEQ ID NO: 8186 - protein, 199 aa, Triticum aestivum
MWSTDSDLDESASTTTAATSSLSSSCSLQPQTPPPPRRRRSRNRRRAQRRVKNGPEVEESEAEAEAEEVWCGAQWEAAWPRRARPVVLAGEDAAPDRAGAGAGDSGVGRARSLTDDDLEELKGCVDLGFGFSYNEIPELCGTLPALELCYSMSQRFLDEHQPFLSASCLDWIVRDSPDEVKARLKYWAQAVACTVKLCS

SEQ ID NO: 8187 - protein, 239 aa, Ceratopteris richardii
MVRRKIKIKRIENATTRQVTFSKRRGGLLKKAHDLSVLCDADVGVIIFSSKGKLFQFANPSMKSVLERYYKAQGDAESADNVSSAENIEIDRITLFTEKLKALQRNVIGDDLERLSLRDLIHLEQQIHESLGRIRAKKEEMILDQLEDFKKKVTDARKTTNANSSLLDKLLDFCSSDMTSSHNFVDCEPLLISEAPQADASLAGRAATSEQSTDVRECSPPAKRLRITEDLNHSPVCME

SEQ ID NO: 8188 - protein, 401 aa, Xanthomonas oryzae
MLSEPLIDFLTSGVARLGVWGMLAVLLVFTQLTIFAVTLYLHRSQAHRGVDFHPVIAHFFRFWTWFTTSMISREWVAIHRKHHAKVETEEDPHSPQSKGISQVFWRGVELYREARTQRADIEQYGKAAPTDWIERHLYTPHANAGPVALLVINSVLFGLPGIALWAVQMAWIPFWAAGVVNVLGHWWGYRNFESADTSTNLTPWALRIGGEELHTHHHAFPSSARFSMRRWELDIGWVVIRSVQAFGLAKVLRVAPSLDIRPNIAVLDADTLKPLLSHRFQAMTDYQRNVLKPALREEAAATGAKLRELLPRRLRKGLVDDGRWLKPEARAQLQTWVAQRPRMRTLVEYRARLTAVLEARSHDASERLRQLQQWCHEAEASGNAALQAYAARLKGDALSGA

SEQ ID NO: 8189 - protein, 345 aa, Candida glabrata
MPVATERRASMDDFDTDIITLPRFIVENQKTVKTARGDFSLVLNALGFAFKFISQTIRRAELVNLIGLAGASNSTGDEQKKLDVLGDEIFINAMKGCGFIKLLVSEEQEDLIVFPTETGTYAICCDPIDGSSNLDAGVSVGTIVSIFKLLPGSTGSIKDVLRSGHDMVAACYAMYGASTHLMLTMGNGVDGFTLDTNLGEFILTQPNLRIPQLRPIYSVNEGNRLYWDELIVSFIDSLKEGQESNKGKPYSLRYIGAMVADVHRTFLYGGLFSYPGDRLKPDGKLRLLYEAFPMAFLVEQAGGKAVNDQGERILDLVPKHIHDKSSIWLGSSGEIDKFLKHIGKE

SEQ ID NO: 8190 - protein, 449 aa, Arabidopsis thaliana
MNHNSNLVLPSHQTETQTQDETDISVWRFRGSDNAAKASSVTMRVIVYKLFDECSLDVKKPLLPLAHGDPSVYPCYRTSILVENAVVDVLRSGKGNSYGPAAGILPARQAVADYVNRDLTNKVKPNDVFITVGCNQGIEVVLQSLARPNANILLPRPSYPHYEARAVYSGLEVRKFDLLPEKEWEIDLPGIEAMADENTVAMVIINPNNPCGNVYSYDHLKKVAETAKKLGIMVITDEVYCQTIFGDKPFVPMGEFSSITPVITLGGISKGWIVPGWRIGWIALNDPRGILKSTGMVQSIQQNLDITPDATTIVQAALPEILGKANKELFAKKNSMLKQNVELVCDRLKEIPCLVCNKKPESCTYLLTKLKLPLLEDIEDDMDFCMKLAKEENLVLLPGVALGLKNWIRITIGVEAQMLEDALERLNGFCKRHLKKTESSFQALSNGKI

SEQ ID NO: 8191 - protein, 709 aa, Pseudomonas aeruginosa
MSEQNNEQRSQAAGTDTVDRGNSNAKLEQLEAYREDATGEALSTNTGTRIADNQNTLKAGERGPSLLEDFIMREKITHFDHERIPERVVHARGSAAHGYFEAYEDLSDLTKAGFLAEAGKRTPVFVRFSTVQGPRGSADTVRDVRGFAVKFYTDEGNFDLVGNNMPVFFIQDAIKFPDFVHAVKPEPHNEIPTGASAHDTFWDFVSLTPESAHMVMWLMSDRAIPIAYRNMQGFGVHTFRLVNAAGESVLVKFHWRPKSGTCSLVWDEAQKLAGKDPDFNRRTLWEDIEKGDYPEWELGLQVIPENQQDSFDFDLLDPTKLVPEELVPVRVVGRMVLNRNPDNFFAETEQVAFHVGHVVPGIDFTNDPLLQGRLFSYTDTQLLRLSGPNFNEIPINRPLCPFHNNQRDAPHRQTINRGRASYEPNSIDGGWPKETPPAARNGGFSTYHEPVSGSKLRKRADSFADHFSQAALFWHSMSEAEQAHIVAAYSFELSKVERQSIREREVNQILLNIDPQLAARVAANVGVQLAAPANPTPQPKPSPALSQMNLLSGDIRSRKVAILIADGVAESDVSDLRDALRQEGADAKLIAPSASPVQAENGAELSPEGTWDGLPSVAFDAVFVPGGAASSQAIGADGRGLHYLLEAYKHLKPVAFAGDAQALASQLSLPGDPGVVLGATATDVFPGLRQALMQHRIWQREAATKAIPA

SEQ ID NO: 8192 - protein, 341 aa, Musa acuminata
MDHEAEAHRTDLMTITRYVLNEQSRHQESRGDFTILLSHIVLGCKFVCSAVNKAGLAKLIGLAGETNVQGGSKRKLDVLSNEVFVKALISSGRTCILVSEEDEEATFVDPSLRGKYCVVFDPLDGSSNIDCGVSIGTIFGVYMVKDKDNVTLDEVLQPGKNMLAAGYCMYGSSCTLVLSTGSGVNGFTLDPSLGEFILTHPDIKIPKKGKIYSVNEGNAKNWDGPTTKYVEKCKFPKDGDSPKSLRYIGSMVADVHRTLLYGGIFLYPADKKSPNGKLRVLYEVFPMSFLMEQAGGQAFTGKQRALDLVPTKIHQRSPIFLGSYDEVEEIKALYAAEENTA

SEQ ID NO: 8193 - protein, 728 aa, Aspergillus fumigatus
MRLTFIPSLIGVANAVCPYMTGELNRRDEISDGDAAAATEEFLSQYYFNDNDAFMTSDVGGPIEDQNSFSAGERGPTLLEDFIFRQKIQRFDHERVPERAVHARGAGAHGVFTSYGDFSNITAASFLAKEGKQTPVFVRFSTVAGSRGSSDLARDVHGFATRFYTDEGNFDIVGNNIPVFFIQDAILFPDLIHAVKPRGDNEIPQAATAHDSAWDFFSQQPSTMHTLLWAMSGHGIPRSFRHVDGFGVHTFRFVTDDGASKLVKFHWKSLQGKASMVWEEAQQTSGKNPDFMRQDLHDAIEAGRYPEWELGVQIMDEEDQLRFGFDLLDPTKIVPEEFVPITKLGKMQLNRNPRNYFAETEQVMFQPGHIVRGVDFTEDPLLQGRLFSYLDTQLNRHGGPNFEQLPINQPRVPVHNNNRDGAGQMFIPLNPHAYSPKTSVNGSPKQANQTVGDGFFTAPGRTTSGKLVRAVSSSFEDVWSQPRLFYNSLVPAEKQFVIDAIRFENANVKSPVVKNNVIIQLNRIDNDLARRVARAIGVAEPEPDPTFYHNNKTADVGTFGTKLKKLDGLKVGVLGSVQHPGSVEGASTLRDRLKDDGVDVVLVAERLADGVDQTYSTSDAIQFDAVVVAAGAESLFAASSFTGGSANSASGASSLYPTGRPLQILIDGFRFGKTVGALGSGTAALRNAGIATSRDGVYVAQSVTDDFANDLKEGLRTFKFLDRFPVDH

SEQ ID NO: 8194 - protein, 355 aa, Aspergillus oryzae
MSGHENNGAPPVGKEKINTDIVTLTRFLTEEQTKVPEATGDFTLLCHALQFSFKSIAYYIRCAFLINLTGLAGSSNTTGDDQKKLDVIGNDIFISAMRGSGKCRILVSEEEEEAIIFDEHPYARYAVVCDPIDGSSNLDAGVSVGTIFGIFKLPDSVLGPENKVSPKDLLLPGTEMVASGFTMYGASAQLVITMRNGGVNGFTLENSLGEFILTHPNMTLPAKRAIYSVNEGNSSYWEEWTNAYFHSLKFPPEGQKPYSARYIGSMVADAYRTLLYGGVFAYPADKKAPKGKLRILYECAPMAMLFENAGGLAVNSRMERLLGVVPEHIHDKSGVFLGSKDEVQKIIDTYNKYKK

SEQ ID NO: 8195 - protein, 446 aa, Oryza sativa
MVGGGALRRVGKYEVGRTIGEGTFAKVKFAQNTESGESVAMKVVDRSSILKHKMADQIKREISIMKLVRHPNVVRLHEVLASRKKIFIILEFITGGELFDKIIRHGRLNEADARRYFQQLIDGVDFCHSKGVYHRDLKPENLLLDSQGNLKISDFGLSAWPAQGGALLRTTCGTPNYVAPEVLSHKGYDGALADTWSCGVILYVLLAGYLPFDEVDLTTLYGKIESAEYSFPAWFPNGAKSLIHRILDPNPDKRIRIEEIRNDEWFKKNYEPTREIESEEVNLDDVNAAFDDPEEDADHTLDDEAGPLTLNAFDLIILSQGLNLAALFDRRQDYDKLQNRFLSRKPAKVIMSSMEVVAQSMGYKTHIRNYKMRVEGLNANKTSHLAVMLEIFEVAPSIFMIELQRAAGDTSDYNKFINNYCSKLDDIIWNFPIEKSKSRISRLSKR

SEQ ID NO: 8196 - protein, 460 aa, Lactobacillus plantarum
MDKERQMPKDFFWGNSVSSMQTEGAWDEDGKGRSVYDVRPATATTSDWHDAIDEYHRYEEDLDLMKDLHLNMYRIQISWSRVVPDGDGEFNAAGIAFYDRLVDAMLARGITPMICLYHFDMPLALAENENGFMSRHTVDAFVRFGEKMIAHFADRVKYWIVFNEHNLYFTDEVFNISGYTKGDQSVNDLYRIFHHTMLAHARLDDFVHQNYDDVKIGGMLAYTPVYPETAKPIDIMAARKSDEFLNNNLNDAYVHGHYSPEVLRYVEQQGIDYDLQPGDEAIIGKMKADFLAFSYYRSTVINGDKIPVNAVPNRYLNYSFEANRFLQANEWGWAIDPLGFRNLITKLYDQYEVPVFPIENGIGLREHWDGQHMIEDDERITYHEEHIKAMKDAMLIDGAKVLGYLGWGLIDIPSSHADIEKRYGVVYVNRSNHDLKDLKRVPKKSYYWLQGVLAKNGDEL

SEQ ID NO: 8197 - protein, 190 aa, Gleditsia triacanthos
KFHEDDHGEVVSEIRRSDLEPYLGLHYPATDIPQASRFLFKQNRVRLICDCHANPVRVIQSEELRQPLCLVISTLRSPHGCHTQYMANMGSIASLVMAVIVNGTDTTKLWGLLVCHHTSPRHVPFPLRYACEFLMQAFGLQLYSDMQLASQMAEKRILRTQTLLCDMLLRDSPFGIVTQSPNIMDLVKCD

SEQ ID NO: 8198 - protein, 220 aa, Oryza sativa
MTAALQALLDPTALSLGLPTPAINKEEYLAICLAALACTRAGKALVGVGGQQQVQACSKWLCPAPAAPEELRFRCTVCGKAFASYQALGGHKSSHRKPPSPGDHYGAAAAAQQLASAGDSKEDSASSAAGSTGPHRCTICRRSFATGQALGGHKRCHYWDGTSVSVSVSASASAASSAVRNFDLNLMPLPESTAAAGIKRWAEEEEVQSPLPVKKLRMSN

SEQ ID NO: 8199 - protein, 139 aa, Glycine max
WKYRVVGSVAALLLLLAIVVPFTQTQTQSARDKAAMAEDAGPLVGGISDSPMGQENDLDVIALARFAVSEHNNKANALLEFENVVKVKKQTVAGTMHYITIRVTEGGAKKLYEAKVWEKPWENFKKLEEFKLVEDVPSA

SEQ ID NO: 8200 - protein, 143 aa, Unknown
  Polaromonas sp. JS666
MTTHLRVFEPGISDTFESALRRFFSPVPLDINPQAIQMRLDVSEKKDAYVVKADLPGVKKEDINVRIDGNIVQIDAEVKQEKETRGSDDKVLRSERYYGSVSRTFSLSQDVDDAKAVAKYADGVLTLELPKKTTAASKKLTVQ

SEQ ID NO: 8201 - protein, 503 aa, Micrococcus luteus
  misc_feature (53)..(53): Xaa can be any naturally occurring amino acid
  misc_feature (144)..(144): Xaa can be any naturally occurring amino acid
  misc_feature (166)..(166): Xaa can be any naturally occurring amino acid
  misc_feature (185)..(185): Xaa can be any naturally occurring amino acid
  misc_feature (376)..(376): Xaa can be any naturally occurring amino acid
MEHQKTTPHATGSTRQNGAPAVSDRQSLTVGSEGPIVLHDTHLLETHQHFNRXNIPERRPHAKGSGAFGEFEVTEDVSKYTKALVFQPGTKTETLLRFSTVAGELGSPDTWRDVRGFALRFYTEEGNYDLVGNNTPIFFLRDPXKFTHFIRSQKRLPDSGLRDATXQWDFWTNNPESAHQVTYLXGPRGLPRTWREMNGYGSHTYLWVNAQGEKHWVKYHFISQQGVHNLSNDEATKIAGENADFHRQDLFESIAKGDHPKWDLYIQAIPYEEGKTYRFNPFDLTKTISQKDYPRIKVGTLTLNRNPENHFAQIESAAFSPSNTVPGIGLSPDRMLLGRAFAYHDAQLYRVGAHVNQLPVNRPKNAVHNYAFEGQXWYDHTGDRSTYVPNSNGDSWSDETGPVDDGWEADGTLTREAQALRADDDDFGQAGTLVREVFSDQERDDFVETVAGALKGVRQDVQARAFEYWKNVDATIGQRIEDEVKRHEGDGIPGVEAGGEARI

SEQ ID NO: 8202 - protein, 246 aa, Antirrhinum majus
MASLSDQSTEVSPERKIGRGKIEIKRIENKTNQQVTFCKRRNGLLKKAYELSVLCDAEVALVVFSSRGRLYEYANNSVKATIDRYKKASSDSSLNGSISEANTQYYQQEASKLRAQISNLQNQNRNMLGESLGALSLRELKNLESRVERGISRIRSKKNELLFAEIEYMQKRQEIDLHHNNQYLRAKIAESERVQGQHMNLMPGGSSGYEQLVETQPFDARNYLQVNGLQPNNDYPRQDQLPLQLV

SEQ ID NO: 8203 - protein, 186 aa, Gymnocladus dioica
MAYKFHEDDHGEVIAEITKPGLEPYLGLHYPATDIPQAARFLFMKNKVRMIVDCHARHVKVLQDEKLPFELTLCGSTLRAPHTCHLQYMENMNSIASLVMAVVVNDNDEDVDSSDSIQPQKRKRLWGLVVCHNTTPRFVPFPLRYACEFLAQVFAIHVNKELELENQIVEKKILRTQTLLCDMLMR

SEQ ID NO: 8204 - protein, 184 aa, Gymnocladus dioica
HGEVVSEIRRSDLEPFLGLHYPATDIPQAARFLFKQNRVRMICDCHANPVKVIQSEESRQPLCLVNSTLRSPHQCHAQYMENMGSIASLVMAVIVNGNDTTKLWGLLVCHHTSPRHVPFPLRYACEFLMQAFGLQLYMEMQLASQMAEKRTLKTQTLLCDMLLRDALFSIVTQSPNIMDLVKCD

SEQ ID NO: 8205 - protein, 844 aa, Saccharomyces cerevisiae
MKPYLFDLKLKDTEKLDWKKGLSSYLKKSYGSSQWRTFYDEKATSELDHLRNNANGELAPSSLSEQNLKYYSFLEHLYFRLGSKGSRLKMDFTWYDAEYSSAQKGLKYTQHTLAFEKSCTLFNIAVIFTQIARENINEDYKNSIANLTKAFSCFEYLSENFLNSPSVDLQSENTRFLANICHAEAQELFVLKLLNDQISSKQYTLISKLSRATCNLFQKCHDFMKEIDDDVAIYGEPKWKTTVTCKLHFYKSLSAYYHGLHLEEENRVGEAIAFLDFSMQQLISSLPFKTWLVEFIDFDGFKETLEKKQKELIKDNDFIYHESVPAVVQVDSIKALDAIKSPTWEKILEPYMQDVANKCDSLYRGIIPLDVYEKESIYSEEKATLLRKQVEETETANLEYSSFIEFTNLPRLLSDLEKQFSDGNIFSNTDTQGQLMRDQIQTWCKFIQTNEFRDIEEQMNKIVFKRKQILEILSALPNDQKENVTKLKSSLVAASNSDEKLFACVKPHIVEINLLNDNGKIWKKFDEFNRNTPPQPSLLDIDDTKNDKILELLKQVKGHAEDLRTLKEERSRNLSELRDEINNDDITKLLIINKGKSDVELKDLFEVELEKFEPLSTRIEATIYKQSSMIDDIKAKLDEIFHLSNFKDKSSGEEKFLEDRKNFFDKLQEAVKSFSIFASDLPKGIEFYDSLFNMSRDLAERVRVAKQTEDSTANSPAPPLPPLDSKASVVGGPPLLPQKSAAFQSLSRQGLNLGDQFQNLKISAGSDLPQGPGIPPRTYEASPYAATPTMAAPPVPPKQSQEDMYDLRRRKAVENEERELQENPTSFYNRPSVFDENMYSKYSS

SEQ ID NO: 8206 - protein, 50 aa, Pisum sativum
PKMTLEKLLEYGNMLVQEQENVKRVQLADKYLSEAALGDANEDAIKRGTF

SEQ ID NO: 8207 - protein, 238 aa, Ceratopteris richardii
MVRRKIKIKRIENATTRQVTFSKRRGGLLKKAHDLSVLCDAEVAVIIFSSKGKLFQFANPSMETVLGRYVKASRDPEAGDNGSSTDNVEADRLTVFTEKLKMLQSNVIGDDLERLSLRDLIHLEQQVHESLGHIRAKKDELILEQIDEFKQKMADTRRTTNANTSMLDRLVDFCSSGITGSQNIVASEPGYVVGVPRTDTLRAGWIATSDQSNDGPEYVPCAKRFRITEGLNESPASE

SEQ ID NO: 8208 - protein, 97 aa, Glycine max
MAALGGNRDVTGSQNSVEIDALARFAVEEHNKKQNALLEFEKVVTAKQQVVSGTLYTITLEAKDGGQKKVYEAKVWEKSWLNFKEVQEFKLVGDAPA

SEQ ID NO: 8209 - protein, 157 aa, Brassica napus
MFDMGPPISSELQVVSFHTVSKGYWGECGQRGGYFEMTNLPPKTVDEIYKVASIALSPNVPGQIFMGVMVNPPKPGDISYLKFAAESKSIHESLRRRARMMTDGFNSCRNVVCNFTEGAMYSFPQIRLPPRAIEAARRAGQSADVFYCLKLLEATGI

SEQ ID NO: 8210 - protein, 137 aa, Schizosaccharomyces pombe
MPPSTVNQEVNSILFIKNLSFKITAEEMYDLFGRYGPVRQIRLGNTVQTRGTAFVVYENVQDARRACEKLSGYNFMDRYLVVHYYNPERAKVDGQDLAARFPLSINSVEENIQQKNESAHIKQSFTSVSNLGIKKVL

SEQ ID NO: 8211 - protein, 212 aa, Zea mays
  misc_feature (160)..(160): Xaa can be any naturally occurring amino acid
  misc_feature (186)..(186): Xaa can be any naturally occurring amino acid
ALTEENLLFLEAWRAVDRAYYDKSFNGQSWFRYRENALRNEPMNTREETYAAIKKMLSTLDDPFTRFLEPEKLKSLRSGTQGALTGVGLSIGYPMAINGSPSGVAVMTATPGGPAEKAGILPGDTILAIDNRSTEDMDIYDAAERLQGPEGSSVDLSIRXGTNTRHVVLKYKQSNLNPVRSRMCEXIPGSKDSSKIGYIKLTTFNQNAAGMQ

SEQ ID NO: 8212 - protein, 404 aa, Prosthecochloris aestuarii
MPYTHSPVFTPAQRVQNYNYAIRNIVTHARKLEAQGKKITYLNIGDPVLYGFQPPEELIEANVLALRHGHNGYSPSSGRKEAVEAIAEDACRRGISTSPDNVIITFGASEAADLVCTSMLNPGDEVLCPSPGYPLYNAIIAKLNAREVRYSLDPANDWLPDPEQVEKSITPRTKILVVINPNNPTGELYSRETLDMFVDIARRHKLLIITDEVYHKLVYEGEHIPLASLASDDVAVITIDSLSKNYMAPGWRTGWLMITNSALIPDVRQAFIKLADARLCAPMAPQYTIKAAMTMGPEYNETILSRLRAQRELTIDRLNAIEGFSCNKPSGAFYVMGKLDLDATPFKTDEEFVLKLLQEKQVLFVHGSGFGTDPASGYARIVYLPDVTILEKVYADVADFINSL

SEQ ID NO: 8213 - protein, 783 aa, Bordetella parapertussis
MKIVCLGGGPAGLYFGLLMKLQDPANEVTVIERNRPYDTFGWGVVFSDATMDNLRQADPVSAKTIGDAFNHWDDIEIHYRDRSIRTSGHGFIGIGRKHLLNILQARCEEVGVKLVFETFVQDDQALARDYDADLVIAADGINSVVRTRYADTFTPDIDQRRCRFVWLGTTKVFDAFTFAFVQNEHGWFQAHAYRFEDGLSTFIVETPEETWQSAGIEGMSQEDGIAYCERLFAPWLDGHRLISNAKHIRGAAIWIRFPRVICPHWVRWNRLQTPRGERDVPVVLMGDAAHTAHFSIGSGTKLALEDAIELARCLDGRRGDLRGALQHYEDVRSVEVLKIQNAARNSTEWFENVRRYANLEPEQFAYSLLTRSQRISHENLRLRDAAWLQGYEAWIAERAGAGPAPGAQAPLPMLTPFQARSVRLANRIVVSPMAMYSCVDGVPGEFHLVHLGARALGGAGLVMVEMTCTSPDARITPGCPGLWNDEQAGAFGRIVDFVHGNSAARIGIQLGHAGRKGSTQLGWQQMDHPLPEGNWPLLSASALPYLPGVSQTPRAMTRADMDRVREDFAAAARRAARAGFDWLELHCAHGYLLSSFISPLTNQRDDEYGGSLENRLRYPLEVFRAVRQAWPAELPMSVRISAHDWVEGGITADDAVEIARHFKAAGADMIDCSSGQVSPDQQPVYGRMYQTPFADRVRNEAGIATIAVGAIFEADHANGIIASGRADLCALARPHLADAAWTLREAARVGYRDVHWPDQYVAGKRQLETNFERAAMLAQLDIK

SEQ ID NO: 8214 - protein, 732 aa, Pseudomonas aeruginosa
MSEPMSERERWQLELDKLQRGLQGDPFAFLGPQRDPGGEGGVLRAYLPGAQRVELLDEDGATLAELEQSDPGSGLFQRHLERLPPRYRLRVHWPDGVQESEDPYAFGPLLGELDLYLFAEGNHRQLASCLGAQLTRHEGVEGVRFAVWAPNAVRVSVVGDFNGWDGRRHPMRRRYPSGVWELFVPRLGEGELYKYELQGHDGLLPLKADPLALACETPPGTASKTCAALRHEWRDQDWLARRAERQGYAAPLSIYEVHAGSWRHRDGRPPHWSELAEELIPYVRQLGFTHIELMPVMEHPFGGSWGYQPLGLFAPTARYGTPEDFAAFVDACHQAGIGVILDWVPAHFPTDAHGLGRFDGTALYEYEHPFEGFHQDWDTYIYNLGRSEVHGFMLASALHWLRTYHVDGLRVDAVASMLYRDYSRKEGEWLPNRHGGRENLEAIDFLHHLNQVVASETPGALVIAEESTAWPGVSRPVAEGGLGFSHKWNMGWMHDSLAYIGEDPLHRRYHHHQLTFGLLYAFSEHFILPISHDEVVHGKHSLLDKMPGDRWQKFANLRLYLSFMWSHPGKKLLFMGCEFGQWREWNHDGELDWYLLRYPEHQGVQDLVAALNRLYRELPALHARDGEALGFEWLIGDDQANSVYAWLRHAAGEPSLLAVHNFTPVPRQGYRIGVPQGGDWDVLLNSDAQAFAGSGAGSQGRVSSESCGAHGQAQSLVLDLPPLGTLLLRPAG

SEQ ID NO: 8215 - protein, 248 aa, Oryza sativa
MGRGRVELKRIENKINRQVTFAKRRNGLLKKAYELSVLCDAEVALIIFSNRGKLYEFCSGQSMTRTLERYQKFSYGGPDTAIQNKENELVQSSRNEYLKLKARVENLQRTQRNLLGEDLGTLGIKELEQLEKQLDSSLRHIRSTRTQHMLDQLTDLQRREQMLCEANKCLRRKLEESNQLHGQVWEHGATLLGYERQSPHAVQQVPPHGGNGFFHSLEAAAEPTLQIGFTPEQMNNSCVTAFMPTWLP

SEQ ID NO: 8216 - protein, 466 aa, Lactococcus lactis
MLYGKENRDEAEFLEPIFGSESEQVDLPKYKLAQQSIEPRVAYQLVQDEMLDEGNARLNLATFCQTYMEPEAVKLMSQTLEKNAIDKSEYPRTTEIENRCVNMIADLWNASEKGKIYGTSTIGSSEACMLGGMAMKFSWRKRAEKLGLDINAKKPNLVISSGYQVCWEKFCVYWDIEMREVPMDREHMSINLEKVMDYVDEYTIGVVGIMGITYTGRYDDIKALDNLIEEYNKQTDYKVYIHVDAASGGLYAPFVEPELEWDFRLKNVISINTSGHKYGLVYPGVGWVLWRDKKYLPEELIFKVSYLGGELPTMAINFSHSASQLIGQYYNFVRYGFDGYKAIHERTHKVAMYLAEEIEKTGMFEIMNDGAQLPIVCYKLKENSNRGWNLYDLADRLLMKGWQVPAYPLPKNLENEIIQRLVIRADFGMNMAFNYVQDMQEAIDALNKAHILFHQEPENKTYGFTH

SEQ ID NO: 8217 - protein, 336 aa, Oryza sativa; identical to SEQ ID NO: 161

SEQ ID NO: 8218 - protein, 360 aa, Triticum aestivum
  misc_feature (302)..(303): Xaa can be any naturally occurring amino acid
  misc_feature (310)..(310): Xaa can be any naturally occurring amino acid
  misc_feature (313)..(313): Xaa can be any naturally occurring amino acid
AYLGDTIEQVCTKKQAGTGPEFPGYRRPTRPLLSGGLDSSLVASVVSRYLAETKVARQWGNKLHTFCIGLKGSPDLKAAKEVADYLGTVHHELHFTVQQGIDALEEVIYHIETYDVTTIRASTPMFLMSRKIKSLGVKMVLSGEGSDEIFGGYLYFHKAPNKKELHEETCRKIKALHLYDCLRANKATSAWGLEARVPFLDKNFINVAMDLDPECKMIRRDLGRIEKWVLRNAFDDEKKPYLPKHILYRQKETVQRMGLGTSWDGWVWKDHANAHVPESMMTNAYFVYLKTHHNKRTYYYRXXLRILPKXLLXNGPGGHVACTRKTVEWDPPGQASPSAVALVYTRLRERPDRYPLEASS

SEQ ID NO: 8219 - protein, 336 aa, Rubrivivax gelatinosus
MTRRISLTQYLVEEQRERGRIPAQLRLLLEVVARACKSIAISVNKGALGGVLGSAGSENVQGEVQKKLDIIANEVLIEANEWGGALAAMASEEMDSIYVVPNRYPQGEYLLLFDPLDGSSNIDVNVSIGTIFSVLKKQSDTPGVSTQDFLQPGSAQVAAGYCVYGPQTTLVLTVGDGVAMFTLDREQGSWVLTTDEVRIPEDTREFAVNMSNQRHWAPPMQRYIDECLQGKDGPRGKDFNMRWVASMVADVHRILCRGGVFMYPWDKREPAKAGKLRLMYEANPMGFIVEQAGGAATNGKQRVLDLQPSQLHERVSVILGSKNEVERASAYHREAG

SEQ ID NO: 8220 - protein, 670 aa, Unknown
  Parachlamydia sp. UWE25
MNIQITPGSPFPFGANIQEGKVNFALYAKNIEKISLCLFNENDPLNPFKEIELEPSLNKTGNVWHIAIESLPPYTLYAFRVPVENSNYLLIDPYAKSIYSSPDWGNAKPYSPLGRIIPLTTFDWEGIPSPKLPSKDLIIYEMHIRGLTQDQSSQVSHPGTYLGVIEKIPYLKELGINAVELMPIYEFNESEALQINPKTQQKLVNYFGYSTVNFFSPMNRYASEIQENKTLVEFKTMVKELHRHGIEVILDVVYNHTFEGNQMGPIQSFRGLDKHAYYMIDEQGNYLNFSGCGNTFNANHPIVKEFIIQSLRYWVTEMRVDGFRFDLASILCRSENGTPLNPSPLIEAISHDPILSQTKLIAEAWDAGGLYQVGGFYPGQRWAEWNGHYRDIVRRFIKGTSGHKTAFATALSGSQDLYGWRGTPCCSINFITAHDGFSLADLVTYNDKHNLDNGEENRDGFDHNDSWNCGIEGHSNNKKIVALRERQIRNFLLALLVSQGIPMILMGDEYAHTRDGNNNTWCQDNKLNWFLWDKLLEKQSVFRFFKSLITFRKNYPLLKRDTFLEETDVTWHGQVPFNPDWENDNKFIAFSLNIPHEGPDLYVAFNASHVVLTVTIPPARQGMHWVWLVNTHNVAPGDFFEESCRKRVNSNTLKIPSYTSIALKAEVDRS

SEQ ID NO: 8221 - protein, 411 aa, Solenostemon scutellarioides
MELQNSAQEMEAPTTITIKGILGLLMANTDAKENGKRVISLGIGDPTAYSCFHASNAAQEGVVECLRSAKFNGYAPTAGLPQTRQAIAEYLSRDLPYKLPAESVYVTAGCTQAIEIALSVLARPGANILLPRPCFPIYGLCASFRNIEVRYFDLHPEKGWEVDLQAVEDLADHNTVAMVIINPGNPCGNVYSYQHLKKVAETAKRLGIVVIADEVYGHLAFGANPFVPMGNFGSIAPVVTLGSLSKRWLVPGWRLGWLVINDPDGTLMSPKFVERIKKYCDICGGPATFIQAAVPEIVEQTQEVFFRKTINILRQTSDICCQKIEEIDGITCPTKPKGAMAFMVKLNISRMKDISDDIDFCFKLAKEESVIILPGIAVGLNNWLRITFAVEPSALEEAMERLKSFCIRHSY

SEQ ID NO: 8222 - protein, 585 aa, Triticum aestivum
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPLYIGWGIDGSVWISSEVKGLNDDCEHFEIFPPGHLYSSKQGGFKRWYNPPWFSEVIPSVPYDPLALRKAFEKAVIKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSRKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWMLRKAFDDEEQPFLPKHILYRQKEQFSDGVGYSWIDGLKAHAESNVTDKMMSNAKFIYPHNTPTTKEAYCYRMIFERFFPQNSAILTVPGGPSVACSTAKAVEWDAQWSGNLDPSGRAALGVHLSAYEQEHLPATILTGTSKKPRMIEVAAPGVAIES

SEQ ID NO: 8223 - protein, 208 aa, Enterolobium cyclocarpum
RVMAYKFHEDEHGEVVSEVKKPGLESYMGLHYPATDVPQATRFLFMKNKVRMIVDCRAKHVKVLQDENLPYDLTFCGSTLRAPHSCHVQYMQNMDLVASLVMAVVINDRDEDGDSSDSVQPQKRKRLWGLVVCHNYTPRFVPFPLRYACEFLAQVFAIHVNKEIELEYQIIEKNIMRTQSLLCDMLMRDEPLGIISQSPNIMDLVKCD

SEQ ID NO: 8224 - protein, 1383 aa, Streptomyces avermitilis
MSENSATRVLEDGQIRASDLRPLLAAMTAARDGIFTRVPETGHGLVAELSTAFNQIMDRNAHFNSEVQRVRRELVRHGRLDERLSASPGQGYWAARVSDVNQLLDALVAPAANATRVLDAVAGGDLTQRVDLHDGNRQLRGDLRRLGRAVNKMVDQLSLFTGEVTRVAREVGTEGRLGGRAKVQGLSGSWRDVTEAVNTMASRLTAQVRDIALVTTAVARGDLTRTVTVEATGELLELKLTVNTMVDQLSAFADEVTRVAREVGTEGQLGGRAQVRGVSGVWKDLTDNVNFMASNLTSQVRNIAQVTTAVANGDLSQKITVDAQGEILELKSTINTMVDQLSAFADEVTRVAREVGTEGNLGGRAQVRGVSGVWKDLTDNVNFMADNLTSQVRNIALVSTAVAQGDLGKKITVEAKGEILELKSTINTMVDQLSAFADEVTRVAREVGTEGNLGGQAQVRGVSGVWKDLTDNVNFMALNLTSQVRNIAQVTTAVANGDLSKKITVDARGEILELKDTVNTMVEQLRAFADEVTRVAREVGTDGRLGGRAQVLGVSGVWRDLTDNVNYMADNLTSQVRNIAQVATAVAQGDLSKKIDVDARGEILELKTTINTMVDTLSSFSSEVTRVAREVGSEGQLGGQARVEGVYGTWKRLTTNVNELALNLTTQVRAIAEVASAVAQGDMSRSISVETRGEVAELKDNINLMVANLRETTRAKDWLESNLARLAALMQGHRDLMEVADLILRELTPLVNAQYGAFFLADPDEDGASLRTTVPAKGLAFIAGYGSAHSVTVDTGGMPVHGLVRQAAREKKRILVEEAPPDYIKINSGLGEAAPASVVIIPILFEDKLLGVIELASFSRFSDVHLAFFDQFVNTIGVAINTIIANSRTESLLGESQRLAIQLQDRSDELQSQQAELQRSNAELEEKAALLATSSQYKSEFLANMSHELRTPLNSLLILARLLSDNPDGHLSDQEVQFATTIHRSGSDLLQLINDILDLSKIEAGRMDVRPKKLPLIKLLDYVHATFRPLTIDRGLAFDVAVGEDVPREMYSDEQRLQQILRNLLSNAIKFTASGRVELRVGRVKDPEHRYTREDSEEVIAFAVSDTGIGIAPEKLPVIFEAFQQADGTTNRKYGGTGLGLSISREIAGLLGGRIIAESVPGKGSTFTLYVPVVSPGHAATGPAPEERPLPTPEQLSTESYITHDPEDSWPAPTKLEEWQVGRAGQVLPGRRVLIVDDDIRNVFALTHVLGRVGMPVLYAENGREGIETLERNPDVELVLMDIMMPEMDGYETISVIRRTPRWAGLPIVALTAKAMPGDREKSIARGANDYVPKPVDVDQLLTVVCALLDPEGADAEERDDFAEPTDPGPVTSGEPAVPPLTE

SEQ ID NO: 8225 - protein, 362 aa, Idiomarina loihiensis
MSALFQPFELKDVRLRNRIAVPPMCQYMAEDGVVNDWHLSHYTSLARGGAGLVIVEATAVSPEGRITPNCTGLWNDEQAQAFAPVVENIKKAGAVAGIQIGHAGRKASANRPWDGDDHIAENDTRGWQPISPSPIAFGANLPREPEEMSLDDIKRVQIDFVAAAERARDLGFEWLELHFAHGYLGQSFFSAHANQRTDEYGGSFENRARFLVETVRAVKQVWPDNFPLTARFGVIEFDGNDEQQMQESVKLTQLLKAEGLDFLNVSISFSTPNANIPWGPGFMAPIAERIRKEVDIPVASAWGIDLPQLAEHTIAQGQLDLVMVGRAHLENPHWPYDAAKVLRVEKPSWVLPAPYAHWLERY

SEQ ID NO: 8226 - protein, 207 aa, Cyclolobium nutans
VMAYKFHEDDHGEVIAEITKPGLEPYLGLHYPATDIPQAARFLFMKNKVRMIVDCHAKHVKVLQDEKLPFDLTLCGSTLRAPHSCHLQYMANMDSIASLVMAVVVNDSDEDGNSSDAVQPQKRKRLWGLVVCHNTTPRFVPFPLRYACEFLAQVFAIHVNKEIELEYQIIEKNILRTQTLLCDMLMRNAPLGIVSQSPNIMDLVKCD

SEQ ID NO: 8227 - protein, 404 aa, Neisseria meningitidis
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLNDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKAYRVAGFRQGWMVLNGPKHHAKGYIEGLDMLSSMRLCANTPMQHAIQTALGGYQSINEFILPGGRLLEQRNRAWELVNQIPGVSCVKPMGAMYMFPKIDTEMYRIRDDMKFVYDLLVREKVLLVQGTGFNWIKPDHFRIVTLPYVHQIEEAMGRLARFLQTYRQ

SEQ ID NO: 8228 - protein, 460 aa, Oryza sativa
APGYHTLSFGITAFFGVMAEQRGNMLMKKYEMGKLLGQGTFAKVYHARNTETSESVAIKMIDKEKVLKGGLMDQIKREISVMKLVRHPNIVQLYEVMATKTKIYFVLEHVKGGELFNKVQRGRLKEDAARKYFQQLICAVDFCHSRGVYHRDLKPENLLLDENSNLKVSDFGLSALADCKRQDGLLHTTCGTPAYVAPEVINRRGYDGAKADIWSCGVILFVLLAGYLPFHDKNLMDMYKKIGKAEFKCPSWFNTDVRRLLLRILDPNPSTRISMDKIMENPWFRKGLDAKLLRYNLQPKDAIPVDMSTDFDSFNSAPTLEKKPSNLNAFDIISLSTGLDLSGMFEESDKKESKFTSTSTASTIISKIEDIAKGLRLKLTKKDGGLLKMEGSKPGRKGVMGIDAEIFEVTPNFHLVELKKTNGDTLEYRKVLNQEMRPALKDIVWAWQGEQPKQQQQPTC

SEQ ID NO: 8229 - protein, 206 aa, Cyclolobium nutans
MAYKFHEDDHGEVIAEVTKPGLEPYLGLHYPATDIPQATRFLLMKNKVRLIVDCCAKHVKVLQDKKIPFELTLCGSTLRAPHSCHIQYMLNMNSIASLVMAVVVNDSDEDGDSSDAVQPQKRKRLWGLVVCHNTTPRFVPFPLRYACEFLAQVFAIHVNKEIELEYQIIEKNILRTQTLLCDMLMRNAPLGIVSQSPNIMDLVKCD

SEQ ID NO: 8230 - protein, 587 aa, Magnaporthe grisea
MATAIQTAHRSHHLVNMRSSESDNIQTRTIPILTPTIQMSAPSPGDPMDISTPTSASAPQSANRSPESERNGLTASSGAKLGAGEHRSSTPKAEQQQTTNPVAMPAPAAAAAAVHQPKIVQTAFIHKLYNMLEDPNIQHLISWSPSQESFLMSPSNDFSKVLAQLNMYGFHKVSDVFHNGSDSTLWEFKHGNNNFKRGDIIGLREIKRRASRHALVHKEYNQRPTPPQPGTPAEPMPIQDGTDPRIANMENALYDLSMRLQRSEESSHYMHIKQQAAMDTMGRLLQLNQELARTVLTLVPNPDNPTHRDVIALQGSLQRQAEMIRTLEEPHDQPLSSGRHYFSQLENAPVSPRQMPQDDPRRANLTVPPHRPSNYYRPQVPSNLSLNTRRPYGSIGGGTPSQSSPSTLRPQPPPPPAPQQHPQHPLANVELPPSSLARRHTSADIRGHGWPVPQASPSASGPPSGPPSTQWPSSPNRSVPTDDQRIRDSFSTYSIQNATPQSHSRPETPPPPPFSNGGSGLDTLTSWTWNSASSGRSGGLTVKDSSAPPTRRGSMAHILNPTDTAESPHEDMDDPRGDDDRKRKRLQ

SEQ ID NO: 8231 - protein, 300 aa, Unknown
  Synechococcus sp. PCC 7002
MTHYSNVLDPIPSTPPQPNPRPRNYSRLTRLSYATGPVWIILCHLGMAIAFFTGLSWGAVLWIVFWYWLRMLGTTAIYHRLLTHKAYQASPWVKWIGSFITASAGQMGPSWWKAHHEDHHRFSDHPGDPHSSKEGFWWAHYRWLISPNTFPKKLPADIERDPILKLIDRFHFVPLIALGALSYGVGGLEYLAAFFISTTLLFHGVAFVNSVCHKWGDRPFQTTDHSRNNSWVAVLALGEGWHNLHHAFGWSVRHGITIQKGKVKYLPDFTYSFIRLLERMGLASKLKQPTVTDLQNAANP

SEQ ID NO: 8232 - protein, 222 aa, Solanum habrochaites
MNIFETYNSDSLISTESSSSSSSSSSSLFSEEEIILASNNPKRPAGRKKFRETRHPIYRGIRKRNSGKWVCEVREPNKKTRIWLGTFPTAEMAARAHDVAALALRGRSACLNFSDSAWRLPIPASSNSKDIQKAAAEAAEIFRPLKESEEVSGESDNSTSPETSENVQESSDFVDEEAIFFMPGLLANMAEGLMLPPPQCAEMGDHYVETDAYMITLWNYSI

SEQ ID NO: 8233 - protein, 594 aa, Cryptococcus neoformans
MSAAVPPMTPPLEKEESELVHRRPSPVDQLDPAFTPPHTPEQNPCKSTKGKGIDPIDPTLLASDRHIPDNYVSYTIANQKYLPPITWKNLIYNIQWISFLALTVTPSLAIYGVFTTAWNTKTAIWSVIYYFITGLGITAGYHRLWAHRAYNASVPLQFALAIAGTGAVEGSIKWWCRGHRAHHRYTDTELDPYSAEKGFFWSHVGWMLVKPRGKIGVADVSDLSRNRVVKWQHRHYIPLILGMGFVLPTVVAGLGWGDWRGGFFFAGAARLCFVHHSTFCVNSLAHWLGEQPFDNKHSPRDHIITALCTIGEGYHNFHHQFPQDFRNAIKWFQYDPTKWFIWTMSQLGLASHLKRFPDNEVKKGQYTMKLRLLKEQADQLEWPKSSNDLPVISWDDFKAEAKERSLVAIHGFIHDCSSFVEDHPGGAHLIKRAIGTDATTAFFGGVYDHSNAAHNLLAMMRVGILDGGMEVEHLKRRPAESAASSVTNSPVSSASASSVDIQSLADDDFRLDQTQLNSQGPKPKAPFGQPQAQVADRWTLSVPPSEKLRIVQTVPEIRPGLLTHRSTGKLNKVTKADVGGEINEFIGEKPVAAA

SEQ ID NO: 8234 - protein, 371 aa, Arabidopsis thaliana
MASLLTKPKPVFLCSPSLSPRTLNTATPSLNFTRISFTHHQKLAPFKPPSLVVAFSEKGLKRDVTTAAAATEGDYRRIMLSDVLVKKKEKVVWWEREWKAMDFGAVAVVLSMHLLSLLAPFQFNWRAVSVAFGLYIVTGLLGITLSFHRNLSHKAFKLPKWLEYLFAYCGAQALQGNPIDWVSTHRYHHQFCDSDRDPHSPLDGFWFSHMNWMFDTNTITQRCGEPNNVGDLEKQPFYRFLRTTYILHPLALAVALYAMGGFPFIVWGMGVRIVWVYHITWLVNSACHVWGKQAWNTGDLSKNNWWVAALAFGEGWHNNHHAFEFSARHGLEWWQLDMTWYVVKFLQAIGLATDVKLPSEAQKQRMAFTSD

SEQ ID NO: 8235 - protein, 471 aa, Triticum aestivum
  misc_feature (333)..(333): Xaa can be any naturally occurring amino acid
  misc_feature (401)..(401): Xaa can be any naturally occurring amino acid
MGATGDSEVAAAEGAAAGCRARAALLGAYELGRTLGEGNFGKVKQARHRATGEHFAVKILDRGRVLSLRGADDQVRREIATLTMLAHPNVVRLHEVAASKTKIYMVLEFVNGGELFDRIAIKRKLSEREGRRLFQQLIDGVSYCHGKGVYHRDLKPENVLIDRKGNIKISDFGLSALPQHLGNDGLLHTTCGSPNYIAPEVLQNRGYDGSLSDIWSCGVILYIMLVGHLPFVDRNMVVLYQKIFKGDTQIPEWLSPGAQNLLRRILEPNPMKRINMAEIKIHEWFQKDYIPAAPYDDDDEDVRLGAILPIKQQISEAPGDKSTHQMNAFQLIXMASSLDLSGLFEEEGVSQRKIRFTSAHPPKDLFDKIEVSATQSGFHVQRAHSKLKITGNCNGPNNPHXFLVCAEVFVLGPSLHVVELRKSHGDTAVYRQLCDRISSDLGIDKIFGMGSLFDDNLPGFDSRAATPLVAL

SEQ ID NO: 8236 - protein, 532 aa, Yarrowia lipolytica
MSKELYANSKDDAVYSTSFGVPFPHHPYSAQRAGPTGPLLLQDTYLIDALAHFDRERIPERVVHAKGGGAHGYFEVTDDLSDITYAEPFQKAGYKCPVTVRFSTVGGERGSADSARDPRGFSIKHRTDWGNWDMVANNTPIFFIRDPIKFPHFIHTQKRDPQTNLGAGPDASHFWNYLTQNPESLHQITYMFGDRGTPDGWRHMNGYSGHTFKFISKEGKITYTQFHYITDQGVKNLSAEKAGELAGANPDSSQQDLFEAIDNGDYPSWTVYVQTMTPEQAEKFRYSILDLTKVWSHKEFPLRKVGKFVLNKNADNYFEEIEQVAFSPSNLPNGLEASADPVLQSRLFSYPDTHRHRLGPNFNQLPVNQPRTFQKGSGCPFLAGNFQRDGNMAINNQGNRPNYLSTIRPIQSVSVPDEDFKSTHNYTGVVTKKMEDESLSVQTEEAKKHDEKIWEGASYIYVSGIQDIDAEQPRALYEKVYDDAAKARFIENVVGHASSIKQPGLKEQVAKYFGQINDDLGQKVAKGLGVSY

SEQ ID NO: 8237 - protein, 512 aa, Nicotiana attenuata
MDGSTVQGGSSVESFLRNYKLGKTLGIGSFGKVKIAEHTLTGHKVAVKILNRRKIKNMDMEEKVRREIKILRLFMHPHIIRLYEVVETPSDIYVVMEYVKSGELFDYIVEKGRLQEDEARKFFQQIISGVEYCHRNMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGMYTLPSHLSAGARDLIPRMLIVDPMKRMTIPEIRMHPWFQAHLPRYLAVPPPDTMQQAKKIDEDILQEVVKRGFDRNSLVASLCNRVQNEGTVAYYLLLDNRFRASSGYMGAEFQETMEYGYHQINSSEAVASPVGQHLPGIMDFQQVGARQFPVERKWALGLQSRAHPREIMTEVLKALQGLNVRWKKIGPYNMKCQWVPGVPGHHEGMSNNSIHNPFFGDDSTIIENGGVTIPNAVKFEVQLYKTREEKYLLDLQRVQGPQFLFLDLCAAFLAQLRVL

SEQ ID NO: 8238 - protein, 583 aa, Pseudomonas aeruginosa
MAIRRRFGAQFQGNGRTCFGLWAPDAREVRVETADGRDWPLEGSDSGWFEATLPCPPGTRYRYRIDGRPGVPDPASQFQPDGVHGHSQVLDHGTYAWRVDEWRGRPWHEAVIYELHVGLFGSYAEVERFLPRLVELGVTAVELMPLGEFPGRRNWGYDGVLPFAPASAYGTPEQLKHLIDSAHGMGLMVFVDVIYNHFGPDGNYLAQYAAAFFRDDRQTPWGQAIDFRRGEVREFFYENALMWLLDYRVDGLRFDAVHAIPDSAFLVEMARRLRGAAGPERHVHLVLENDDNRASLLRQGYDAQWNDDGHHALHVLLTGENDGYYQDYPEPLRCLARCLAEGFVYQGEANRHGRPRGEPSADLAPDAFVLFLQNHDQVGNRAFGERLSVLAEPQALRLAIALQLLAPMIPLLFMGEECAAREPFLYFTDHQGELADAVREGRRKEFGEFGRFGEGATLASLPDPNAVETFERSRPGLADCDPAWRGFYRQLLEIRHEHLIPRLRGARSLGVTTIAGAALSARWRLGDGSDWRIDFNPSPLEAEVEPPAAATWVLFLDNLACAEYRRGRLSPRSIAVSLEPAHE

SEQ ID NO: 8239 - protein, 285 aa, Anabaena variabilis
MTVKHLAIAPEGKKSLRLNWTNVAFFTTVHALALLAPWFFSWSALGLLLFLHWLFGSIGICLGYHRLLSHKSFQVPKWLEYAIATIGALAMQGGPIFWIGGHRQHHAHTEDVNLDPYSSQRGFWWSHMLWILYPRSEFFDYEIYQKYAPDLARQPFYRWLDRYFLLLQIPFGLLLYAIGGWSFVIYGVVLRAVLLWHSTWFVNSATHMWGYRTFNADDNARNLWWVSIVTYGEGWHNNHHTFPNVAKAGFQWWEVDVTWWSIKLLQTLGLAKKVVLPPSQRMNQG

SEQ ID NO: 8240 - protein, 485 aa, Candida tropicalis
MAPTFTNSNGQPIPEPFATQRVGQHGPLLLQDFNLIDSLAHFDRERIPERVVHAKGSGAYGVFEVTDDITDVCAAKFLDTVGKKTRIFTRFSTVGGELGSADTARDPRGFATKFYTEEGNLDLVYNNTPVFFIRDPSKFPHFIHTQKRNPETHLKDANMFWDYLTTNEESVHQVMVLFSDRGTPASYREMNGYSGHTYKWSNNKGEWFYVQVHFISDQGIKTLTNEEAGSLAGSNPDYAQEDLFKNIAAGNYPSWTCYIQTMTEAQAKEAEFSVFDLTKVWPHGKYPMRRFGKFTLNENPKNYFAEVEQAAFSPAHTVPHMEPSADPVLQSRLFSYADTHRHRLGTNYTQIPVNCPVTGAVFNPHMRDGAMNVNGNLGNHPNYLASDKPIEFKQFSLQEDQEVWHGAATPFHWKATPADFKQATELWKVLKKYPNQQEHLAHNVAVHASAADAPIQDRVIAYFTKVHPDLGDLIKKEILELSPRK

SEQ ID NO: 8241 - protein, 443 aa, Mesorhizobium loti
MMRKLSLLFAGALMGASAMSLVYGAPGSSANAAGSETYKQLAIFGDIFERVRAQYVTPPDDKSLVENAINGMLSSLDPHSSYMNAEQAQDMRVQTKGEFGGLGIEVTMENDLVKVITPIDDTPAAKAGVLAGDYIAKIDGEEVRGLTLNDAVDKMRGLVNTPIKLTILRQGADKPIELTVVRDIIKVKAVKFRVENDIGYMKITSFTEKTYDDLENAIDTIKKQVPDDKLKGYVLDLRLNPGGLLDQAVSVSDAFLKRGEIVSTRGRDPKDVTRFDAKPKQTDDINGKPMIVLVNGGSASASEIVAGALQDLRRVTVVGTQSFGKGSVQTIIPLGENGALRLTTALYYTPSGKSIQGKGITPDIKVDQPLPPELQGRDLTRGESDLKGHIKGADESKTGSGSAAYVPPDPKDDLQLIFAEQLLRGQKTDPAFPPNPEKAVLNQ

SEQ ID NO: 8242 - protein, 336 aa, Pseudomonas aeruginosa
MSRVTLSRYLIEQTRSHNTPADLRFLIEVVARACKEISHAVSKGALGGVLGSMGTENVQGEVQKKLDVMSNEILLEANEWAGNLAGMASEEMDHPYQIPGRYPKGAYLLVFDPLDGSSNIDVNVSVGTIFSVLRCPNEYLNQNDTLREEAFLQPGTTQVAAGYAIYGPQTMLMLTLGNGVKGFTLDRELGSFVLTHDNISVPESTAEFAINMSNQRHWEAPVKRYVEELLAGKEGPLGKNYNMRWIASMVADVHRILTRGGVFMYPRDAREPEKPGKLRLMYEANPMSFIIEQAGGAATNGTQRILDIKPENLHQRVAVFLGSKQEVERITGYHAE

SEQ ID NO: 8243 - protein, 635 aa, Lotus corniculatus
MCGICCVIGVPAGAESIRSTVLDRAKRIRHRGPDWTGVYAKGKNIIVHERLSIVDVETGNQPLKSADGKQVLVCNGEIYNHLQLRQSLKAPVQFATNSDSECILHLYNERGVGFVNSLNGIFGFVLIDEAKDTFIVARDHEGIIPLYYGWDETGALWVASELKALHDVCVRFEEFPPGHVLHGKVGSAGKLEKWYQPVWHDEAYVPAATAACDIKGLRESLEAAVERQMMTDVPYGVLLSGGLDSSVISAVAVRVAAKRAAAKADSKHTELGHVDPKSVVHSFSVGLKGSPDLKAAREVAAFIGTEHHEFVFTVDDGINALRDVIYHLETFDTTTIRASTAMYLMSRKIKALGVKMVLSGEGSDEVFGGYLYFHKAPDRVEFHKETVRKLKALNKFDCLRANKSTMAWGLEARVPFLDKEFLDFAMTLDPTHKMCGKHAGGRIEKWIVRKAFEGYLPPAILWRQKEQFSDGVGYSWIDSLKAFADAKVSDAQLAAAAFKFPENTPLTKESYLYRSIFETHYPEPAARACVPGGPSVACSTPAAIAWDAAFQKMADPSGRAVAGVHADAYAVAADDKTPDTSADAKHGTAAEHKASGATRAPFIAAANGIKCSAEAALPHALPKPVALASGKAEAE

SEQ ID NO: 8244 - protein, 140 aa, Triticum aestivum
MVSFDINDRTKIGLGLTGFGVLFSFLGILMLFDKGFLAMGNILFASGVSLTIGLKSTAQFFTKPKNHKGSIAFGIGLFLVLIGWPVFGMMAESYGFAVLFSGFWPTAAVYLQKNPTVGWIFQHPYVTSLLTRFRGRRAPV

SEQ ID NO: 8245 - protein, 452 aa, Neurospora crassa
MSAANGRQPEVQPCRYKVGKTLGAGSYSVVKECVHIDTGRYYAAKVINKRLMAGREHMVRNEIAVLKKVSMGHQNILTLVDYFETMNNLYLVTDLALGGELFDRICRKGSYYESDAADLIRATLSAVAYLHDHGIVHRDLKPENLLFRTPEDNADLLIADFGLSRIMDEEQFHVLTTTCGTPGYMAPEIFKKTGHGKPVDIWALGVITYFLLCGYTPFDRDSDFEEMQAILNADYSFTPLEYWRGVSDNAKDFIRRCLTIDPAKRMTAHEALQHPFVAGWARGTDGAEADKGANLLPTVKKNFNARRTLHAAIDTVRAINKLREGQFMNGGRSREPAKKAAAALGPTLGKEASMVSTASSNVTKDSGYATQPEGEGGSRDGDDVLMKDASVPAPTSSSPAPCRVSYGRAVSRIRLSRLVKACGMGLVLSDDQFLGLSSLTNGGWFCSIVIIF

SEQ ID NO: 8246 - protein, 455 aa, Caldicellulosiruptor saccharolyticus
MDMSFPKGFLWGAATASYQIEGAWNEDGKGESIWDRFTHQKRNILYGHNGDVACDHYHRFEEDVSLMKELGLKAYRFSIAWTRIFPDGFGTVNQKGLEFYDRLINKLVENGIEPVVTLYHWDLPQKLQDIGGWANPEIVNYYFDYAMLVINRYKDKVKKWITFNEPYCIAFLGYFHGIHAPGIKDFKVAMDVVHSLMLSHFKVVKAVKENNIDVEVGITLNLTPVYLQTERLGYKVSEIEREMVSLSSQLDNQLFLDPVLKGSYPQKLLDYLVQKDLLDSQKALSMQQEVKENFIFPDFLGINYYTRAVRLYDENSSWIFPIRWEHPAGEYTEMGWEVFPQGLFDLLIWIKESYPQIPIYITENGAAYNDIVTEDGKVHDSKRIEYLKQHFEAARKAIENGVDLRGYFVWSLMDNFEWAMGYTKRFGIIYVDYETQKRIKKDSFYFYQQYIKENS

SEQ ID NO: 8247 - protein, 176 aa, Pseudomonas aeruginosa
MSFNTEVQPGICMEPDAITQEYVFNHTMLRVKDPKRSLDFYSRVLGMRLLRRLDFEEGRFSLYFLAMTRGEEVPDAVDERQRYTFGRQSVLELTHNWGSESDDSQYHNGNQDPRGFGHICFSVPDLVAACERFETLGVNFVKPLDRGMKNVAFISDPDGYWVEIVQASLNGEMGRG

SEQ ID NO: 8248 - protein, 367 aa, Pseudomonas syringae
MHDPRTTTDLFSPVTLGSMELANRIVMAPVTRSRYGEDGVPNELHATYYAQRATAGLIVAEATNISAQGRGYAATPGIWSEQQVAGWRLVTDAVHAAGGKIVSQLWHVGRFSSVDLQPNGEAPVAPSAIKAEGNTYTAGGFVPVSMPRALETGEIPGIIEQYKHAAENAKRAGFDGIEVHSANSYLLDQFLRDSTNQRTDQYGGSIENRARLTLEVTQAIVDIWGSDRVGIRLSPVTPDAGNTAPDSNVMGLHGYLIQQLNTFNLAYLHFVEGATATSREVPEGVDMDALSAGFNGPFIGNNNYDLKMAIERRAQGKIDAVAFGRLFISNPDLVARLRHGAELTIAPRESYYGGGAKGYIDWPMGKY

SEQ ID NO: 8249 - protein, 267 aa, Helianthus annuus
MENSEAIEHEHDFSCIDRSMSFQNEDSGDISPQRRIGKGKIEIKRIENTTNRQVTFCKRRNGLLKKAYELSVLCDAEVALIVFSSRGRLYEYANNSVRGTIDRYKKSCLDPPSTGSVAEANAQFYQQEATKLRQQIANLQNQNRQFYRNIMGESLADMPGKELKNLESKLEKAINRIRAKKNELLFAEIEYMQKRELELHNSNQFLRARISENERAQQQHMSLMPGSSGYNDLGPHQSFDGLNDLQTNELQLNNNYSCQDQTPLQLV

SEQ ID NO: 8250 - protein, 365 aa, Pseudomonas syringae
MSETHKHVTAPFDRGHLKLKNRFAVAPMTRVSADEQGSATQAMTRYYERFAKGGFGLIITEGNYTDRRFSQGYRFQPGLTDDEQAQAWRATTDAVHRHGSVMIAQLMHAGALSQANRFVSESAGPSAIRPKGEQMAFYYGVGSYRVPRAMSDKDIAEAIDGFARAAQLAIGTAGFDGVEIHGANGYLLDQFLTDYSNQRTDQWGGEVGQRLRLTLEVIAAVKKVAGQAPVGVRLSQGKVNDFQHKWAGGEGDAEVIFAALADAGVDYIHVTEHEAWQPAFTQGQASLVELARRYAPDVALIANGGLHDPQKADQVLRQGADIIAVGKGALANPDLPELLRQGAPLRDFDPAILGPIANIKDSELV

SEQ ID NO: 8251 - protein, 247 aa, Helianthus annuus
MSFPNESGEMSPQRKLGRGKIEIKRIENTTNRQVTFCKRRNGLLKKAYELSVLCDAEVALIVFSSRGRLYEYANNSVKGTIDRYKKACLDPPSSGSVAEANAQFYQQEAAKLRQQIANLQNQNRQFYRNIMGESLGNMPAKDLKNLEGKLEKGISRIRSKKNELLFAEIEYMPKRENELHNNNQFLRAKIAENERSQQQHMSLMPGSSDYDLVPPHQPFDGRNYLQVNDLQPNNSYSCQDQTPLQLV

SEQ ID NO: 8252 - protein, 95 aa, Pyrus communis
MAAVGAVRDNQGVANSVETESLARYAVDEHNKKENDLLEFVRVLDDKVQVVSGTMHYLKIEATEGGKKKVYEAKVWVKPWENFKQVQEFKPVSDS

SEQ ID NO: 8253 - protein, 200 aa, Myrospermum sousanum
RVMAYKFHEDEHGEVVAESKRPDLEPYIGLHYPATDIPQASRFLFKQNRVRMIVDCHASPVGVIQDEGLMQPLCLVGSTLRAPHGCHAQYMANMGSIASLVMAVIINGNDEDTVCSRSSMRLWGLVVCHHTSARCIPFPLRYACEFLMQAFGLQLNMELQLASQSLEKRVLKTQTLLCDMLLRDSPIGIVTQSPNIMDLV

SEQ ID NO: 8254 - protein, 735 aa, Agrobacterium tumefaciens
MKKPLNSAEEKKTGDITKAEIEAIKSGLHSNPFALLGVHETPEGFSARCFIPGAEEVSVLTLDGNFVGELKQIDPDGFFEGRIDLSKRQPVRYRACRDDAEWAVTDPYSFGPVLGPMDDYFVREGSHLRLFDRMGAHPLKLEGVEGFHFAVWAPNARRVSVVGDFNNWDGRRHVMRFRKDTGIWEIFAPDVYAGCAYKFEILGANGELLPLKADPYARRGELRPKNASVTAPELTQKWEDQAHREHWAQVDQRRQPISIYEVHAGSWQRREDGTFLSWDELAAQLIPYCTDMGFTHIEFLPITEHPYDPSWGYQTTGLYAPTARFGDPEGFARFVNGAHKVGIGVLLDWVPAHFPTDEHGLRWFDGTALYEHADPRQGFHPDWNTAIYNFGRIEVMSYLINNALYWAEKFHLDGLRVDAVASMLYLDYSRKEGEWIPNEYGGRENLESVRFLQKMNSLVYGTHPGVMTIAEESTSWPKVSQPVHEGGLGFGFKWNMGFMHDTLSYFSREPVHRKFHHQELTFGLLYAFTENFVLPLSHDEVVHGKGSLIAKMSGDDWQKFANLRSYYGFMWGYPGKKLLFMGQEFAQWSEWSEKGSLDWNLRQYPMHEGMRRLVRDLNLTYRSKAALHARDCEPDGFRWLVVDDHENSVFAWLRTAPGEKPVAVICNLTPVYRENYYVPLPVAGRWREILNTDAEIYGGSGKGNGGRVQAVDAGGEIGAMLVLPPLATIMLEPEN

SEQ ID NO: 8255 - protein, 231 aa, Brassica napus
  misc_feature (105)..(105): Xaa can be any naturally occurring amino acid
MGRGKIEIKRIENSTNRQVTFCKRRNGLLKKAYELAVLCDAEVALIVFSTRGRLYEYGNNNIRATIERYKKASSDNANTHSVQEINAAYYQQESAKLRQQIQTIXNSNRNLMGDSLSALNVKELKQVENRLEKAISRIRSKKHELLLAEIENLHKREIKLDNESIYLRTKIAEVERFQPHHHQMVSGTEMTAIEALASRNYFAHNIMTIGSGSGAGHGCSYFDPDKKTHLG

SEQ ID NO: 8256 - protein, 380 aa, Escherichia coli
MTNKHPSLFSPFMLTEKIKLRNRIVMAPMTTWSANPDGTISEQELEFYKRRSQNVGLVITGCTYVTPSGIGFTHEFAAYDDRFINSLEKLAAAAKSGGAPAILQIFHAGNKAIPELVPNNDVISASASSVKSGDFMKRVVQSREMTENEIQETIRAFGDVTKRAIKAGFDGIELHGAHGFLLQNFFSPLFNQRNDRWGGDLEGRMRFPLAVLQEVKNVVYEYATKPFAIGYRISPEESATGGLRIEDTYKLLDRLISSGISYIHTSLVSINDSYPVESPNGPRTIELILNHIAGRVPVIAAGKIRTPSQAQEAISTGLPLVAIGKGLVINPEWVTLAESGRGHEIQTTLNPQLVPELTIPDKLWDQIQASKGTGWFPLMD

SEQ ID NO: 8257 - protein, 560 aa, Oryza sativa
MDAAATAATATAAAAMVWFRKGLRVHDNPALDAARRGGAAARLYPVFVLDPRYLRPDQAAPSPGSARAGVARVRFLLESLSDLDARLRRLGSRLLLLRARDDGDVAGTVCAALKDWNIGKLCFESDTEPYALARDKKVMDFAAASGIDVFSPVSHTLFDPAEIIEKFLFSFGKWKNGGRPPMTYQSFVAIAGEPPEPIMEEYSELPPVGDTGEYELLPVPRVEELGYGDISQEDLSLFRGGETEALKRMRESLHDKEWVAKFEKPKGDPSAFLKPATTVLSPYLKFGCLSSRYFYHCIQDIYRSTKKHTNPPVSLTGQLLWRDFFYTVAFGTPNFDQMKGNKICKQIPWTENEELFPAWRDGRTGYPWIDAIMIQLRKWGWMHHLARHSVACFLTRGDLFIHWEKGRDVFERLLIDSDWAINNGNWMWLSCSSFFYQYHRIYSPTSFGKKYDPNGNYIRHFIPVLKDMPKEYIYEPWTAPLSIQKKANCIIGKDYPKPVVDHAIASKECKKMMGEAYASNRLDDDKPDKGKSSNSSRRKLSAGSQVTPNSSKTKQLKRSS

SEQ ID NO: 8258 - protein, 449 aa, Aspergillus nidulans
MAGSKVVEKGSVDGAPAAKLHITELPMTWSNWYQHVNWLNCFFVLFIPLVGCIGAIWTPLRLHTAIFAIIYYFNAGLGITAGYHRLWAHCCYKATLPLQIYLALAGAGAGQGSIRWWSRGHRAHHRYTDTEKDPYSVRKGFWYSHIGWIIMKQNYKKVGRSDASDLDADPVVIWQHKNYINTALFMTLIFPTLVCGLGWGDWRGGFIYGGILRVFFIQQATNCVNSLAHWIGEQPFDDRNSPRDHVITALVTLGEGYHNFHHEFPSDYRNAIEWWQYDPTKWMIWIWKQVGLAYDLKQFRANEIEKGRLQQMQKKVDARRAALDWGVPLKELPVFSWDEFIAESANRALVAIGGVIHDVSDFIKEHPGGKTFISSAVGKDATAMFNGGVYQHSNAAHNLLAMKRVGVVRGGGEVEIWKDAKQPSKVSFPEMVRAGEQITRRTVPVLDRS

SEQ ID NO: 8259 - protein, 120 aa, Glycine max
  misc_feature (72)..(72): Xaa can be any naturally occurring amino acid
  misc_feature (88)..(88): Xaa can be any naturally occurring amino acid
  misc_feature (90)..(92): Xaa can be any naturally occurring amino acid
  misc_feature (95)..(95): Xaa can be any naturally occurring amino acid
  misc_feature (98)..(98): Xaa can be any naturally occurring amino acid
  misc_feature (100)..(102): Xaa can be any naturally occurring amino acid
  misc_feature (104)..(105): Xaa can be any naturally occurring amino acid
  misc_feature (107)..(107): Xaa can be any naturally occurring amino acid
  misc_feature (109)..(110): Xaa can be any naturally occurring amino acid
APPPIQRAWQIVDQIPGRATGAYSLSQGVKGLRDTISAGIEERDGYPANPDDIFMTDGASPAVHNMMQLLIXSENDGILRPIPQYPLXSXXXALXGRXLXXXYXXEXSXXGGEIPNQGAR

SEQ ID NO: 8260 - protein, 258 aa, Unknown
  Silicibacter sp. TM1040
MNILVAGGVRGAGNALFKWSNTPDAVYLERRILPVSQKLFAEPTAGALELTTRLVIAPLKHDRAGDTTAEVLERYAEYYAQRASAGLIITEGSQISAEARGYIQTPGIHTAAQAAAWRKVTDAVHAKGGKIVIQMWHVGRSTHAGFEPTATPEALTVGGIQRVIEDRVQAATYAKEAGFDGVELHVANGCLLEQFRKDRVNTRSDAYGGSAENRARLLFEVLDALATVWEPGRIAVRLAPFASLTMSSIAPPWPIPPR

SEQ ID NO: 8261 - protein, 730 aa, Haemophilus influenzae
MTTAVTQAIIDGFFDASNGDPFATLGMHETEQGIEIRTLLPDANRMVVIERESGKEITELDCVDERGFFVGVIPNCRQFFAYQLQVFWGNEAQIIEDPYRFHPMIDDLEQWLLSEGSMLRPYEVLGAHFMECDGVSGVNFRLWAPNARRVSIVGDFNYWDGRRHPMRFHSKSGVWELFLPKASLGQLYKFELIDCHGNLRLKADPFAFSSQLRPDTASQVSALPNVVEMTEARKKANQGNQPISIYEVHLGSWRRNLENNFWLDYDQIADELIPYVKEMGFTHIEFLPLSEFPFDGSWGYQPLGLYSPTSRFGSPEAFRRLVKRAHEAGINVILDWVPGHFPSDTHGLVAFDGTALYEHEDPREGYHQDWNTLIYNYGRNEVKNFLSSNALYWLERFGVDGIRVDAVASMIYRDYSRAEGEWIPNQYGGRENLEAIEFLKHTNWKIHSEMAGAISIAEESTSFAGVTHPSENGGLGFNFKWNMGWMNDTLAYMKLDPIYRQYHHNKMTFGMVYQYSENFVLPLSHDEVVHGKYSLLGKMPGDTWQKFANLRAYYGYMWGYPGKKLLFMGNEFAQGREWNYEESLDWFLLDENIGGGWHKGVLKLVKDLNQIYQKNRPLFELDNSPEGFDWLVVDDAANSVLAFERRSSNGERIIVVSNFTPVPRHNYRIGVNVAGKYEEILNTDSMYYEGSNVGNFGCVASEQIESHGRENSISVSIPPLATVYLRLKTK

SEQ ID NO: 8262 - protein, 491 aa, Nicotiana tabacum
MGFENEKNSSILSKLATNEELGENSPYFDGWKAYDNDPFHPLKNPNGVIQMGLAENQLCFDLIEEWIKRNPNASICTTEGIKSFRAIANFQDYHGLPEFRSAIAKFMEKTRGGRVTFDPERVVMAGGATGANETIIFCLADTGDAFLVPSPYYPAFNRDLRWRTGVQLIPIPCDSSNNFQITTKAVREAYENAQKSNIKVKGLILTNPSNPLGTTLDRDTLKNLLTFTNQHNIHLVCDEIYAATVFNTPQFVSIAEILDDETSHCNKDLVHIVYSLSKDMGLPGFRVGIVYSFNDAVVNCARKMSSFGLVSTQTQYLLAEMLSDERFVSNFLTESSKRLAKRHKHFTNGLEEVGIKCLRSNAGLFCWMDLRPLLKESTFDSEMSLWRVIINDVKLNVSPGSSFDCQEPGFFRVCFANMDDETVDIALARIRSFVGVKKSGDESTPILMEKKQQWKKNNLRLSFSKRMYDESVNLSPLSSPIPHSPLVRART

SEQ ID NO: 8263 - protein, 474 aa, Oryza sativa
METTSQDSQVIMGRYKLGRLLGRGTFAKVYKAYKLATGEAVAIKVFDKEAVQRSGTVEQVKREVDVMRRVHHRHVIRLHEVMATRSRIYFVMEYASGGELFTRLSRSPRFPEPVARRYFQQLITAVEFCHSRGVYHRDLKPENLLLDARGDLKVTDFGLSALDGGLRGDGLLHTTCGTPAYVAPEVLLKRGYDGAKADIWSCGVILFVLLAGYLPFNETNLVILYRNITESNYRCPPWFSVEARKLLARLLDPNPKTRITISKIMDRPWFQQATCPLGDMSLVASAPSVLLARKEASQQHDDEEDDGFAREKKKRSNVIMSSPVIDVRPSSMNAFDIISRSRGLDLSKMFDAEERRSEARFSTRETTTAIVSKLEEIAEAGRFSFKLKEKGRVELEGSQDGRKGALAIEAEIFKVAPEVHVVEVRKTGGDSPDFRDFYKQELKPSLGDMVWAWQGGDSPPLVPAAGRRPITKRS

SEQ ID NO: 8264 - protein, 331 aa, Rhodobacter sphaeroides
MAIELEDLGLSPDVADVMQRLARVGAGIARIISRNGLERDLGAGVGTNAGGDGQKALDVIADDAFRAALEGSAVAYYASEEQDEVVTLGEGSLALAIDPLDGSSNIDVNVSIGTIFSIFPAAAGPEASFLRPGTEQIAGGYIIYGPQCALVCSFGQGVQHWVLDLDAGIFRRMPDIRPLPAETSEFAINASNYRHWPQPIRAFVDDLVAGAEGPRGKNFNMRWIASLVAETHRILMRGGVFLYPGDERKGYERGRLRHVYECAPIAFLIANVGGGATDGCADILTALPDRLHARTPFVFGCASKVARVAAYHDLACEETSALFGSRGLFRS

SEQ ID NO: 8265 - protein, 75 aa, Nicotiana tabacum
LAEYTEFTGNFPAIAAQCLQKLPSSNNKFTYNCDHHTFNFLVEDGYGKFSFYLSVLASPFCIVFSIFYTFFFSSI

SEQ ID NO: 8266 - protein, 234 aa, Glycine max
  misc_feature (225)..(225): Xaa can be any naturally occurring amino acid
  misc_feature (228)..(228): Xaa can be any naturally occurring amino acid
MTVTASLHRLSRLRFIAKPQPFLSPHSTPSHFSLTPKTKKPNRFRFRFRSMAAEPKESPSNNPGLHTTPDEATKGYIMQQTMFRIKDPKVSLDFYSRVLGMSLLKRLDFPEMKFSLYFMGYEDTTEAPSNPIDKVVWTFSQKATIELTHNWGTESDPEFKGYHNGNSEPRGFGHIGITVDDTYKACERFQNLGVEFVKKPDDGKMKGIAFIKDPDGYWIEIFDRXTIXNGTQAP

SEQ ID NO: 8267 - protein, 449 aa, Glycine max
  misc_feature (54)..(54): Xaa can be any naturally occurring amino acid
  misc_feature (204)..(204): Xaa can be any naturally occurring amino acid
MEQKGGVLMQRYELGRLLGQGTFAKVYHARNIITGMSVAIKIIDKDKILKVGMXMRLIRHPHVVELYEVMASKTKIYFVMEHAKGGELFNKVVKGKLKEDDARKYFQQLISAVDYCHSRGVCHRDLKPENLLLDENGNLKVTDFGLSALAESKCQDGLLHTTCGTPAYVAPEVINRKGYDGIKADIWSCGVILYVLLAGHLPFXMTPRGEFKFPNWFAPDVRRLLSKILDPNPKTRISMAKIMESSWFKKGLEKPTITQNEDEELAPLDADGVFGACENGDPIEPAKNSKPCNNLNAFDIISYSSGFDLSGLFEETDRKKEERFTSDKPASIIISKLEEICRRLRLKVKKKDGGLFKLEGSKEGRKGPLGIDAEIFEITPVFHLVELKKSSGDTLEYQKLLKQEVRPALKDIVWNWQGEQPQPLQHGVVQKEEQPSYPGISEVVPQSTA

SEQ ID NO: 8268 - protein, 520 aa, Oryza sativa
MLMATVSPARREPTPQAVRASPMPSAAAALVRRGGGGSGGTVLGKYELGRVLGQGSFAKVYQARHLETDECVAIKVLDKEKAVKGGMVHLVKREINVLRRVRHPNIVQLFEVMASKTKIYFVMEYVRGGELFSRVSKGRLREDTARRYFQQLVSAVDFCHARGVFHRDLKPENLLVDENGDLKVSDFGLAAGPDQFDPDGLLHTFCGTPAYVAPEVLRRRGYDGAKADIWSCGVILFALMAGYLPFHDHNIMVLYRKIYNGEFRCPRWFSKDFTRLITRLLDANPKTRITVPEIIESDWFKKGYKPVKFYIEDDKLYNLSDDVLNLEPADPVPPPLGLAPPVPPPPQGDDPDGSGSESDSSVVSCPATLSTGESQRVRGSLPRPASLNAFDIISFSKGFNLSGLFEERGNEIRFVSGEPMSDIVKKLEEIAKVKSFTVRRKDWRVSIEGTREGVKGPLTIGAEIFELTPSLVVVEVKRKAGDNEEYEDFCNMELKPGMQHLVHQMLPAPNGTPVSEKVER

SEQ ID NO: 8269 - protein, 344 aa, Oryza coarctata
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKDNVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAKLEHNH

SEQ ID NO: 8270 - protein, 1131 aa, Zea mays
MSSSRPAHSSSSSSRTRQSSRARILAQTTLDAELNAEYEESGDSFDYSKLVEAQRSTPPEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFDLTGYDRVMAYKFHEDEHGEVFAEITKPGIEPYIGLHYPATDIPQAARFLFMKNKVRMICDCRARSVKIIEDEALSIDISLCGSTLRAPHSCHLKYMENMNSIASLVMAVVVNENEEDDEPEPEQPPQQQKKKRLWGLIVCHHESPRYVPFPLRYACEFLAQVFAVHVNKEFELEKQIREKNILRMQTMLSDMLFKESSPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKTKSLPWSDYEMDAIHSLQLILRGTLNDASKPAQASGLDNQIGDLKLDGLAELQAVTSEMVRLMETATVPILAVDGNGLVNGWNQKVAELSGLRVDEAIGRHILTLVEDSSVSLVQRMLYLALQGREEKEVRFELKTHGSKRDDGPVILVVNACASRDLHDHVVGVCFVAQDMTVHKLVMDKFTRVEGDYKAIIHNPNPLIPPIFGADQFGWCSEWNAAMTKLTGWHRDEVVDKMLLGEVFNSSNASCLLKSKDAFVRLCIVINSALAGEEAEKASFGFFDRNEKYVECLLSVNRKVNADGVVTGVFCFIHVPSDDLQHALHVQQASEQTAQRKLKAFSYMRHAINKPLSGMLYSRETLKSTGLNEEQMRQVRVGDNCHRQLNKILADLDQDNITDKSSCLDLDMAEFVLQDVVVSAVSQVLIGCQAKGIRVACNLPERSMKQKVYGDGIRLQQIVSDFLFVSVKFSPAGGSVDISSKLTKNSIGENLHLIDFELRIKHRGAGVPAEILSQMYEEDNKEQSEEGFSLAVSRNLLRLMNGDIRHLREAGMSTFILTAELAAAPSAVGR

SEQ ID NO: 8271 - protein, 357 aa, Rubrivivax gelatinosus
MPTGGKSTLTQFLIEERRKHPAATGELNALITDVSLACKAISRKVAFGGLAGVLGSAGSGNVQGEEQKTLDVLSNTMFLRATEWGGHVAGMVSEELEAPYTLPPQYARGKYLLMFDPLDGSSNIDVNVTVGSIFAIHRAPQPRQDPQPQDYLQPGTTMVCGGYAIYGPSTMLVLTLGDGTHAFTLDPQLGEWVLSHPNLRIPEKTREFAINASNSRFWEPAVKRYVDECLAGSTGPRGTDFNMRWIASLVAETHRILMRGGVFLYPRDSKDPNKAGRLRLLYEANPISFLIEQAGGMASTGRKRLLEVQPEDIHQRIGFVFGSTEEVARIEAYHRDEPPTPYNSPLFGKRGLFAEAG

SEQ ID NO: 8272 - protein, 1353 aa, Pseudomonas syringae
MKKSSLTWLVGWMAVVLLAGLSVSFIASHEQRRSIDARIGQALKEAGEGIGDNLQARLRVYEYRLRGLRGAVHMLDLQHINSSQMGRYSKGRNIEKEYPGARGFGFIRRVAASDEAEFVRRVREDGRPDFSLSRLSGPGTRQGDRFIIQFIDPLDRNVQALGLDITSEEHRRDAALQAMRSGAATLSAPITLLQDNDDHMRAFLFLLPVYSTPEIPTDIAQRETSLIGWTYAPLAMREVMSNLDPLNHRLHLKLYDVNEGRQLIYQTPENDHDQEVLQTYAFEREIYGRVWRMEVGAHPAFIAALDPVPAGRVFIIGTLVSLMLTVLVGTLLLSRQRKQQVVAGQARLATIVENSSDAIIGEALDGRIITWNRAAEQMFGYDEHEVLGRPLAPLLVPPELVHEDEQLLERVARGERGPTLETRRLHKNGQLIDVTITCSFIRETDGTLLGAAKMMHDITDRKRVERYLMEFNAQLEQQVSERTAELSRVAGLLQGVLDASSEVSIIATDTQGQIFVFNRGAELLLGYSNSEMLSGNGPGVFHLPEEVAARSAELSREYGTLIEGIDVFCYKASREGSETRQWTYVRKDGTTVPVLMIITPIRTADGELIGHLGIAQDITERLHHSAELHAAKSSAEAANAAKSLFLANMSHEIRTPMNAVIGISHLLHNTALNDQQRQLLTKLQIAGRTLLGIINDILDIAKIEAGEMRLEHNPFSPRQLLDELGELFTPQAQEKGLRFSVNVVASLPGQLIGDALRVNQILMNLVGNALKFTSVGGVDVTVSREDDHADTCCLRFSVQDTGCGIPGDVLGQLFSPFTQADASTTRRFGGTGLGLSVVRGLAEQMGGRIGVESELGTGSEFWVELPFQISQSDLEPSGPGSSLEVMLLSDDAQSSMALQRLCRGLGWRVASLTGEHDLRTALQERNHVNAALPDVLLVDWQQPQVEEVQQLIEATPLPVILVTSSEIRAELHPLVDKVLLKPLDSSALFNAVNACIARYQGSTERVIQATRMDTSMTLWLSGLHLLLVDDSEINLEVASLLLQQQGAVVQTCSNGLLALERLRQTPDFFDAVLMDVQMPEMDGYEATRRLRSELGLTRLPVLALTAGALAEERRQAELAGMDDFLTKPLDPAALIRAVRRAVERVRGAPLAVGTLLQEASTGSAWPVIEGIDTQEVAARLGNDVPLFLSSLRRFFSEFAAFGESESVLARARQNPDQTMADLHKLRGSALLLGATQVGLHAGQAETLLRNAADPEQAVRALSAAFRSLQERTPVLEERPLAPRIDADPDVSRQALSTLRELLENHDIAALDQFPLAAVALQELAGQALVEQLWQTIEGLEFEQALHLLERAEL

SEQ ID NO: 8273 - protein, 491 aa, Solanum tuberosum
DPSKYRPSSAYDTPFLTTNAGGPVYNNVSSLTVGPRGPVLLEDYYLIEKLATFDREKIPERVVHARGASAKGFFEVTHDISHLTCADFLRAPGAQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKEGKAHYVKFHWKPTCGVKSMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAEQYPIPACVLNGRRTNCVIPKENNFKQAGERYRSWESDRQDRYITKWVESLSDPRVTHEIRSIWISYLSQADKSCGQKVASRLTVKPTM

SEQ ID NO: 8274 - protein, 193 aa, Arabidopsis thaliana
  misc_feature (60)..(60): Xaa can be any naturally occurring amino acid
MEEKKTESTNKNVKKANLLDHHSIKHILDESVSDIVTSRGYKEDVRLSNLKLILGTIIIXLLLLVAQFYNKEFPENRDFLIGCIALYVVLNAVLQLILYTKEKNAILFTYPPEGSFTSTGLVVSSKLPRFSDQYTLTIDSADPKSISAGKSVQLTKSVTQWFTKDGVLVEGLFWKDVEALIKNYAEEEPKKKK

SEQ ID NO: 8275 - protein, 294 aa, Escherichia coli
MEGLTVEFSVLSNNLKMPMMGFGVFQVTDKNVCKQSVLNAIRTGYRLIDTAAVYGNEDAVGEAVREAISEGLCTREELFITSKLWVQDMLNQDTAAAGIEASLKKSGLEYFDLYLLHQAMRDYFSAWRALEDAYEEGKLKAIGVSNFYPHVLANFCETVRVKPMVNQVELHPYFAQPEALATMKYYNVQPEAWAPLGGGRHKPFENNLLQSIADAHQKSISQVILRWNIQRGVVVIPKSTHQQRIEENFAIWDFSLTEKEMAQISSLDLGYVGESVKHFNPEFVRGCLAVKIHD

SEQ ID NO: 8276 - protein, 209 aa, Austrosteenisia blackii
DRVMAYKFHEDDHGEVIAEITKPGLEPYLGLHYPATDIPQAARFLFMKNKVRMIVDCHAKHVKVLQDEKLPFDLTLCGSTLRAPHSCHLQYMANMNSIASLVLAVVVNDNEEDGDSSDAVQPQKRKRLWGLVVCHNTTPRFVPFPLRYACEFLAQVFAIHVNKEIELEYQIIEKNILRTQTLLCDMLMRDAPLGIISQSPNIMDLVKCD

SEQ ID NO: 8277 - protein, 417 aa, Zea mays
  misc_feature (203)..(203): Xaa can be any naturally occurring amino acid
  misc_feature (208)..(208): Xaa can be any naturally occurring amino acid
MAAAFDAYTDKNAVFRRLKAKPENKMCFDCNAKNPTWASVTYGIFLCLDCSAAHRSLGVHITFVRSTNLDSWTPDQLKMMAFGGNNRAHAFFKQHGWTDGGKVEAKYTSRAAELYRQMLTKEVAKSATTDNALPSSPVASEASKPPSDDFPEFKLPDVAAPPAENLNGKHEPKSPKAAPRSPKAATHSTFATSVKEPIGAKKXGGKTXGGLGVRKLTTKPNESLYEQKPEEPKPAVPALAASTKKGGQALHSRFEYVENESSADSRTGGSGSRVSGHVAPPKSSDFFQEYGMGNGFQKKSSNASKTQVEETDEARKKFSNAKAISSSQFFGTQNREEKEAQLSLQKFAGSSSISSTDLFGRNDADNSNLDLSAADLINRISFQASQDLSSLKDIAGETGKKLTSLASNFISDLDRIL

SEQ ID NO: 8278 - protein, 706 aa, Yersinia pestis
MCAQNTCSSDTEANLGMNKFVRLAAIAGLLLAGASYATDTTYRIDQLPQLRQEPEHATVSERVTSRFTRSHYRQFALDDQFSAKIFDRYLNMLDYSHNVLLASDVAQFADKKYSLDKELKSGQLDTPFALFNLAQKRRFERYQYALSVLDRPMVFTGNDTIDIDRAKAPWPSSEAELNALWDAKVKYDQLNLKLAGKTDKEIKETLTKRYQSAIKRLTQSNSEDVFQLIMNAFAREIDPHTNYLSPRNTEQFNTEMSLSLEGIGAVLQMDDDYTLINSMVPGGPAAKSKTIAVGDRVIGVGQAGKPMVDVIGWRLDDVVALIKGPKGSKVRLEILPAGKGTKPRTVTLTRERIRLEDRAVKMSVKTIGKERVGVLDIPGFYVGLTEDVKVQLQKLEKQNVSSIIIDLRSNGGGALTEAVSLSGLFIPSGPVVQVRDNNGKVREDSDTDGVVYYKGPLVVLVDRYSASASEIFAAAMQDYGRALIVGEPTFGKGTVQQYRSLNRIYDQMLRPEWPALGSLQYTIQKFYRVDGGSTQRKGVTPDIVMPTGVDPAETGENFEDNALPWDRINAASYTKTGDLKPWEPELLKNHAERIAANPEFQYIQKDIERYKALKDKRNIVSLNYAQREKENRDDDMTRLTRLNERFIREGKKPLKSLDDLPKDYQEPDPYLDETVNIALDLAHKEKAQPQIASRPVAAATAGATVK

SEQ ID NO: 8279 - protein, 205 aa, Austrosteenisia blackii
RTSSMRMIMGKVIAEIKKPGLEPYLGLHYPATDIPQATRFLFMKNKVRQIVDCRAKHVKVLQDKNIPFDLTLCGSTLRAPHSCHLQYMKNMNSSASLVMAVVVNDNNEDGDSSDAFQPQKRKRLWGLVVCHHTTPRFVPFPLRYACEFLAQVFAYLVNKELEIAYQIVEKNILRTQTLLCDMLMRDAPLGIVSQSPNIMDLVKCD

SEQ ID NO: 8280 - protein, 831 aa, Arabidopsis thaliana
MSEPKVRRWVGKYEVGRLIGECNFGKLRSAVDTETGDPVALMILDKDKVLKHKMAEQIKREISIMKLINHPNVVQLYEVLASKAKIYIVLEFISGGKLFDKIKNDGRMNEDEAQRYFQQLINAVDYCHSRGVYHRDLKPENLLLDAQENLKVAEFGLIALSQQAGGDGLRHTACGNPDYAAPEVLNDQGYDGAKADLWSCGVILFVLLAGYLPFEDSSLTTLYKKISSADFSCPPWLSSGVKNLIVRILDPNPMTRITIPEILEDVWFKKDYKPAVFEEKKEANLADVEAVFKDSEEGRVQLRSFPCVICSGGTTCGDVRSRTKLMNGLIERGRPQEAHSIFNTLIEEGHKPSLITYTTLVTALTRQKHFHSLLSLISKVEKNGLKPDTILFNAIINASSESGNLDQAMKIFEKMKESGCKPTASTFNTLIKGYGKIGKLEESSRLLDMMLRDEMLQPNDRTCNILVQAWCNQRKIEEAWNIVYKMQSYGVKPDVVTFNTLAKAYARIGSTCTAEDMIIPRMLHNKVKPNVRTCGTIVNGYCEEGKMEEALRFFYRMKELGVHPNLFVFNSLIKGFLNINDMDGVGEVVDLMEEFGVKPDVVTFSTLMNAWSSVGDMKRCEEIYTDMLEGGIDPDIHAFSILAKGYARAGEPEKAEQILNQMRKFGVRPNVVIYTQIISGWCSAGEMKKAMQVYKKMCGIVGLSPNLTTYETLIWGFGEAKQPWKAEELLKDMEGKNVVPTRKTMQLIADGWKSIGVSNSNDANTLGSSFSTSSKLNIPNNIASSRSPLFLKGMPEKPKLCIKSQFGLRQTLLVVLCRDQIGEAGRFCKFM

SEQ ID NO: 8281 - protein, 193 aa, Austrosteenisia blackii
MAYKFHEDDHGEVVSEIRRSDLEPYLGLHYPATDIPQASRFLFKQNRVRMICDCHAKPVKVIQSEELRQPLCLVNSTLRSPHGCHTQYMANMGSIASLVMAVTVNGNDTRRLWGLLVCHHTSPRYVPFPVRYACEFLMQAFGLQLYMEIQLASQMAEKRILKTQTLLCDMLLRDAPFGIVSQSPNIMDLVKCD

SEQ ID NO: 8282 - protein, 546 aa, Sulfolobus tokodaii
MRLLEPFYIRDVELKNRVVMSPMITNLGAPEGYPTEEHIRYFVRRASAGLLITEYTYVNKVDARGSPNQLGLYDDELIPKFARLTEAVHNMDSKIFVQLVHVGRKTRRSLIWNNDPIAPSNIPLLDPVREMTEDDINRVIMDFVKASERAEKSGFDGIELHGAHGYLIAQFLSPATNKREDKYKDGVIFLEELLKEIRRVVSIPVGMRISVTEFDPQGLTPELVAKIVKRVENLLDYIHLSAGRDGPLGGSSSFYYKRPSYVDEAKVVRKVTNLPLLLVGSVSTVEDAEKVLEVADAVVLGRQILADPDWVIKVKNNLPIRPCIRCNQLCRLLSTREVRCDVNPELGWEILNLEKGEGEVRIVGGGVMGLETARVLALRGFEVKIYEKKDKIGGQLNEIRDPWKREEFSRLIDYYEKELKRLGVKIYLSTEERKADIFALPKERQPEFKEYKGMRILVNSNLYAYQDYVFEWLKHNEVYITENVFKGLDRNRSYLLQQKYKELGVNIVKENVKADIVINDVRRNQPSIGQSIARGYWLGMTFKLKY

SEQ ID NO: 8283 - protein, 439 aa, Arabidopsis thaliana
MNRPKVQRRVGKYEVGKTLGQGTFAKVRCAVNTETGERVALKILDKEKVLKHKMAEQIRREICTMKLINHPNVVRLYEVLASKTKIYIVLEFGTGGELFDKIVHDGRLKEENARKYFQQLINAVDYCHSRGVYHRDLKPENLLLDAQGNLKVSDFGLSALSRQVRGDGLLHTACGTPNYAAPEVLNDQGYDGATADLWSCGVILFVLLAGYLPFEDSNLMTLYKKIIAGEYHCPPWLSPGAKNLIVRILDPNPMTRITIPEVLGDAWFKKNYKPAVFEEKEEANLDDVDAVFKDSEEHHVTEKKEEQPTSMNAFELISMSRALDLGNLFEEEEGFKRETRFAAKGAANDLVQKIEEASKPLGFDIQKKNYKMRLENVTAGRKGNLRVATEIFQVSPSLHMIEVRKTKGDTLEFHKFYKKLSTSLNDVVWKSGESSGLSK

SEQ ID NO: 8284 - protein, 398 aa, Burkholderia vietnamiensis
MLNSLLDFLSHGLLRFSWWQVALFALAVTHVTIIGVTVYLHRCQAHRALELHPIASHFFRVWLWMTTGMLTGQWAAIHRKHHAKCETEEDPHSPQTRGIWKVFLEGAELYRAEAKNEETMRKFSHGTPNDWIERNVYSKYPILGVSLMMVIDVALFGVLGLTVWAVQMVWIPFWAAGVVNGFGHFWGYRNFNSADASTNLFPWGIVIGGEELHNNHHTFATSAKLSNKWYEFDIGWMYIRIMSAFGLAKVKKIAPTPRLNKPKTVLDQETLQAVLSNRYEVMARYGKAVKRAYRQELAHLKELGSRDKYQLMRGARKWFHKDADGLDEPQKKLLPEIFANSQKLHTYYQLRQDLAAIWDRSTASREQLLAQLQDWCHRAEQSGIKSLQEFATRLRRYA

SEQ ID NO: 8285 - protein, 468 aa, Zea mays
MVEGEAEAEAEVKKGGVLQGRYELGHVLGHGNFGRVHEARDLRTGRGVAVKVLAKDKLLRTGMMEQIKREIAVMKRVSHPNIVELHEVMATRTKIYLALELVRGGDLLARIARSGRVREDVARRYFRQLVSAVDFCHARGVFHRDLKPENLLVDEAGNLKVVDFGLSALADHARADGLLHTICGTPGYVAPEVFRNRGYDGAKADVWSCGVVLYVLLAGSLPFPKDSIAAMFIKMSRRDYRCPPWLSTEARRLIPKLLDPDPDTRITVAQIVETPWFNKPSVSRAVTAAAAEPPAEAACSAKDSGGGDKDELPETLNAFHLISLSAGLDLSPLFDVEGGPARGHREDGMRFATREPASGVVSRLEEVAARSGGRMRVTKSGARGVRLEGAGRGGRKGRLAVAADIFCLAPSVLVVDIKKDGGDTLEYRSFCSEVLRPALKDIVWAADPHPAAAAVDAVRPPSDHCSGS

SEQ ID NO: 8286 - protein, 547 aa, Pasteurella multocida
MAAKDVKFGNDARVKMLAGVNILADAVKVTLGPKGRNVVLDKSFGAPTITKDGVSVAREIELEDKFENMGAQMVKEVASKANDAAGDGTTTATVLAQAIVNEGLKAVAAGMNPMDLKRGIDKAVTAVVTELKALSKPCETSKEIEQVGTISANSDSIVGQIIAQAMDKVGKEGVITVEDGTGLEDELAVVEGMQFDRGYLSPYFINKPETATVELDNPFILLVDKKVSNIRELLPVLEGVAKAGKPLLIIAEDVEGEALATLVVNTMRGIVKVAAVKAPGFGDRRKAMLQDIAILTAGTVISEEIGMELEKATLEDLGQAKRVVINKDNTTIIDGIGDEAQIQGRVAQIRQQIEESTSDYDKEKLQERVAKLAGGVAVIKVGAATEVEMKEKKARVEDALHATRAAVEEGIVAGGGVALIRAANKVAGLQGDNEEQNVGIKLALRAMEAPLRQIVANAGEEASVVASAVKNGEGNFGYNAGTEQYGDMIEMGILDPTKVTRSALQFAASVAGLMITTECMVTDLPKEDKADLGAAGMGGMGGMGGMM

SEQ ID NO: 8287 - protein, 425 aa, Arabidopsis thaliana
MNRRQQVKRRVGKYEVGRTIGEGTFAKVKFARNSETGEPVALKILDKEKVLKHKMAEQIRREIATMKLIKHPNVVQLYEVMASKTKIFIILEYVTGGELFDKIVNDGRMKEDEARRYFQQLIHAVDYCHSRGVYHRDLKPENLLLDSYGNLKISDFGLSALSQQVRDDGLLHTSCGTPNYVAPEVLNDRGYDGATADMWSCGVVLYVLLAGYLPFDDSNLMNLYKKISSGEFNCPPWLSLGAMKLITRILDPNPMTRVTPQEVFEDEWFKKDYKPPVFEERDDSNMDDIDAVFKDSEEHLVTEKREEQPAAINAFEIISMSRGLNLENLFDPEQEFKRETRITLRGGANEIIEKIEEAAKPLGFDVQKKNYKMRLENVKAGRKGNLNVATEVCYMRLDIQESVGDGLLNQCVFCLYGVTTSRYSK

SEQ ID NO: 8288 - protein, 589 aa, Pseudomonas aeruginosa
MCGISGEFRFDNQAADLAAVERITHHLAPRGPDAWGFHAQGPIALGHRRLKIMDLAEASGQPMIDPDLGLAMVFNGAIYNYPELRGELESLGYRFFSGGDTEVLLKGYHAWGADLLPRLNGMFAFAVWERDRQRLFLARDRLGIKPLYYSLDRSRLRFASSLPALLKGGDIASDLDPQALNFYLNFHAVVPAPHTLLEGVKKLPPATWMSVDLDGSCEQRTWWTLDYGPRPDERELTLDDWQERVLDGLREAVAIRQRAAREVGVLLSGGVDSSLLVGLLHEAGVDNLLTFSIGFEDAGGERGDEFQYSDLIAERYHTRHHRLRIGEHEVIEQLPAAFRAMSEPMVSHDCIAFYLLAREVSKHCKVVQSGQGADELFAGYHWYPKVDGADDAFAAYRAAFFDRDHEEYLATVGERFRVEDVAGRFVRDHFASPGAEAAVDKALRLDSTIMLVDDPVKRVDNMTMAWGLEARVPFLDYRLAELSARIPARFKLGDGGKQVLKGAARKVIPSEVIDRPKGYFPVPGLKHLQGRTREWVRELLLDPSQDRGLFQPAIFDRLLSDPDGDLTPLRGSKLWQLAALNLWLSEQGL

SEQ ID NO: 8289 - protein, 216 aa, Triticum aestivum
  misc_feature (204)..(204): Xaa can be any naturally occurring amino acid
MRRFLTDRARRAVAASLRGATRPAAPSPAPAPAAALSRPSPSAPSAMAAYMARAMSTSAAGTPPVSLDTINPKVLEFKYAVRGEIVTHAQNLEQELHKNPESLPFDEILYCNIGNPHSLGQQPVTFFREVLSLCDHPALLDKSETHALYSSDAIERAWQILEKIPGRATGAYSHSQGVKGLRDEIAAGIAARDGFHASGETSFXTDGASPQSHDDA

SEQ ID NO: 8290 - protein, 551 aa, Mesorhizobium loti
MAAKDVKFSRDARERMLRGVNILADAVKVTLGPKGRNVVIDKSFGAPRITKDGVTVAKEIELEDKFENMGAQMVREVASKTNDIAGDGTTTATVLAQSIVQEGHKAVAAGMNPMDLKRGIDLAVSEVVAALGKAAKKIKTSEEVAQVGTISANGDESVGKMIAEAMQKVGNEGVITVEEAKTAETELEVVEGMQFDRGYLSPYFVTNADKMVADLEDAYILLHEKKLSNLQAMLPVLEAVVQTSKPLLIISEDVEGEALATLVVNKLRGGLKIAAVKAPGFGDRRKAMLEDIAILTGGQVISEDLGIKLENVGLNMLGRAKKVSISKENTTIVDGAGKKAEIQGRVAQIKQQIEETTSDYDKEKLQERLAKLAGGVAVIRVGGATEVEVKEKKDRVDDALNATRAAVEEGIVAGGGVALLRASANIKAAGANADQAAGINIVRRALQAPARQIASNAGAEASIVAGKILENKGATFGYNAQTGEYGDMIAMGIVDPVKVVRTALQDAASVAGLLVTTEAMIAEAPKKESAGGGMPGGMGGGGMGGMGGMDF

SEQ ID NO: 8291 - protein, 211 aa, Bacillus halodurans
MSWFQLPLGPLQTNWYIQTNDQGEGIIFDPGGEVEKLITWLRDRQITPLAILLTHAHFDHIGAVEDVRNTFHIPVYIHENEKEWLIDPQRNGSSLFIPGSSIKAREAEHLITGEQDLSIGSFSYQVLETPGHSPGSLSYYAKEDKIVFSGDALFAGSIGRTDLPGGDHQLLLDSIHDKLLELPEDTTVASGHGPTTTIGHEMDGNPFLSGF

SEQ ID NO: 8292 - protein, 703 aa, Ashbya gossypii
MAGVPDNVKGVVELDPWLAPYGDILSARRFLADKWRHDIEHAVPGGRRSLVEFARDAYKSYGLHADAQSKSITYREWAPNATRAFLVGDFNGWDETSHELQNKDEFGVFTGVFGPGADGDFMIPHDSRVKVVFELADGSRIHRLPAWIKRATQPSKETAKEWGPSYEARFWNPASPYKFKHERPRLDPNVESLRIYEAHVGISTPEPRVGSYSEFTKDVLPRIRDLGYNAIQLMAIMEHAYYASFGYQVTNFFAVSSRYGTPEELKELIDTAHGMGIQVLLDVVHSHASKNVSDGLNMFDGTDYQYFHSISSGRGEHPLWDSRLFNYGSFEVQRFLLANLAFYIDVYQFDGFRFDGVTSMLYHHHGVGERGAFSGDYNEYLSDHSGVDHEALAYLMLANDLIHDMLPANGVTVAEDVSGYPTLCLPRSVGGCGFDYRLAMALPDMWIKLLKESKDEDWSMGHIVYTLVNRRYKEKVVAYAESHDQALVGDKTLAFWMMDAAMYTDMTVLKELTPVVDRGIALHKLIRLITHSLGGESYLNFEGNEFGHPEWLDFPNANNGDSYQYARRQFNLVDDGLLRYKHLYAFDKAMQEAEGKHKWLNTPQAYVSLKHETDKVISFERNGLVFIFNFHPTQSFTDYRIGVDEAGAYRIILNSDREEFGGHRRIEEENSVFHTTDLEWNGRRNFIQVYLPSRTALVLARNP

SEQ ID NO: 8293 - protein, 448 aa, Clostridium thermocellum
MSKITFPKDFIWGSATAAYQIEGAYNEDGKGESIWDRFSHTPGNIADGHTGDVACDHYHRYEEDIKIMKEIGIKSYRFSISWPRIFPEGTGKLNQKGLDFYKRLTNLLLENGIMPAITLYHWDLPQKLQDKGGWKNRDTTDYFTEYSEVIFKNLGDIVPIWFTHNEPGVVSLLGHFLGIHAPGIKDLRTSLEVSHNLLLSHGKAVKLFREMNIDAQIGIALNLSYHYPASEKAEDIEAAELSFSLAGRWYLDPVLKGRYPENALKLYKKKGIELSFPEDDLKLISQPIDFIAFNNYSSEFIKYDPSSESGFSPANSILEKFEKTDMGWIIYPEGLYDLLMLLDRDYGKPNIVISENGAAFKDEIGSNGKIEDTKRIQYLKDYLTQAHRAIQDGVNLKAYYLWSLLDNFEWAYGYNKRFGIVHVNFDTLERKIKDSGYWYKEVIKNNGF

SEQ ID NO: 8294 - protein, 512 aa, Arabidopsis thaliana
MANKYVSSVLKSLLVLLHLVFLSKQHVDSASIVKSLPGFEGQLPFELETGYIGVGEEEEVQLFYYFIKSERNPKEDPLILWLTGGPGCSAISGLLFENGPLTMKLDVYNGTLPSLVSTTYSWTKTSSIIFLDQPVGTGFSYSRTQQFNKPSDSGEAKRIHEFLQKWLGKHQVFSSNPFYVAGDSYSGLVVPATVQEISKGNYECCNPPINLQGYVLGNPLTDYTTGSNSRIPFAHGMALISDELYESLKKTCKGEYTNVHPRNTQCLKFVEEFNKCTNRIFQQLILDPLCETETPDCYIYRYLLTTYWANDATVREALQINKESIGEWVRCYYSIPYNNDIKSSMPYHVNNSISGYRSLIYSGDHDFEVPYLGTQAWIRSLNYSIIDDWRPWMVKNQIAGYTRTYANKMTFATIKGGGHTAESKPEEASIMFQRSFVEAPLGQWLTKGSLMLLQQDVWGSSPNYCDLLVDLQINGGKCAGDLQRCTIMDLIRKKKTKRSFSSILDWIKVARF

SEQ ID NO: 8295 - protein, 653 aa, Unknown
  Parachlamydia sp. UWE25
MYKFLICLICLTTFVLEAKSPDLSPKEVTFKANEIMKAHASQKQLSPTLTRRILNNYLENLDPNKTYFIESDIYEWTHPTDELLTNIIDDYNNSNFSTFESIHTALIKAILKRRQLENKIDYQSLPKNVRAEEFKDIPWVQTEEELIERLKRIRALQIETAAKLNDHMKENALQRIGKRQAKYEEEALNPKEQEKQPLILSNVLKATASALDAHTAYFTPGEAAQFMINVQQRLFGIGAQLRDDINGFTVIKIIEGGPAALGKELKLKDRIVAVNGEPVVGMDITDAVDLIRGEEHTPVILTVIRETTSTAGEKTEEKLDVTILRGEVILKESRFKSSYEPYGNGIIGYLKLYSFYQDRDSSSATDLEEEINKLKKNQNMFGLILDLRYNSGGLLSQAVAVTSLFITKGIVVSIKDENGKIQHLRDLDGTSTWDGPLIILVNRMSASASEIVAQTLQDYGRAIIVGDDHTYGKGSYQTFTLTTTEHEQVNPQGEYKVTRGRYYTVSGKTPQLSGVLSDIPIPGVLSESEIGEKYTKYPLENDHIKANFDDDLSDVPFLQRDKIRKLYKFGLQEKLDTYHPYFEVLKKNSSKRLENDPNYQNMLKEIRKKENSDIESMEDFGQNDLQLEEAYKIMKDLLIMMQEKGIPLISSKL

SEQ ID NO: 8296 - protein, 205 aa, Oryza sativa
MVQPKKKFRGVRQRHWGSWVSEIRHPLLKRRVWLGTFETAEEAARAYDEAAVLMSGRNAKTNFPVQRNSTGDLATAADRDARSNGGSRNSSAGNLSQILSAKLRKCCKAPSPSLTCLRLDPEKSHIGVWQKRAGARADSNWVMTVELNKEVEPTEPAAQPTSTATASQVTMDDEEKIALQMIEELLSRSSPASPSHGEGEGSFVI

SEQ ID NO: 8297 - protein, 550 aa, Wolbachia pipientis
MTNVVVSGEQLQQAFREVAAVIDSTVAITAGPRGKTVGINKPYGAPEITKDGYKVMKGIKPEKPLNAAITSIFAQSCSQCNDKVGDGTTTCSILTSSMIMEASKSIAAGNDRVGIKNGMQKAKDVVLKEVASMSRTISLEKIDEVAQVAIISANGDRSIGSNIADAVKKVGKEGVITVEESKGSKELEVELTTGMQFDRGYLSPYFITNNEKMIVELDDPYLLITEKKLNIIQPLLSILEAVVKSGKPLLIIAEDIEGEALSTLVINKLRGGLKVAAVKAPGFGDRRKEMLEDIAALTGAKYVIKDELGIKMEDLTLEDLGIAKNVKITKDNTTIVSENKVTNRVKARIEQIKSQIESSTSDYDKEKLRERLAKLSGGVAVLKVGGATELEVKERRDRVEDALHATRAAIEEGIVPGGGVALLYASSALDKLKGAGDEEQIGINIIKKVLNVPIKRLVKNAGLESAVIIDYLIKQNNKELIYNVEAMNYVNAFTAGVIDPAKVVRIAFETAISVASVLITTESMIVDVPSKDENASSPMSAGGMGRMNEF

SEQ ID NO: 8298 - protein, 629 aa, Aspergillus nidulans
MASQSPLFQPLRIGNVTLNHRVVMAPLTRLRADAKHVQLPMATTYYEQRASVPGTLLISEATIISPQHGGYPHAPGIWNSEQVAAWKKVTDAVHTKGSYIFCQFVAVGRVADPATLRADGGYEVTAPSAIPLDAENGVVPKELTEEDIQALIQTFVTAAKNAIAAGFDGVEVHGANGYLVDQFLQDVTNKRTDAWGGSVPNRARFGLEVARALVEAVGADRVGFRLSPWNTWQGMKMADPVPQFSYFAEKLKELKLAYLHVIESRVINNVDCDKTEGIEFLLEIWGKTSPVLVAGGYNPANAEAAFTEYKDNDIAVVFGRHFIANPDLPFRIREGLPLNKYDRDSFYAFMQEAGIGAATAIAFAAAGCTRIAITDLPGSGLNETHMKILAATSNKPNVMSYPGDISDESFVNSFIDQVFSAFKRIDYVVNCAGVLQKEFLRSTEVSCEQFDFINGVNYRGTWLVSRAALRKMVSQEPLSDGIEDGEWRQKSRGSIVNIASQLGVVSRAGAAAYCASKSAIIGLTRADAIDFSKDLIRVNCVCPGVIDTNMTTGDPETKEALAPAVQIAPMGRMGDPREVADAVLFLSSSRASFVQGHALVVDGGAWEGVSLQTSPLIRCGMSSTFRVSS

SEQ ID NO: 8299 - protein, 434 aa, Bartonella bacilliformis
MIRKVIFFVAGVFLSASLIVMAQSITTNNEQNTYKQLARFGDIFERVRTQYVTIPDDQKLIENAINGMLLSLDPHSSYMDAEKAKDMRDSTKGEFGGLGIEVTMENNLIKVVSPIDDTPAAKAGVLAGDFISKIDGKQISGQTLNEAVDQMRGPAGTPITLTINRFGVDKPLDIKIVRDIIKVKAVKYRVEGDIGYLRLIQFTEKTFSDLQAAIKDIQSKIPTDKLKGYVLDLRLNPGGLLDQAISVTDAFLNKGEIVSTRGRKQNDVMRFDAKLGDLTDEKPIIVLINGGSASASEIVAGALQDHRRATIIGTQSFGKGSVQTIIPLGENGALRLTTALYYTPSGTSIQGIGITPDIVVEQPLPEKYKGYDVTLGESELRGHIKGKQESDKGSGSAAFVPRDPKDDVQLNEAYKLLRGEITHAAFPPDPNKVF

SEQ ID NO: 8300 - protein, 195 aa, Poecilanthe falcata
RVMAYKFHEDDHGEVVSEIRRSDLEPYLGLHYPAKDIPQAARFLFKQNRVRMIFDCHAKPVNVIQSEELRQPLCLVNSTLRSPHGCHTQYMANMGSVASLVMAVIVNGNDTTRLWGLLVCHHTSPRYVPFPVRYACEFLMQAFGLQLYMEIQLATQLAEKRILKTQTLLCDMLLRDAPFGIVNQSPNIMDLVKCD

SEQ ID NO: 8301 - protein, 546 aa, Xanthomonas campestris
MAAKDIRFGEDARTRMVRGVNVLANAVKATLGPKGRNVVLEKSFGAPTITKDGVSVAKEIELADKFENMGAQMVKEVASKTNDNAGDGTTTATVLAQALIREGAKAVAAGMNPMDLKRGIDQAVKAAVVELKNISKPTTDDKAIAQVGTISANSDESIGNIIAEAMKKVGKEGVITVEEGSGLENELDVVEGMQFDRGYLSPYFINNQQSQSADLDDPFILLHDKKISNVRDLLPVLEGVAKAGKPLLIVAEEVEGEALATLVVNTIRGIVKVVAVKAPGFGDRRKAMLEDMAVLTGGTVISEEVGLALEKATIKDLGRAKKVQVSKENTTIIDGAGDTAAIESRVGQIKTQIEDTSSDYDREKLQERVAKLAGGVAVIKVGASTEIEMKEKKARVEDALHATRAAVEEGVVPGGGVALVRALVAVGELKGANEDQTHGIQIALRAMEAPLREIVANAGEEPSVILNKVKEGSGNYGYNAANGEFGDMVEFGILDPTKVTRSALQNAASIAGLMITTEAMVADAPKKDEPAMPAGGGMGGMGGMDF

SEQ ID NO: 8302 - protein, 168 aa, Oryza sativa
MKNMVFEKKKEKKEKEKCQQSCRSCSHFTCLVAQIAVSTISSLLFSTEIGLGLSGFGVLFSFLGIIMLFDKGFLAIGNILFVSGVSLTIGPKSTVQFFTKPKNHKGSIAFGIGFFLVLIGWPFFGMLAEAYGFVKLFRGFWPTAAVYLQKSPTFGWIFHHPLVTSVRL

SEQ ID NO: 8303 - protein, 918 aa, Salmonella typhimurium
MTNYSLRARMMILILAPTVLIGLLLSIFFVVHRYNDLQRQLEDAGASIIEPLAVSSEYGMNLQNRESIGQLISVLHRRHSDIVRAISVYDDHNRLFVTSNFHLDPSQMQLPAGAPFPRRLSVDRHGDIMILRTPIISESYSPDESAIADAKNTKNMLGYVALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELNPTQRDHLNTIERSANNLLAIINDVLDFSKLEAGKLILESIPFPLRNTLDEVVTLLAHSSHDKGLELTLNIKNDVPDNVIGDPLRLQQVITNLVGNAIKFTESGNIDILVEKRALSNTKVQIEVQIRDTGIGIPERDQSRLFQAFRQADASISRRHGGTGLGLVITQKLVNEMGGDISFHSQPNRGSTFWFHINLDLNPNVIIDGPSTACLAGKRLAYVEPNATAAQCTLDLLSDTPVEVVYSPTFSALPLAHYDIMILSVPVTFREPLTMQHERLAKAASMTDFLLLALPCHAQINAEKLKQGGAAACLLKPLTSTRLLPALTEYCQLNHHPEPLLMDTSKITMTVMAVDDNPANLKLIGALLEDKVQHVELCDSGHQAVDRAKQMQFDLILMDIQMPDMDGIRACELIHQLPHQQQTPVIAVTAHAMAGQKEKLLSAGMNDYLAKPIEEEKLHNLLLRYKPGANVAARLMAPEPAEFIFNPNATLDWQLALRQAAGKPDLARDMLQMLIDFLPEVRNKIEEQLVGENPNGLVDLVHKLHGSCGYSGVPRMKNLCQLIEQQLRSGVHEEELEPEFLELLDEMDNVAREAKKILG

SEQ ID NO: 8304 - protein, 607 aa, Bacillus cereus
MCGITGWVNWNKDLSNEHVILKKMANRIQHRGPDAEGFWFSPRAAFAHRRLIVIDPEGGAQPKTFRAGDYTYALTYNGEIYNFRELREHLQKCGHTFETHSDTEVLLHAYLEWKEDCVQHLNGIFAFALWDDQKQRLFLARDHLGVKPLFYTERNDSIIFGSEIKALLAHPSVPAEIDANGINEIFGLGLFRTPGCGVFKHIEEVRAGHSITFTRDKKVVTKYWNLESKVHTDSIEDTSSHILSILQDTVKRQLIADVPLVCMLSGGLDSSGITALAGKEFAAENKTLHTYSVDFVNSAKDFELTFARTGLDAPWVKRVSEHVGTSHHDIIVNAEELANRLFVPLRAKDLPSAGEMETSLYLLFCEMKKDATVALSGESADEVFGGYPWFHQEELLYVDKFPWLTNWKNTSPLLLHEVSNQCNLENYIDTRFQKAILEVPTLEGESKKSAKQRQMFYLFLTRFLPFLLDRKDRMSMAVGFEVRVPFCDYRLVEYLWNVPFNIKSIDNIEKGILRRALKPALPDDVRNRRKSAYPTSQDPHYLQTIRNLTLDMCSNKNNPIFSLINHSTLLAIANQSNKEINNFEARSAIEYMLQVNEWLKTYHIHIA

SEQ ID NO: 8305 - protein, 231 aa, Triticum aestivum
  misc_feature (8)..(8): Xaa can be any naturally occurring amino acid
  misc_feature (29)..(29): Xaa can be any naturally occurring amino acid
MGGSERTXVWFRRDLRIDDNPALAAAAGXAVLLLIWCPAEEGRFYPGRCSRWWLKESLAHLARSLEALGCPLVLIRAQSTLAALLQCVDSIGATRVVYNHLYDPISLVRDDKIKNELLGLGISMQSFNGDLLYEPWQVYDENGLAFTTFNMYWEKCMKLHIEISSSLAPWRLVPVSGIENICSSSIDDLGLESSKDEESSNALLSRAWSPGWRNAEKTLEDFVSHGLLDHR

SEQ ID NO: 8306 - protein, 152 aa, Arabidopsis thaliana
  misc_feature (113)..(113): Xaa can be any naturally occurring amino acid
  misc_feature (119)..(119): Xaa can be any naturally occurring amino acid
  misc_feature (127)..(128): Xaa can be any naturally occurring amino acid
  misc_feature (132)..(133): Xaa can be any naturally occurring amino acid
  misc_feature (138)..(139): Xaa can be any naturally occurring amino acid
  misc_feature (142)..(142): Xaa can be any naturally occurring amino acid
DWQMGDIIYTLTNRRWSEKCISYAESHDQALVGDKTIAFWLMDKDMYDFMAVDRPSTPLIDRGIALHKMIRLITMGLGGEGYLNFMGNEFGHPEWIDFPRGEQRLSDGSVIPXNNFSYXKCRRRFDXXGSDXXRYPGXXNFXQTSVEGDFEG

SEQ ID NO: 8307 - protein, 547 aa, Prosthecochloris aestuarii
MSRIFQALVMIAVLSFGILLGSRLQNDSLGPVFGYQKKLFDVINLISSRYVDDVDPDSLAESGIKGMVESLDPHTVYLSQDKVSYSKAEFKGNFEGIGIEFDIIRDTLVVVAPLTSGPSQDAGIMAGDRILAIDSVSAIGIASSAVVASLRGEKGSSVHLDLYRPFSKRFLHLDVKRDRIPTYSIDASFLLDDRTGYIRLSRFVSTTSDEFVQSLSDLKSRGMKGLVVDLRGNPGGYLEEAVEIADEFLAPDSLIVYTKSRHGGPDEIKYRSTADGDYQSGPLVILVDRGSASAAEILAGALQDSRRAPVVGELTFGKGLVQRQFDLYDGSAIRLTIARYYTPLGRQIQRDYDNGARGREDYYEDHSSLLASESFFDDREDLAVATDVDGVRVYRTDAVSLGEVADSAAVKAFGGVGGIIPDFWVLDDRPGEYFVMLQEKGVIEETALAVLDDSASRVRELGGSLDLFLEKYAENQRVERYLEMVCRRKNMTIDALELEREKTRIMIAVKSRIARQLFGIGGQIRVLVEEADKVLLVAREQLYKEVL

SEQ ID NO: 8308 - protein, 111 aa, Arabidopsis thaliana
  misc_feature (24)..(24): Xaa can be any naturally occurring amino acid
  misc_feature (34)..(34): Xaa can be any naturally occurring amino acid
IRNCPSVRIRAPVRLSLHFHWTNXYSDYRIGCSXPGKYKIVLDSDNSLFGGFNRLDDSAEFFTSDGRHDDRPCSFMVYAPCRTAVVYAAVDDDDDDERSSLVPIGLLPEDV

SEQ ID NO: 8309 - protein, 325 aa, Triticum aestivum
MAWWAGSMGGLDLRNHLAQFGGPAAGGAAMGGAEQAPTTPNSSGSNNHDDSSGAAQDSPTAGAGDNSPNPNAAISGSGPSGGGGGSGGGGSSSGRRPRGRPAGSKNKPKPPIIITRESPNTLRSHVLEIASGADIMEAVSTFARRRQRGVSVLSGSGVVGNVTLRQPAAPPGSVVTLHGRFEILSLSGAFLPSPCPPGATGLAVYLAGGQGQVVGGTVIGELVASGPVMVVAATFSNATYERLPLADEEPGEAAAAATGSDGMQLPDGPAPGGNGGMGAAVGVPGLPDPSSMPFYNLPPNLQMPNGGGQMAHDVFGSFRPPPPAF

SEQ ID NO: 8310 - protein, 421 aa, Lotus corniculatus
MNHCVVLCIIVVGFFFFFFLSQFVMQIKREISIMKLVRHPYVVRLYEVLASRTKIYIILEFITGGELFDKIIRHGRLSEAESRRYFQQLIDGVDYCHSKGVYHRDLKPENLLLDSLGNIKISDFGLSALPEQGVSILRTTCGTPNYVAPEVLSHKGYNGAVADVWSCGVILYVLLVGYLPFDELDLTSLYSKIEKAEYSCPPGFPVGAKTLIHKILDPNPETRITIEQIRNDEWFQRGYVPVSLLEYEDVNLDDVNAVFDDAEEQRANQQCDHEDMGPLMLNAFDLIILSQGLNLAAIFDRGQDSMKYQTRFITQKPAKVVLSSMEVVAQSMGFKTHIRNYKMRVEGLSAKKTSHFSVMLEIFEVAPTFYMVDIQKAAGDAGEYLKFYKNFCGNLEDIIWKPPHESTKSKVSKTRSKRRSR

SEQ ID NO: 8311 - protein, 441 aa, Streptomyces avermitilis
MIRRMATNPISQFPAGFLWGVSTSAHQIEGAADEREPSVWDAFTAEPGRVKDGSTAAVACDHYHRYAEDVALLADLGVDAYRFSVSWPRVNSPGGLDFYDRLVDELCAAGVRPVPTLFHWDLPLALDWLDRDTAARFAEYAARVAERLGDRVTKWITLNEPAEHTLLGHALGAHAPGRQLLFDALPAAHHQLLAHGLAVRALRAAGVTDIGIANSHGPTWPASQEPADLEAAAFYDLLLNRLFSDPLLLGRYPEGIGELMPKGSAGIESDLKVIAEPIDWYGINYYAPTKVGAPQGAEIEFGGLTLPAELPFSVREIEGHPVTDFGWPVVPQALTELLTGFRERFGDRLPPIVITENGCSYEGIDDQERIAYLDGHVRALHRAVEAGVDVRGYFVWSLLDNFEWAEGYERRFGLVHVDYDTLERTPKASYGWLRDALRARR

SEQ ID NO: 8312 - protein, 970 aa, Ustilago maydis
MAARTPAREAAAAKMAMPSSLLKRAALTASDETLLVSALKMLATFDNAKNTVFALVVYRYSTRLLRHVRAYGISESLYQLYCLVSAQVFALILKTPAAKRKVKRELDTAMAEVEAKIVPRPSHLGIHHQLPQLGKETEWIKTELAKLQIMEAGVDAKLVEADWENRDGQMVWKGGKVSGAVYHGGDDLSDLLADTIKQFLVSNPLHPDVFPGVRKMEAEVVSMVLKMYNAPAGAVGATSSGGTESILLSCLAMREWARATKGIKEPELIVSVSAHAAFDKAGQYFGIKVHHIPVDTVTRKVQVARVARAINSNTIGLVGSAPNFPDGIIDDIPNLAKLAKRHKILLHVDCCLGSFLVPFLEKAGFESEPFDFRIDGVTSISCDTHKYGFGPKGLSTILYRSADLRRFQYYVKTDWPGGVYATPTLSGSRPGSLIAGTWAAMMKIGESGYTQSCRDIVGAAKEISTRIEREIPELRVLGRPLVSVVAFASAAPNSVSIYDLITDLKAAVKHARSSFTGQKGSMATLYGLGSGVSATAIVGQLASSRLELQQLRLQDLVGLAQPCTLLCQGVQFLLGVHRLGVLLAEEDADFVAQGCALLHLARQLCAQVLVFELYTLQPILDVVQTCLCGLDEVDHLVPLVQELAHLHPLLLVLEHIRIPLDHFGAIALQLRVHLKQLCARLLELPSERNDACRIFLCLRLELSCLGRPRLALLSLGVLRLVRRAQRAHRVVQILSLRFQRCVGDLFAISKLSSLRSSRFSRCSNDTLVAWLPTLPSTAVRIVVSYDGMADNAVSLDASRAAVVGASAAKWLIASACRDVGDRGDVPLTVWLRDCNDDIEPDRERTRASDTCVAGDTGIEQATCEALELPIAVTIAGVAAAAALAAGSSFESVLLAAMPLAALVGIGVASSNLCAAAAMGWMAEPKSISVHVASLAASPAAPVETSGAPERNDAYVSRISSGFTERGSRCH

SEQ ID NO: 8313 - protein, 454 aa, Staphylococcus xylosus
PSGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVA

SEQ ID NO: 8314 - protein, 443 aa, Staphylococcus xylosus
GPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEKAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKA

SEQ ID NO: 8315 - protein, 447 aa, Staphylococcus xylosus
PLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVKTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAHG

SEQ ID NO: 8316 - protein, 177 aa, Callerya atropurpurea
YPATDIPQAARFLFMKNKVRMIVDCHAKHVKVLQDEKLPFDLTLCGSTLRAPHSCHLQYMANMDSIASLVMAVVVNDSEEDGDSSEAVQPQKRKRLWGLVVCHNTTPRFVPFPLRYACEFLAQVFAIHVNKEIELEYQILEKNILRTQTLLCDMLMRDAPLGIVSQSPNIMDLVKCD

SEQ ID NO: 8317 - protein, 454 aa, Staphylococcus xylosus
GPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEKAEQVMAKDKDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAEA

SEQ ID NO: 8318 - protein, 500 aa, Oryza sativa
MVLTHVEAVEEGSEAAAAVFASRYVQDPVPRYELGERSISKDAAYQIVHDELLLDSSPRLNLASFVTTWMEPECDRLILEAINKNYADMDEYPVTTELQNRCVNIIARLFNAPVGDGEKAVGVGTVGSSEAIMLAGLAFKRRWQNRRKAAGKPHDKPNIVTGANVQVCWEKFARYFEVELKEVKLTEGCYVMDPVKAVDMVDENTICVAAILGSTLTGEFEDVRRLNDLLAAKNKRTGWDTPIHVDAASGGFIAPFIYPELEWDFRLPLVKSINVSGHKYGLVYAGVGWVIWRNKEDLPEELIFHINYLGADQPTFTLNFSKGSSQIIAQYYQFLRLGFEGYKSVMKNCMESARTLREGLEKTGRFTIISKEEGVPLVAFTFKDGAGAQAFRLSSGLRRYGWIVPAYTMPAALEHMTVVRVVVREDFGRPLAERFLSHVRMALDEMDLAARAPVPRVQLTIELGPARTAGEEASIRVVKSEAVPVRKSVPLVAGKTKGVC
